United States Patent 11,096,956 (ANTISENSE OLIGOMERS AND USES THEREOF) - sequence listing, part 5

SEQ ID NO: 34064 - RNA, 18 nt, Artificial Sequence
  Description of Artificial Sequence: Synthetic oligonucleotide
uacuucuagaguaggccu

SEQ ID NO: 34065 - RNA, 18 nt, Artificial Sequence
  Description of Artificial Sequence: Synthetic oligonucleotide
uuuaguacuucuagagua

SEQ ID NO: 34066 - RNA, 18 nt, Artificial Sequence
  Description of Artificial Sequence: Synthetic oligonucleotide
auacuuuuaguacuucua

SEQ ID NO: 34067 - RNA, 18 nt, Artificial Sequence
  Description of Artificial Sequence: Synthetic oligonucleotide
aaacgauacuuuuaguac

SEQ ID NO: 34068 - RNA, 18 nt, Artificial Sequence
  Description of Artificial Sequence: Synthetic oligonucleotide
aucugaaacgauacuuuu

SEQ ID NO: 34069 - RNA, 18 nt, Artificial Sequence
  Description of Artificial Sequence: Synthetic oligonucleotide
cagguaucugaaacgaua

SEQ ID NO: 34070 - RNA, 18 nt, Artificial Sequence
  Description of Artificial Sequence: Synthetic oligonucleotide
gaguacagguaucugaaa

SEQ ID NO: 34071 - RNA, 18 nt, Artificial Sequence
  Description of Artificial Sequence: Synthetic oligonucleotide
caauagaguacagguauc

SEQ ID NO: 34072 - RNA, 18 nt, Artificial Sequence
  Description of Artificial Sequence: Synthetic oligonucleotide
ggcuccaauagaguacag

SEQ ID NO: 34073 - RNA, 18 nt, Artificial Sequence
  Description of Artificial Sequence: Synthetic oligonucleotide
guuuaggcuccaauagag

SEQ ID NO: 34074 - RNA, 18 nt, Artificial Sequence
  Description of Artificial Sequence: Synthetic oligonucleotide
aaacaguuuaggcuccaa

SEQ ID NO: 34075 - RNA, 18 nt, Artificial Sequence
  Description of Artificial Sequence: Synthetic oligonucleotide
ugccaaaacaguuuaggc

SEQ ID NO: 34076 - RNA, 18 nt, Artificial Sequence
  Description of Artificial Sequence: Synthetic oligonucleotide
auaaaugccaaaacaguu

SEQ ID NO: 34077 - RNA, 18 nt, Artificial Sequence
  Description of Artificial Sequence: Synthetic oligonucleotide
gauucauaaaugccaaaa

SEQ ID NO: 34078 - RNA, 18 nt, Artificial Sequence
  Description of Artificial Sequence: Synthetic oligonucleotide
guccagauucauaaaugc

SEQ ID NO: 34079 - RNA, 18 nt, Artificial Sequence
  Description of Artificial Sequence: Synthetic oligonucleotide
auuggguccagauucaua

SEQ ID NO: 34080 - RNA, 18 nt, Artificial Sequence
  Description of Artificial Sequence: Synthetic oligonucleotide
uuagcauuggguccagau

SEQ ID NO: 34081 - RNA, 18 nt, Artificial Sequence
  Description of Artificial Sequence: Synthetic oligonucleotide
ugucauuagcauuggguc

SEQ ID NO: 34082 - RNA, 18 nt, Artificial Sequence
  Description of Artificial Sequence: Synthetic oligonucleotide
cugugugucauuagcauu

SEQ ID NO: 34083 - RNA, 18 nt, Artificial Sequence
  Description of Artificial Sequence: Synthetic oligonucleotide
uuucacugugugucauua

SEQ ID NO: 34084 - RNA, 18 nt, Artificial Sequence
  Description of Artificial Sequence: Synthetic oligonucleotide
aauuuuuucacugugugu

SEQ ID NO: 34085 - RNA, 18 nt, Artificial Sequence
  Description of Artificial Sequence: Synthetic oligonucleotide
agacaaauuuuuucacug

SEQ ID NO: 34086 - RNA, 18 nt, Artificial Sequence
  Description of Artificial Sequence: Synthetic oligonucleotide
aucagagacaaauuuuuu

SEQ ID NO: 34087 - RNA, 18 nt, Artificial Sequence
  Description of Artificial Sequence: Synthetic oligonucleotide
cuugaaucagagacaaau

SEQ ID NO: 34088 - RNA, 18 nt, Artificial Sequence
  Description of Artificial Sequence: Synthetic oligonucleotide
cuguacuugaaucagaga

SEQ ID NO: 34089 - RNA, 18 nt, Artificial Sequence
  Description of Artificial Sequence: Synthetic oligonucleotide
auaaacuguacuugaauc

SEQ ID NO: 34090 - RNA, 18 nt, Artificial Sequence
  Description of Artificial Sequence: Synthetic oligonucleotide
uacaaauaaacuguacuu

SEQ ID NO: 34091 - RNA, 18 nt, Artificial Sequence
  Description of Artificial Sequence: Synthetic oligonucleotide
aguuuuacaaauaaacug

SEQ ID NO: 34092 - RNA, 18 nt, Artificial Sequence
  Description of Artificial Sequence: Synthetic oligonucleotide
aguauaguuuuacaaaua

SEQ ID NO: 34093 - RNA, 18 nt, Artificial Sequence
  Description of Artificial Sequence: Synthetic oligonucleotide
gaauaaguauaguuuuac

SEQ ID NO: 34094 - RNA, 18 nt, Artificial Sequence
  Description of Artificial Sequence: Synthetic oligonucleotide
uuguagaauaaguauagu

SEQ ID NO: 34095 - RNA, 18 nt, Artificial Sequence
  Description of Artificial Sequence: Synthetic oligonucleotide
caaauuuguagaauaagu

SEQ ID NO: 34096 - RNA, 18 nt, Artificial Sequence
  Description of Artificial Sequence: Synthetic oligonucleotide
cugaccaaauuuguagaa

SEQ ID NO: 34097 - RNA, 18 nt, Artificial Sequence
  Description of Artificial Sequence: Synthetic oligonucleotide
cauuucugaccaaauuug

SEQ ID NO: 34098 - RNA, 18 nt, Artificial Sequence
  Description of Artificial Sequence: Synthetic oligonucleotide
cacaacauuucugaccaa

SEQ ID NO: 34099 - RNA, 18 nt, Artificial Sequence
  Description of Artificial Sequence: Synthetic oligonucleotide
auagacacaacauuucug

SEQ ID NO: 34100 - RNA, 18 nt, Artificial Sequence
  Description of Artificial Sequence: Synthetic oligonucleotide
auauuauagacacaacau

SEQ ID NO: 34101 - RNA, 18 nt, Artificial Sequence
  Description of Artificial Sequence: Synthetic oligonucleotide
uagaaauauuauagacac

SEQ ID NO: 34102 - RNA, 18 nt, Artificial Sequence
  Description of Artificial Sequence: Synthetic oligonucleotide
cuuuuuagaaauauuaua

SEQ ID NO: 34103 - RNA, 18 nt, Artificial Sequence
  Description of Artificial Sequence: Synthetic oligonucleotide
aaucucuuuuuagaaaua

SEQ ID NO: 34104 - RNA, 18 nt, Artificial Sequence
  Description of Artificial Sequence: Synthetic oligonucleotide
gcuacaaucucuuuuuag

SEQ ID NO: 34105 - RNA, 18 nt, Artificial Sequence
  Description of Artificial Sequence: Synthetic oligonucleotide
acauggcuacaaucucuu

SEQ ID NO: 34106 - RNA, 18 nt, Artificial Sequence
  Description of Artificial Sequence: Synthetic oligonucleotide
uuuuaacauggcuacaau

SEQ ID NO: 34107 - RNA, 18 nt, Artificial Sequence
  Description of Artificial Sequence: Synthetic oligonucleotide
ugaguuuuuaacauggcu

SEQ ID NO: 34108 - RNA, 18 nt, Artificial Sequence
  Description of Artificial Sequence: Synthetic oligonucleotide
ucaguugaguuuuuaaca

SEQ ID NO: 34109 - RNA, 18 nt, Artificial Sequence
  Description of Artificial Sequence: Synthetic oligonucleotide
auacaucaguugaguuuu

SEQ ID NO: 34110 - RNA, 18 nt, Artificial Sequence
  Description of Artificial Sequence: Synthetic oligonucleotide
ggcacauacaucaguuga

SEQ ID NO: 34111 - RNA, 18 nt, Artificial Sequence
  Description of Artificial Sequence: Synthetic oligonucleotide
uaguuggcacauacauca

SEQ ID NO: 34112 - RNA, 18 nt, Artificial Sequence
  Description of Artificial Sequence: Synthetic oligonucleotide
aguuauaguuggcacaua

SEQ ID NO: 34113 - RNA, 18 nt, Artificial Sequence
  Description of Artificial Sequence: Synthetic oligonucleotide
aaaagaguuauaguuggc

SEQ ID NO: 34114 - RNA, 18 nt, Artificial Sequence
  Description of Artificial Sequence: Synthetic oligonucleotide
guaagaaaagaguuauag

SEQ ID NO: 34115 - RNA, 18 nt, Artificial Sequence
  Description of Artificial Sequence: Synthetic oligonucleotide
uagagguaagaaaagagu

SEQ ID NO: 34116 - RNA, 18 nt, Artificial Sequence
  Description of Artificial Sequence: Synthetic oligonucleotide
uacuuuagagguaagaaa

SEQ ID NO: 34117 - RNA, 18 nt, Artificial Sequence
  Description of Artificial Sequence: Synthetic oligonucleotide
uuucuuacuuuagaggua

SEQ ID NO: 34118 - RNA, 18 nt, Artificial Sequence
  Description of Artificial Sequence: Synthetic oligonucleotide
auuauuuucuuacuuuag

SEQ ID NO: 34119 - RNA, 18 nt, Artificial Sequence
  Description of Artificial Sequence: Synthetic oligonucleotide
aggaaauuauuuucuuac

SEQ ID NO: 34120 - RNA, 18 nt, Artificial Sequence
  Description of Artificial Sequence: Synthetic oligonucleotide
aaucuaggaaauuauuuu

SEQ ID NO: 34121 - RNA, 18 nt, Artificial Sequence
  Description of Artificial Sequence: Synthetic oligonucleotide
ggauaaaucuaggaaauu

SEQ ID NO: 34122 - RNA, 18 nt, Artificial Sequence
  Description of Artificial Sequence: Synthetic oligonucleotide
guuuaggauaaaucuagg

SEQ ID NO: 34123 - RNA, 18 nt, Artificial Sequence
  Description of Artificial Sequence: Synthetic oligonucleotide
agcauguuuaggauaaau

SEQ ID NO: 34124 - RNA, 18 nt, Artificial Sequence
  Description of Artificial Sequence: Synthetic oligonucleotide
acaucagcauguuuagga

SEQ ID NO: 34125 - RNA, 18 nt, Artificial Sequence
  Description of Artificial Sequence: Synthetic oligonucleotide
uauauacaucagcauguu

SEQ ID NO: 34126 - RNA, 18 nt, Artificial Sequence
  Description of Artificial Sequence: Synthetic oligonucleotide
acucuuauauacaucagc

SEQ ID NO: 34127 - RNA, 18 nt, Artificial Sequence
  Description of Artificial Sequence: Synthetic oligonucleotide
guauuacucuuauauaca

SEQ ID NO: 34128 - RNA, 18 nt, Artificial Sequence
  Description of Artificial Sequence: Synthetic oligonucleotide
uuaagguauuacucuuau

SEQ ID NO: 34129 - RNA, 18 nt, Artificial Sequence
  Description of Artificial Sequence: Synthetic oligonucleotide
aacaauuaagguauuacu

SEQ ID NO: 34130 - RNA, 18 nt, Artificial Sequence
  Description of Artificial Sequence: Synthetic oligonucleotide
ccauaaacaauuaaggua

SEQ ID NO: 34131 - RNA, 18 nt, Artificial Sequence
  Description of Artificial Sequence: Synthetic oligonucleotide
aaaaaccauaaacaauua

SEQ ID NO: 34132 - RNA, 18 nt, Artificial Sequence
  Description of Artificial Sequence: Synthetic oligonucleotide
ggaagaaaaaccauaaac

SEQ ID NO: 34133 - RNA, 18 nt, Artificial Sequence
  Description of Artificial Sequence: Synthetic oligonucleotide
guccaggaagaaaaacca

SEQ ID NO: 34134 - RNA, 18 nt, Artificial Sequence
  Description of Artificial Sequence: Synthetic oligonucleotide
agaguguccaggaagaaa

SEQ ID NO: 34135 - RNA, 18 nt, Artificial Sequence
  Description of Artificial Sequence: Synthetic oligonucleotide
agaaaagaguguccagga

SEQ ID NO: 34136 - RNA, 18 nt, Artificial Sequence
  Description of Artificial Sequence: Synthetic oligonucleotide
ucuguagaaaagaguguc

SEQ ID NO: 34137 - RNA, 18 nt, Artificial Sequence
  Description of Artificial Sequence: Synthetic oligonucleotide
uguuuucuguagaaaaga

SEQ ID NO: 34138 - RNA, 18 nt, Artificial Sequence
  Description of Artificial Sequence: Synthetic oligonucleotide
aguuguguuuucuguaga

SEQ ID NO: 34139 - RNA, 18 nt, Artificial Sequence
  Description of Artificial Sequence: Synthetic oligonucleotide
caaaaaaauacaaggcag

SEQ ID NO: 34140 - RNA, 18 nt, Artificial Sequence
  Description of Artificial Sequence: Synthetic oligonucleotide
uaggucaaaaaaauacaa

SEQ ID NO: 34141 - RNA, 18 nt, Artificial Sequence
  Description of Artificial Sequence: Synthetic oligonucleotide
uuugauaggucaaaaaaa

SEQ ID NO: 34142 - RNA, 18 nt, Artificial Sequence
  Description of Artificial Sequence: Synthetic oligonucleotide
augauuuugauaggucaa

SEQ ID NO: 34143 - RNA, 18 nt, Artificial Sequence
  Description of Artificial Sequence: Synthetic oligonucleotide
gaaaaaugauuuugauag

SEQ ID NO: 34144 - RNA, 18 nt, Artificial Sequence
  Description of Artificial Sequence: Synthetic oligonucleotide
uaauugaaaaaugauuuu

SEQ ID NO: 34145 - RNA, 18 nt, Artificial Sequence
  Description of Artificial Sequence: Synthetic oligonucleotide
acaaguaauugaaaaaug

SEQ ID NO: 34146 - RNA, 18 nt, Artificial Sequence
  Description of Artificial Sequence: Synthetic oligonucleotide
gggaaacaaguaauugaa

SEQ ID NO: 34147 - RNA, 18 nt, Artificial Sequence
  Description of Artificial Sequence: Synthetic oligonucleotide
gacaucugaaaucuaggg

SEQ ID NO: 34148 - RNA, 18 nt, Artificial Sequence
  Description of Artificial Sequence: Synthetic oligonucleotide
ccgugacaucugaaaucu

SEQ ID NO: 34149 - RNA, 18 nt, Artificial Sequence
  Description of Artificial Sequence: Synthetic oligonucleotide
ucauaccgugacaucuga

SEQ ID NO: 34150 - RNA, 18 nt, Artificial Sequence
  Description of Artificial Sequence: Synthetic oligonucleotide
accuuucauaccgugaca

SEQ ID NO: 34151 - RNA, 18 nt, Artificial Sequence
  Description of Artificial Sequence: Synthetic oligonucleotide
auaaaaccuuucauaccg

SEQ ID NO: 34152 - RNA, 18 nt, Artificial Sequence
  Description of Artificial Sequence: Synthetic oligonucleotide
uauauauaaaaccuuuca

SEQ ID NO: 34153 - RNA, 18 nt, Artificial Sequence
  Description of Artificial Sequence: Synthetic oligonucleotide
uuaaauauauauaaaacc

SEQ ID NO: 34154 - RNA, 18 nt, Artificial Sequence
  Description of Artificial Sequence: Synthetic oligonucleotide
auuuuuuaaauauauaua

SEQ ID NO: 34155 - RNA, 18 nt, Artificial Sequence
  Description of Artificial Sequence: Synthetic oligonucleotide
acuuuauuuuuuaaauau

SEQ ID NO: 34156 - RNA, 18 nt, Artificial Sequence
  Description of Artificial Sequence: Synthetic oligonucleotide
uuuauacuuuauuuuuua

SEQ ID NO: 34157 - RNA, 18 nt, Artificial Sequence
  Description of Artificial Sequence: Synthetic oligonucleotide
uuauguuuauacuuuauu

SEQ ID NO: 34158 - RNA, 18 nt, Artificial Sequence
  Description of Artificial Sequence: Synthetic oligonucleotide
agacuuuauguuuauacu

SEQ ID NO: 34159 - RNA, 18 nt, Artificial Sequence
  Description of Artificial Sequence: Synthetic oligonucleotide
caaaaagacuuuauguuu

SEQ ID NO: 34160 - RNA, 18 nt, Artificial Sequence
  Description of Artificial Sequence: Synthetic oligonucleotide
cgcuucaaaaagacuuua

SEQ ID NO: 34161 - RNA, 18 nt, Artificial Sequence
  Description of Artificial Sequence: Synthetic oligonucleotide
aaccacgcuucaaaaaga

SEQ ID NO: 34162 - RNA, 18 nt, Artificial Sequence
  Description of Artificial Sequence: Synthetic oligonucleotide
ugcauaaccacgcuucaa

SEQ ID NO: 34163 - RNA, 18 nt, Artificial Sequence
  Description of Artificial Sequence: Synthetic oligonucleotide
uauguugcauaaccacgc

SEQ ID NO: 34164 - RNA, 18 nt, Artificial Sequence
  Description of Artificial Sequence: Synthetic oligonucleotide
uagcauauguugcauaac

SEQ ID NO: 34165 - RNA, 18 nt, Artificial Sequence
  Description of Artificial Sequence: Synthetic oligonucleotide
acgccuagcauauguugc

SEQ ID NO: 34166 - RNA, 18 nt, Artificial Sequence
  Description of Artificial Sequence: Synthetic oligonucleotide
aacuuacgccuagcauau

SEQ ID NO: 34167 - RNA, 18 nt, Artificial Sequence
  Description of Artificial Sequence: Synthetic oligonucleotide
ucaccaacuuacgccuag

SEQ ID NO: 34168 - RNA, 18 nt, Artificial Sequence
  Description of Artificial Sequence: Synthetic oligonucleotide
ggcauucaccaacuuacg

SEQ ID NO: 34169 - RNA, 18 nt, Artificial Sequence
  Description of Artificial Sequence: Synthetic oligonucleotide
aagcaggcauucaccaac

SEQ ID NO: 34170 - RNA, 18 nt, Artificial Sequence
  Description of Artificial Sequence: Synthetic oligonucleotide
cugcaaagcaggcauuca

SEQ ID NO: 34171 - RNA, 18 nt, Artificial Sequence
  Description of Artificial Sequence: Synthetic oligonucleotide
acacucugcaaagcaggc

SEQ ID NO: 34172 - RNA, 18 nt, Artificial Sequence
  Description of Artificial Sequence: Synthetic oligonucleotide
ggguuacacucugcaaag

SEQ ID NO: 34173 - RNA, 18 nt, Artificial Sequence
  Description of Artificial Sequence: Synthetic oligonucleotide
cuuuuuuuauucaauggg

SEQ ID NO: 34174 - RNA, 18 nt, Artificial Sequence
  Description of Artificial Sequence: Synthetic oligonucleotide
gcuuuuuuuauucaaugg

SEQ ID NO: 34175 - RNA, 18 nt, Artificial Sequence
  Description of Artificial Sequence: Synthetic oligonucleotide
acaaagcuuuuuuuauuc

SEQ ID NO: 34176 - RNA, 18 nt, Artificial Sequence
  Description of Artificial Sequence: Synthetic oligonucleotide
ggaaaacaaagcuuuuuu

SEQ ID NO: 34177 - RNA, 18 nt, Artificial Sequence
  Description of Artificial Sequence: Synthetic oligonucleotide
gaaagggaaaacaaagcu

SEQ ID NO: 34178 - RNA, 18 nt, Artificial Sequence
  Description of Artificial Sequence: Synthetic oligonucleotide
gggcagaaagggaaaaca

SEQ ID NO: 34179 - RNA, 18 nt, Artificial Sequence
  Description of Artificial Sequence: Synthetic oligonucleotide
gcccauacugauacaggg

SEQ ID NO: 34180 - RNA, 18 nt, Artificial Sequence
  Description of Artificial Sequence: Synthetic oligonucleotide
ugcccauacugauacagg

SEQ ID NO: 34181 - RNA, 18 nt, Artificial Sequence
  Description of Artificial Sequence: Synthetic oligonucleotide
gggugugcccauacugau

SEQ ID NO: 34182 - RNA, 18 nt, Artificial Sequence
  Description of Artificial Sequence: Synthetic oligonucleotide
gugcagggugugcccaua

SEQ ID NO: 34183 - RNA, 18 nt, Artificial Sequence
  Description of Artificial Sequence: Synthetic oligonucleotide
uuagagugcagggugugc

SEQ ID NO: 34184 - RNA, 18 nt, Artificial Sequence
  Description of Artificial Sequence: Synthetic oligonucleotide
uaaaguuagagugcaggg

SEQ ID NO: 34185 - RNA, 18 nt, Artificial Sequence
  Description of Artificial Sequence: Synthetic oligonucleotide
uagauuaaaguuagagug

SEQ ID NO: 34186 - RNA, 18 nt, Artificial Sequence
  Description of Artificial Sequence: Synthetic oligonucleotide
ugacguagauuaaaguua

SEQ ID NO: 34187 - RNA, 18 nt, Artificial Sequence
  Description of Artificial Sequence: Synthetic oligonucleotide
gagggugacguagauuaa

SEQ ID NO: 34188 - RNA, 18 nt, Artificial Sequence
  Description of Artificial Sequence: Synthetic oligonucleotide
caggugagggugacguag

SEQ ID NO: 34189 - RNA, 18 nt, Artificial Sequence
  Description of Artificial Sequence: Synthetic oligonucleotide
ccaaacaggugaggguga

SEQ ID NO: 34190 - RNA, 18 nt, Artificial Sequence
  Description of Artificial Sequence: Synthetic oligonucleotide
ccaaaccaaacaggugag

SEQ ID NO: 34191 - RNA, 18 nt, Artificial Sequence
  Description of Artificial Sequence: Synthetic oligonucleotide
uaaacccaaaccaaacag

SEQ ID NO: 34192 - RNA, 18 nt, Artificial Sequence
  Description of Artificial Sequence: Synthetic oligonucleotide
gacauuaaacccaaacca

SEQ ID NO: 34193 - RNA, 18 nt, Artificial Sequence
  Description of Artificial Sequence: Synthetic oligonucleotide
ucgcagacauuaaaccca

SEQ ID NO: 34194 - RNA, 18 nt, Artificial Sequence
  Description of Artificial Sequence: Synthetic oligonucleotide
uuuucucgcagacauuaa

SEQ ID NO: 34195 - RNA, 18 nt, Artificial Sequence
  Description of Artificial Sequence: Synthetic oligonucleotide
uuugguuuucucgcagac

SEQ ID NO: 34196 - RNA, 18 nt, Artificial Sequence
  Description of Artificial Sequence: Synthetic oligonucleotide
agauauuugguuuucucg

SEQ ID NO: 34197 - RNA, 18 nt, Artificial Sequence
  Description of Artificial Sequence: Synthetic oligonucleotide
acacaagauauuugguuu

SEQ ID NO: 34198 - RNA, 18 nt, Artificial Sequence
  Description of Artificial Sequence: Synthetic oligonucleotide
acaauacacaagauauuu

SEQ ID NO: 34199 - RNA, 18 nt, Artificial Sequence
  Description of Artificial Sequence: Synthetic oligonucleotide
aguucacaauacacaaga

SEQ ID NO: 34200 - RNA, 18 nt, Artificial Sequence
  Description of Artificial Sequence: Synthetic oligonucleotide
uugacaguucacaauaca

SEQ ID NO: 34201 - RNA, 18 nt, Artificial Sequence
  Description of Artificial Sequence: Synthetic oligonucleotide
uggcuuugacaguucaca

SEQ ID NO: 34202 - RNA, 18 nt, Artificial Sequence
  Description of Artificial Sequence: Synthetic oligonucleotide
uuagauggcuuugacagu

SEQ ID NO: 34203 - RNA, 18 nt, Artificial Sequence
  Description of Artificial Sequence: Synthetic oligonucleotide
uugguuuagauggcuuug

SEQ ID NO: 34204 - RNA, 18 nt, Artificial Sequence
  Description of Artificial Sequence: Synthetic oligonucleotide
ugggauugguuuagaugg

SEQ ID NO: 34205 - RNA, 18 nt, Artificial Sequence
  Description of Artificial Sequence: Synthetic oligonucleotide
gaccuugggauugguuua

SEQ ID NO: 34206 - RNA, 18 nt, Artificial Sequence
  Description of Artificial Sequence: Synthetic oligonucleotide
cacuugaccuugggauug

SEQ ID NO: 34207 - RNA, 18 nt, Artificial Sequence
  Description of Artificial Sequence: Synthetic oligonucleotide
auauccacuugaccuugg

SEQ ID NO: 34208 - RNA, 18 nt, Artificial Sequence
  Description of Artificial Sequence: Synthetic oligonucleotide
uuuuuauauccacuugac

SEQ ID NO: 34209 - RNA, 18 nt, Artificial Sequence
  Description of Artificial Sequence: Synthetic oligonucleotide
cagaauuuuuauauccac

SEQ ID NO: 34210 - RNA, 18 nt, Artificial Sequence
  Description of Artificial Sequence: Synthetic oligonucleotide
uuuggcagaauuuuuaua

SEQ ID NO: 34211 - RNA, 18 nt, Artificial Sequence
  Description of Artificial Sequence: Synthetic oligonucleotide
auguuuuuggcagaauuu

SEQ ID NO: 34212 - RNA, 18 nt, Artificial Sequence
  Description of Artificial Sequence: Synthetic oligonucleotide
augccauguuuuuggcag

SEQ ID NO: 34213 - RNA, 18 nt, Artificial Sequence
  Description of Artificial Sequence: Synthetic oligonucleotide
aucuuaugccauguuuuu

SEQ ID NO: 34214 - RNA, 18 nt, Artificial Sequence
  Description of Artificial Sequence: Synthetic oligonucleotide
uuuccaucuuaugccaug

SEQ ID NO: 34215 - RNA, 18 nt, Artificial Sequence
  Description of Artificial Sequence: Synthetic oligonucleotide
gaacuuuuccaucuuaug

SEQ ID NO: 34216 - RNA, 18 nt, Artificial Sequence
  Description of Artificial Sequence: Synthetic oligonucleotide
ucagggaacuuuuccauc

SEQ ID NO: 34217 - RNA, 18 nt, Artificial Sequence
  Description of Artificial Sequence: Synthetic oligonucleotide
aguuuucagggaacuuuu

SEQ ID NO: 34218 - RNA, 18 nt, Artificial Sequence
  Description of Artificial Sequence: Synthetic oligonucleotide
uccagaguuuucagggaa

SEQ ID NO: 34219 - RNA, 18 nt, Artificial Sequence
  Description of Artificial Sequence: Synthetic oligonucleotide
uuucuuccagaguuuuca

SEQ ID NO: 34220 - RNA, 18 nt, Artificial Sequence
  Description of Artificial Sequence: Synthetic oligonucleotide
uuuguuuucuuccagagu

SEQ ID NO: 34221 - RNA, 18 nt, Artificial Sequence
  Description of Artificial Sequence: Synthetic oligonucleotide
auuacuuuguuuucuucc

SEQ ID NO: 34222 - RNA, 18 nt, Artificial Sequence
  Description of Artificial Sequence: Synthetic oligonucleotide
ucuacauuacuuuguuuu

SEQ ID NO: 34223 - RNA, 18 nt, Artificial Sequence
  Description of Artificial Sequence: Synthetic oligonucleotide
aggugucuacauuacuuu

SEQ ID NO: 34224 - RNA, 18 nt, Artificial Sequence
  Description of Artificial Sequence: Synthetic oligonucleotide
aaagaaggugucuacauu

SEQ ID NO: 34225 - RNA, 18 nt, Artificial Sequence
  Description of Artificial Sequence: Synthetic oligonucleotide
gggaaaaagaaggugucu

SEQ ID NO: 34226 - RNA, 18 nt, Artificial Sequence
  Description of Artificial Sequence: Synthetic oligonucleotide
auuuucuaaugguguggg

SEQ ID NO: 34227 - RNA, 18 nt, Artificial Sequence
  Description of Artificial Sequence: Synthetic oligonucleotide
aacauuuucuaauggugu

SEQ ID NO: 34228 - RNA, 18 nt, Artificial Sequence
  Description of Artificial Sequence: Synthetic oligonucleotide
gaugcaacauuuucuaau

SEQ ID NO: 34229 - RNA, 18 nt, Artificial Sequence
  Description of Artificial Sequence: Synthetic oligonucleotide
guccucaucgucauuauu

SEQ ID NO: 34230 - RNA, 18 nt, Artificial Sequence
  Description of Artificial Sequence: Synthetic oligonucleotide
gucagguccucaucguca

SEQ ID NO: 34231 - RNA, 18 nt, Artificial Sequence
  Description of Artificial Sequence: Synthetic oligonucleotide
cuggugucagguccucau

SEQ ID NO: 34232 - RNA, 18 nt, Artificial Sequence
  Description of Artificial Sequence: Synthetic oligonucleotide
cugcucuggugucagguc

SEQ ID NO: 34233 - RNA, 18 nt, Artificial Sequence
  Description of Artificial Sequence: Synthetic oligonucleotide
gccuucugcucugguguc

SEQ ID NO: 34234 - RNA, 18 nt, Artificial Sequence
  Description of Artificial Sequence: Synthetic oligonucleotide
gcucugccuucugcucug

SEQ ID NO: 34235 - RNA, 18 nt, Artificial Sequence
  Description of Artificial Sequence: Synthetic oligonucleotide
cucacgcucugccuucug

SEQ ID NO: 34236 - RNA, 18 nt, Artificial Sequence
  Description of Artificial Sequence: Synthetic oligonucleotide
uccuucucacgcucugcc

SEQ ID NO: 34237 - RNA, 18 nt, Artificial Sequence
  Description of Artificial Sequence: Synthetic oligonucleotide
uccgcuccuucucacgcu

SEQ ID NO: 34238 - RNA, 18 nt, Artificial Sequence
  Description of Artificial Sequence: Synthetic oligonucleotide
cauccuccgcuccuucuc

SEQ ID NO: 34239 - RNA, 18 nt, Artificial Sequence
  Description of Artificial Sequence: Synthetic oligonucleotide
uuggccauccuccgcucc

SEQ ID NO: 34240 - RNA, 18 nt, Artificial Sequence
  Description of Artificial Sequence: Synthetic oligonucleotide
cauuguuggccauccucc

SEQ ID NO: 34241 - RNA, 18 nt, Artificial Sequence
  Description of Artificial Sequence: Synthetic oligonucleotide
ucgggcauuguuggccau

SEQ ID NO: 34242 - RNA, 18 nt, Artificial Sequence
  Description of Artificial Sequence: Synthetic oligonucleotide
cgcucucgggcauuguug

SEQ ID NO: 34243 - RNA, 18 nt, Artificial Sequence
  Description of Artificial Sequence: Synthetic oligonucleotide
gcagacgcucucgggcau

SEQ ID NO: 34244 - RNA, 18 nt, Artificial Sequence
  Description of Artificial Sequence: Synthetic oligonucleotide
gacccgcagacgcucucg

SEQ ID NO: 34245 - RNA, 18 nt, Artificial Sequence
  Description of Artificial Sequence: Synthetic oligonucleotide
ucacggacccgcagacgc

SEQ ID NO: 34246 - RNA, 18 nt, Artificial Sequence
  Description of Artificial Sequence: Synthetic oligonucleotide
ugaugucacggacccgca

SEQ ID NO: 34247 - RNA, 18 nt, Artificial Sequence
  Description of Artificial Sequence: Synthetic oligonucleotide
cucguugaugucacggac

SEQ ID NO: 34248 - RNA, 18 nt, Artificial Sequence
  Description of Artificial Sequence: Synthetic oligonucleotide
aaagccucguugauguca

SEQ ID NO: 34249 - RNA, 18 nt, Artificial Sequence
  Description of Artificial Sequence: Synthetic oligonucleotide
cuuugaaagccucguuga

SEQ ID NO: 34250 - RNA, 18 nt, Artificial Sequence
  Description of Artificial Sequence: Synthetic oligonucleotide
gagcucuuugaaagccuc

SEQ ID NO: 34251 - RNA, 18 nt, Artificial Sequence
  Description of Artificial Sequence: Synthetic oligonucleotide
cggccgagcucuuugaaa

SEQ ID NO: 34252 - RNA, 18 nt, Artificial Sequence
  Description of Artificial Sequence: Synthetic oligonucleotide
ccaugcggccgagcucuu

SEQ ID NO: 34253 - RNA, 18 nt, Artificial Sequence
  Description of Artificial Sequence: Synthetic oligonucleotide
cugcaccaugcggccgag

SEQ ID NO: 34254 - RNA, 18 nt, Artificial Sequence
  Description of Artificial Sequence: Synthetic oligonucleotide
uggagcugcaccaugcgg

SEQ ID NO: 34255 - RNA, 18 nt, Artificial Sequence
  Description of Artificial Sequence: Synthetic oligonucleotide
ugagguggagcugcacca

SEQ ID NO: 34256 - RNA, 18 nt, Artificial Sequence
  Description of Artificial Sequence: Synthetic oligonucleotide
acucuugagguggagcug

SEQ ID NO: 34257 - RNA, 18 nt, Artificial Sequence
  Description of Artificial Sequence: Synthetic oligonucleotide
uugucacucuugaggugg

SEQ ID NO: 34258 - RNA, 18 nt, Artificial Sequence
  Description of Artificial Sequence: Synthetic oligonucleotide
gggcuugucacucuugag

SEQ ID NO: 34259 - RNA, 18 nt, Artificial Sequence
  Description of Artificial Sequence: Synthetic oligonucleotide
ucaggagcuuggucuggg

SEQ ID NO: 34260 - RNA, 18 nt, Artificial Sequence
  Description of Artificial Sequence: Synthetic oligonucleotide
gaggaucaggagcuuggu

SEQ ID NO: 34261 - RNA, 18 nt, Artificial Sequence
  Description of Artificial Sequence: Synthetic oligonucleotide
ugguggaggaucaggagc

SEQ ID NO: 34262 - RNA, 18 nt, Artificial Sequence
  Description of Artificial Sequence: Synthetic oligonucleotide
ccgccugguggaggauca

SEQ ID NO: 34263 - RNA, 18 nt, Artificial Sequence
  Description of Artificial Sequence: Synthetic oligonucleotide
ggccaccgccugguggag

SEQ ID NO: 34264 - RNA, 18 nt, Artificial Sequence
  Description of Artificial Sequence: Synthetic oligonucleotide
augacggccaccgccugg

SEQ ID NO: 34265 - RNA, 18 nt, Artificial Sequence
  Description of Artificial Sequence: Synthetic oligonucleotide
ugaggaugacggccaccg

SEQ ID NO: 34266 - RNA, 18 nt, Artificial Sequence
  Description of Artificial Sequence: Synthetic oligonucleotide
cagacugaggaugacggc

SEQ ID NO: 34267 - RNA, 18 nt, Artificial Sequence
  Description of Artificial Sequence: Synthetic oligonucleotide
ugcuccagacugaggaug

SEQ ID NO: 34268 - RNA, 18 nt, Artificial Sequence
  Description of Artificial Sequence: Synthetic oligonucleotide
cuugcugcuccagacuga

SEQ ID NO: 34269 - RNA, 18 nt, Artificial Sequence
  Description of Artificial Sequence: Synthetic oligonucleotide
ucggacuugcugcuccag

SEQ ID NO: 34270 - RNA, 18 nt, Artificial Sequence
  Description of Artificial Sequence: Synthetic oligonucleotide
cuguaguccugguggcau

SEQ ID NO: 34271 - RNA, 18 nt, Artificial Sequence
  Description of Artificial Sequence: Synthetic oligonucleotide
ugccccuguaguccuggu

SEQ ID NO: 34272 - RNA, 18 nt, Artificial Sequence
  Description of Artificial Sequence: Synthetic oligonucleotide
cacucugccccuguaguc

SEQ ID NO: 34273 - RNA, 18 nt, Artificial Sequence
  Description of Artificial Sequence: Synthetic oligonucleotide
ggagacacucugccccug

SEQ ID NO: 34274 - RNA, 18 nt, Artificial Sequence
  Description of Artificial Sequence: Synthetic oligonucleotide
ccagaggagacacucugc

SEQ ID NO: 34275 - RNA, 18 nt, Artificial Sequence
  Description of Artificial Sequence: Synthetic oligonucleotide
agcugccagaggagacac

SEQ ID NO: 34276 - RNA, 18 nt, Artificial Sequence
  Description of Artificial Sequence: Synthetic oligonucleotide
cucagagcugccagagga

SEQ ID NO: 34277 - RNA, 18 nt, Artificial Sequence
  Description of Artificial Sequence: Synthetic oligonucleotide
uugaucucagagcugcca

SEQ ID NO: 34278 - RNA, 18 nt, Artificial Sequence
  Description of Artificial Sequence: Synthetic oligonucleotide
cggauuugaucucagagc

SEQ ID NO: 34279 - RNA, 18 nt, Artificial Sequence
  Description of Artificial Sequence: Synthetic oligonucleotide
gucaucggauuugaucuc

SEQ ID NO: 34280 - RNA, 18 nt, Artificial Sequence
  Description of Artificial Sequence: Synthetic oligonucleotide
cccucgucaucggauuug

SEQ ID NO: 34281 - RNA, 18 nt, Artificial Sequence
  Description of Artificial Sequence: Synthetic oligonucleotide
caucacccucgucaucgg

SEQ ID NO: 34282 - RNA, 18 nt, Artificial Sequence
  Description of Artificial Sequence: Synthetic oligonucleotide
guucucaucacccucguc

SEQ ID NO: 34283 - RNA, 18 nt, Artificial Sequence
  Description of Artificial Sequence: Synthetic oligonucleotide
ugcagguucucaucaccc

SEQ ID NO: 34284 - RNA, 18 nt, Artificial Sequence
  Description of Artificial Sequence: Synthetic oligonucleotide
ugucuugcagguucucau

SEQ ID NO: 34285 - RNA, 18 nt, Artificial Sequence
  Description of Artificial Sequence: Synthetic oligonucleotide
uuucgugucuugcagguu

SEQ ID NO: 34286 - RNA, 18 nt, Artificial Sequence
  Description of Artificial Sequence: Synthetic oligonucleotide
gaagauuucgugucuugc

SEQ ID NO: 34287 - RNA, 18 nt, Artificial Sequence
  Description of Artificial Sequence: Synthetic oligonucleotide
ccuccgaagauuucgugu

SEQ ID NO: 34288 - RNA, 18 nt, Artificial Sequence
  Description of Artificial Sequence: Synthetic oligonucleotide
cuuguccuccgaagauuu

SEQ ID NO: 34289 - RNA, 18 nt, Artificial Sequence
  Description of Artificial Sequence: Synthetic oligonucleotide
aauuucuuguccuccgaa

SEQ ID NO: 34290 - RNA, 18 nt, Artificial Sequence
  Description of Artificial Sequence: Synthetic oligonucleotide
caucuaauuucuuguccu

SEQ ID NO: 34291 - RNA, 18 nt, Artificial Sequence
  Description of Artificial Sequence: Synthetic oligonucleotide
gucgucaucuaauuucuu

SEQ ID NO: 34292 - RNA, 18 nt, Artificial Sequence
  Description of Artificial Sequence: Synthetic oligonucleotide
uucuugucgucaucuaau

SEQ ID NO: 34293 - RNA, 18 nt, Artificial Sequence
  Description of Artificial Sequence: Synthetic oligonucleotide
uauccuucuugucgucau

SEQ ID NO: 34294 - RNA, 18 nt, Artificial Sequence
  Description of Artificial Sequence: Synthetic oligonucleotide
uuugauauccuucuuguc

SEQ ID NO: 34295 - RNA, 18 nt, Artificial Sequence
  Description of Artificial Sequence: Synthetic oligonucleotide
auugauuugauauccuuc

SEQ ID NO: 34296 - RNA, 18 nt, Artificial Sequence
  Description of Artificial Sequence: Synthetic oligonucleotide
uaguaauugauuugauau

SEQ ID NO: 34297 - RNA, 18 nt, Artificial Sequence
  Description of Artificial Sequence: Synthetic oligonucleotide
ugaccuaguaauugauuu

SEQ ID NO: 34298 - RNA, 18 nt, Artificial Sequence
  Description of Artificial Sequence: Synthetic oligonucleotide
gaucuugaccuaguaauu

SEQ ID NO: 34299 - RNA, 18 nt, Artificial Sequence
  Description of Artificial Sequence: Synthetic oligonucleotide
gcgacaguauuauauacu

SEQ ID NO: 34300 - RNA, 18 nt, Artificial Sequence
  Description of Artificial Sequence: Synthetic oligonucleotide
augaagcgacaguauuau

SEQ ID NO: 34301 - RNA, 18 nt, Artificial Sequence
  Description of Artificial Sequence: Synthetic oligonucleotide
auuaaaugaagcgacagu

SEQ ID NO: 34302 - RNA, 18 nt, Artificial Sequence
  Description of Artificial Sequence: Synthetic oligonucleotide
aaggaauuaaaugaagcg

SEQ ID NO: 34303 - RNA, 18 nt, Artificial Sequence
  Description of Artificial Sequence: Synthetic oligonucleotide
caauaaaggaauuaaaug

SEQ ID NO: 34304 - RNA, 18 nt, Artificial Sequence
  Description of Artificial Sequence: Synthetic oligonucleotide
aaguccaauaaaggaauu

SEQ ID NO: 34305 - RNA, 18 nt, Artificial Sequence
  Description of Artificial Sequence: Synthetic oligonucleotide
caucaaaguccaauaaag

SEQ ID NO: 34306 - RNA, 18 nt, Artificial Sequence
  Description of Artificial Sequence: Synthetic oligonucleotide
cacuucaucaaaguccaa

SEQ ID NO: 34307 - RNA, 18 nt, Artificial Sequence
  Description of Artificial Sequence: Synthetic oligonucleotide
cuguucacuucaucaaag

SEQ ID NO: 34308 - RNA, 18 nt, Artificial Sequence
  Description of Artificial Sequence: Synthetic oligonucleotide
ccguucuguucacuucau

SEQ ID NO: 34309 - RNA, 18 nt, Artificial Sequence
  Description of Artificial Sequence: Synthetic oligonucleotide
ucuucccguucuguucac

SEQ ID NO: 34310 - RNA, 18 nt, Artificial Sequence
  Description of Artificial Sequence: Synthetic oligonucleotide
uaguuucuucccguucug

SEQ ID NO: 34311 - RNA, 18 nt, Artificial Sequence
  Description of Artificial Sequence: Synthetic oligonucleotide
cugaauaguuucuucccg

SEQ ID NO: 34312 - RNA, 18 nt, Artificial Sequence
  Description of Artificial Sequence: Synthetic oligonucleotide
aaaaacugaauaguuucu

SEQ ID NO: 34313 - RNA, 18 nt, Artificial Sequence
  Description of Artificial Sequence: Synthetic oligonucleotide
caggaaaaaacugaauag

SEQ ID NO: 34314 - RNA, 18 nt, Artificial Sequence
  Description of Artificial Sequence: Synthetic oligonucleotide
ccugccaggaaaaaacug

SEQ ID NO: 34315 - RNA, 18 nt, Artificial Sequence
  Description of Artificial Sequence: Synthetic oligonucleotide
auuuaccugccaggaaaa

SEQ ID NO: 34316 - RNA, 18 nt, Artificial Sequence
  Description of Artificial Sequence: Synthetic oligonucleotide
uguaaauuuaccugccag

SEQ ID NO: 34317 - RNA, 18 nt, Artificial Sequence
  Description of Artificial Sequence: Synthetic oligonucleotide
ucagcuguaaauuuaccu

SEQ ID NO: 34318 - RNA, 18 nt, Artificial Sequence
  Description of Artificial Sequence: Synthetic oligonucleotide
ucuuuucagcuguaaauu

SEQ ID NO: 34319 - RNA, 18 nt, Artificial Sequence
  Description of Artificial Sequence: Synthetic oligonucleotide
aauuuucuuuucagcugu

SEQ ID NO: 34320 - RNA, 18 nt, Artificial Sequence
  Description of Artificial Sequence: Synthetic oligonucleotide
ccuuuaauuuucuuuuca

SEQ ID NO: 34321 - RNA, 18 nt, Artificial Sequence
  Description of Artificial Sequence: Synthetic oligonucleotide
guaggccuuuaauuuucu

SEQ ID NO: 34322 - RNA, 18 nt, Artificial Sequence
  Description of Artificial Sequence: Synthetic oligonucleotide
cuagaguaggccuuuaau

SEQ ID NO: 34323 - RNA, 18 nt, Artificial Sequence
  Description of Artificial Sequence: Synthetic oligonucleotide
uacuucuagaguaggccu

SEQ ID NO: 34324 - RNA, 18 nt, Artificial Sequence
  Description of Artificial Sequence: Synthetic oligonucleotide
uuuaguacuucuagagua

SEQ ID NO: 34325 - RNA, 18 nt, Artificial Sequence
  Description of Artificial Sequence: Synthetic oligonucleotide
auacuuuuaguacuucua

SEQ ID NO: 34326 - RNA, 18 nt, Artificial Sequence
  Description of Artificial Sequence: Synthetic oligonucleotide
aaacgauacuuuuaguac

SEQ ID NO: 34327 - RNA, 18 nt, Artificial Sequence
  Description of Artificial Sequence: Synthetic oligonucleotide
aucugaaacgauacuuuu

SEQ ID NO: 34328 - RNA, 18 nt, Artificial Sequence
  Description of Artificial Sequence: Synthetic oligonucleotide
cagguaucugaaacgaua

SEQ ID NO: 34329 - RNA, 18 nt, Artificial Sequence
  Description of Artificial Sequence: Synthetic oligonucleotide
gaguacagguaucugaaa

SEQ ID NO: 34330 - RNA, 18 nt, Artificial Sequence
  Description of Artificial Sequence: Synthetic oligonucleotide
caauagaguacagguauc

SEQ ID NO: 34331 - RNA, 18 nt, Artificial Sequence
  Description of Artificial Sequence: Synthetic oligonucleotide
ggcuccaauagaguacag

SEQ ID NO: 34332 - RNA, 18 nt, Artificial Sequence
  Description of Artificial Sequence: Synthetic oligonucleotide
guuuaggcuccaauagag

SEQ ID NO: 34333 - RNA, 18 nt, Artificial Sequence
  Description of Artificial Sequence: Synthetic oligonucleotide
aaacaguuuaggcuccaa

SEQ ID NO: 34334 - RNA, 18 nt, Artificial Sequence
  Description of Artificial Sequence: Synthetic oligonucleotide
ugccaaaacaguuuaggc

SEQ ID NO: 34335 - RNA, 18 nt, Artificial Sequence
  Description of Artificial Sequence: Synthetic oligonucleotide
auaaaugccaaaacaguu

SEQ ID NO: 34336 - RNA, 18 nt, Artificial Sequence
  Description of Artificial Sequence: Synthetic oligonucleotide
gauucauaaaugccaaaa

SEQ ID NO: 34337 - RNA, 18 nt, Artificial Sequence
  Description of Artificial Sequence: Synthetic oligonucleotide
guccagauucauaaaugc

SEQ ID NO: 34338 - RNA, 18 nt, Artificial Sequence
  Description of Artificial Sequence: Synthetic oligonucleotide
auuggguccagauucaua

SEQ ID NO: 34339 - RNA, 18 nt, Artificial Sequence
  Description of Artificial Sequence: Synthetic oligonucleotide
uuagcauuggguccagau

SEQ ID NO: 34340 - RNA, 18 nt, Artificial Sequence
  Description of Artificial Sequence: Synthetic oligonucleotide
ugucauuagcauuggguc

SEQ ID NO: 34341 - RNA, 18 nt, Artificial Sequence
  Description of Artificial Sequence: Synthetic oligonucleotide
cugugugucauuagcauu

SEQ ID NO: 34342 - RNA, 18 nt, Artificial Sequence
  Description of Artificial Sequence: Synthetic oligonucleotide
uuucacugugugucauua

SEQ ID NO: 34343 - RNA, 18 nt, Artificial Sequence
  Description of Artificial Sequence: Synthetic oligonucleotide
aauuuuuucacugugugu

SEQ ID NO: 34344 - RNA, 18 nt, Artificial Sequence
  Description of Artificial Sequence: Synthetic oligonucleotide
agacaaauuuuuucacug

SEQ ID NO: 34345 - RNA, 18 nt, Artificial Sequence
  Description of Artificial Sequence: Synthetic oligonucleotide
aucagagacaaauuuuuu

SEQ ID NO: 34346 - RNA, 18 nt, Artificial Sequence
  Description of Artificial Sequence: Synthetic oligonucleotide
cuugaaucagagacaaau

SEQ ID NO: 34347 - RNA, 18 nt, Artificial Sequence
  Description of Artificial Sequence: Synthetic oligonucleotide
cuguacuugaaucagaga

SEQ ID NO: 34348 - RNA, 18 nt, Artificial Sequence
  Description of Artificial Sequence: Synthetic oligonucleotide
auaaacuguacuugaauc

SEQ ID NO: 34349 - RNA, 18 nt, Artificial Sequence
  Description of Artificial Sequence: Synthetic oligonucleotide
uacaaauaaacuguacuu

SEQ ID NO: 34350 - RNA, 18 nt, Artificial Sequence
  Description of Artificial Sequence: Synthetic oligonucleotide
aguuuuacaaauaaacug

SEQ ID NO: 34351 - RNA, 18 nt, Artificial Sequence
  Description of Artificial Sequence: Synthetic oligonucleotide
aguauaguuuuacaaaua

SEQ ID NO: 34352 - RNA, 18 nt, Artificial Sequence
  Description of Artificial Sequence: Synthetic oligonucleotide
gaauaaguauaguuuuac

SEQ ID NO: 34353 - RNA, 18 nt, Artificial Sequence
  Description of Artificial Sequence: Synthetic oligonucleotide
uuguagaauaaguauagu

SEQ ID NO: 34354 - RNA, 18 nt, Artificial Sequence
  Description of Artificial Sequence: Synthetic oligonucleotide
caaauuuguagaauaagu

SEQ ID NO: 34355 - RNA, 18 nt, Artificial Sequence
  Description of Artificial Sequence: Synthetic oligonucleotide
cugaccaaauuuguagaa

SEQ ID NO: 34356 - RNA, 18 nt, Artificial Sequence
  Description of Artificial Sequence: Synthetic oligonucleotide
cauuucugaccaaauuug

SEQ ID NO: 34357 - RNA, 18 nt, Artificial Sequence
  Description of Artificial Sequence: Synthetic oligonucleotide
cacaacauuucugaccaa

SEQ ID NO: 34358 - RNA, 18 nt, Artificial Sequence
  Description of Artificial Sequence: Synthetic oligonucleotide
auagacacaacauuucug

SEQ ID NO: 34359 - RNA, 18 nt, Artificial Sequence
  Description of Artificial Sequence: Synthetic oligonucleotide
auauuauagacacaacau

SEQ ID NO: 34360 - RNA, 18 nt, Artificial Sequence
  Description of Artificial Sequence: Synthetic oligonucleotide
uagaaauauuauagacac

SEQ ID NO: 34361 - RNA, 18 nt, Artificial Sequence
  Description of Artificial Sequence: Synthetic oligonucleotide
cuuuuuagaaauauuaua

SEQ ID NO: 34362 - RNA, 18 nt, Artificial Sequence
  Description of Artificial Sequence: Synthetic oligonucleotide
aaucucuuuuuagaaaua

SEQ ID NO: 34363 - RNA, 18 nt, Artificial Sequence
  Description of Artificial Sequence: Synthetic oligonucleotide
gcuacaaucucuuuuuag

SEQ ID NO: 34364 - RNA, 18 nt, Artificial Sequence
  Description of Artificial Sequence: Synthetic oligonucleotide
acauggcuacaaucucuu

SEQ ID NO: 34365 - RNA, 18 nt, Artificial Sequence
  Description of Artificial Sequence: Synthetic oligonucleotide
uuuuaacauggcuacaau

SEQ ID NO: 34366 - RNA, 18 nt, Artificial Sequence
  Description of Artificial Sequence: Synthetic oligonucleotide
ugaguuuuuaacauggcu

SEQ ID NO: 34367 - RNA, 18 nt, Artificial Sequence
  Description of Artificial Sequence: Synthetic oligonucleotide
ucaguugaguuuuuaaca

SEQ ID NO: 34368 - RNA, 18 nt, Artificial Sequence
  Description of Artificial Sequence: Synthetic oligonucleotide
auacaucaguugaguuuu

SEQ ID NO: 34369 - RNA, 18 nt, Artificial Sequence
  Description of Artificial Sequence: Synthetic oligonucleotide
ggcacauacaucaguuga

SEQ ID NO: 34370 - RNA, 18 nt, Artificial Sequence
  Description of Artificial Sequence: Synthetic oligonucleotide
uaguuggcacauacauca

SEQ ID NO: 34371 - RNA, 18 nt, Artificial Sequence
  Description of Artificial Sequence: Synthetic oligonucleotide
aguuauaguuggcacaua

SEQ ID NO: 34372 - RNA, 18 nt, Artificial Sequence
  Description of Artificial Sequence: Synthetic oligonucleotide
aaaagaguuauaguuggc

SEQ ID NO: 34373 - RNA, 18 nt, Artificial Sequence
  Description of Artificial Sequence: Synthetic oligonucleotide
guaagaaaagaguuauag

SEQ ID NO: 34374 - RNA, 18 nt, Artificial Sequence
  Description of Artificial Sequence: Synthetic oligonucleotide
uagagguaagaaaagagu

SEQ ID NO: 34375 - RNA, 18 nt, Artificial Sequence
  Description of Artificial Sequence: Synthetic oligonucleotide
uacuuuagagguaagaaa

SEQ ID NO: 34376 - RNA, 18 nt, Artificial Sequence
  Description of Artificial Sequence: Synthetic oligonucleotide
uuucuuacuuuagaggua

SEQ ID NO: 34377 - RNA, 18 nt, Artificial Sequence
  Description of Artificial Sequence: Synthetic oligonucleotide
auuauuuucuuacuuuag

SEQ ID NO: 34378 - RNA, 18 nt, Artificial Sequence
  Description of Artificial Sequence: Synthetic oligonucleotide
aggaaauuauuuucuuac

SEQ ID NO: 34379 - RNA, 18 nt, Artificial Sequence
  Description of Artificial Sequence: Synthetic oligonucleotide
aaucuaggaaauuauuuu

SEQ ID NO: 34380 - RNA, 18 nt, Artificial Sequence
  Description of Artificial Sequence: Synthetic oligonucleotide
ggauaaaucuaggaaauu

SEQ ID NO: 34381 - RNA, 18 nt, Artificial Sequence
  Description of Artificial Sequence: Synthetic oligonucleotide
guuuaggauaaaucuagg

SEQ ID NO: 34382 - RNA, 18 nt, Artificial Sequence
  Description of Artificial Sequence: Synthetic oligonucleotide
agcauguuuaggauaaau

SEQ ID NO: 34383 - RNA, 18 nt, Artificial Sequence
  Description of Artificial Sequence: Synthetic oligonucleotide
acaucagcauguuuagga

SEQ ID NO: 34384 - RNA, 18 nt, Artificial Sequence
  Description of Artificial Sequence: Synthetic oligonucleotide
uauauacaucagcauguu

SEQ ID NO: 34385 - RNA, 18 nt, Artificial Sequence
  Description of Artificial Sequence: Synthetic oligonucleotide
acucuuauauacaucagc

SEQ ID NO: 34386 - RNA, 18 nt, Artificial Sequence
  Description of Artificial Sequence: Synthetic oligonucleotide
guauuacucuuauauaca

SEQ ID NO: 34387 - RNA, 18 nt, Artificial Sequence
  Description of Artificial Sequence: Synthetic oligonucleotide
uuaagguauuacucuuau

SEQ ID NO: 34388 - RNA, 18 nt, Artificial Sequence
  Description of Artificial Sequence: Synthetic oligonucleotide
aacaauuaagguauuacu

SEQ ID NO: 34389 - RNA, 18 nt, Artificial Sequence
  Description of Artificial Sequence: Synthetic oligonucleotide
ccauaaacaauuaaggua

SEQ ID NO: 34390 - RNA, 18 nt, Artificial Sequence
  Description of Artificial Sequence: Synthetic oligonucleotide
aaaaaccauaaacaauua

SEQ ID NO: 34391 - RNA, 18 nt, Artificial Sequence
  Description of Artificial Sequence: Synthetic oligonucleotide
ggaagaaaaaccauaaac

SEQ ID NO: 34392 - RNA, 18 nt, Artificial Sequence
  Description of Artificial Sequence: Synthetic oligonucleotide
guccaggaagaaaaacca

SEQ ID NO: 34393 - RNA, 18 nt, Artificial Sequence
  Description of Artificial Sequence: Synthetic oligonucleotide
agaguguccaggaagaaa

SEQ ID NO: 34394 - RNA, 18 nt, Artificial Sequence
  Description of Artificial Sequence: Synthetic oligonucleotide
agaaaagaguguccagga

SEQ ID NO: 34395 - RNA, 18 nt, Artificial Sequence
  Description of Artificial Sequence: Synthetic oligonucleotide
ucuguagaaaagaguguc

SEQ ID NO: 34396 - RNA, 18 nt, Artificial Sequence
  Description of Artificial Sequence: Synthetic oligonucleotide
uguuuucuguagaaaaga

SEQ ID NO: 34397 - RNA, 18 nt, Artificial Sequence
  Description of Artificial Sequence: Synthetic oligonucleotide
aguuguguuuucuguaga

SEQ ID NO: 34398 - RNA, 18 nt, Artificial Sequence
  Description of Artificial Sequence: Synthetic oligonucleotide
caaaaaaauacaaggcag

SEQ ID NO: 34399 - RNA, 18 nt, Artificial Sequence
  Description of Artificial Sequence: Synthetic oligonucleotide
uaggucaaaaaaauacaa

SEQ ID NO: 34400 - RNA, 18 nt, Artificial Sequence
  Description of Artificial Sequence: Synthetic oligonucleotide
uuugauaggucaaaaaaa

SEQ ID NO: 34401 - RNA, 18 nt, Artificial Sequence
  Description of Artificial Sequence: Synthetic oligonucleotide
augauuuugauaggucaa

SEQ ID NO: 34402 - RNA, 18 nt, Artificial Sequence
  Description of Artificial Sequence: Synthetic oligonucleotide
gaaaaaugauuuugauag

SEQ ID NO: 34403 - RNA, 18 nt, Artificial Sequence
  Description of Artificial Sequence: Synthetic oligonucleotide
uaauugaaaaaugauuuu

SEQ ID NO: 34404 - RNA, 18 nt, Artificial Sequence
  Description of Artificial Sequence: Synthetic oligonucleotide
acaaguaauugaaaaaug

SEQ ID NO: 34405 - RNA, 18 nt, Artificial Sequence
  Description of Artificial Sequence: Synthetic oligonucleotide
gggaaacaaguaauugaa

SEQ ID NO: 34406 - RNA, 18 nt, Artificial Sequence
  Description of Artificial Sequence: Synthetic oligonucleotide
gacaucugaaaucuaggg

SEQ ID NO: 34407 - RNA, 18 nt, Artificial Sequence
  Description of Artificial Sequence: Synthetic oligonucleotide
ccgugacaucugaaaucu

SEQ ID NO: 34408 - RNA, 18 nt, Artificial Sequence
  Description of Artificial Sequence: Synthetic oligonucleotide
ucauaccgugacaucuga

SEQ ID NO: 34409 - RNA, 18 nt, Artificial Sequence
  Description of Artificial Sequence: Synthetic oligonucleotide
accuuucauaccgugaca

SEQ ID NO: 34410 - RNA, 18 nt, Artificial Sequence
  Description of Artificial Sequence: Synthetic oligonucleotide
auaaaaccuuucauaccg

SEQ ID NO: 34411 - RNA, 18 nt, Artificial Sequence
  Description of Artificial Sequence: Synthetic oligonucleotide
uauauauaaaaccuuuca

SEQ ID NO: 34412 - RNA, 18 nt, Artificial Sequence
  Description of Artificial Sequence: Synthetic oligonucleotide
uuaaauauauauaaaacc

SEQ ID NO: 34413 - RNA, 18 nt, Artificial Sequence
  Description of Artificial Sequence: Synthetic oligonucleotide
auuuuuuaaauauauaua

SEQ ID NO: 34414 - RNA, 18 nt, Artificial Sequence
  Description of Artificial Sequence: Synthetic oligonucleotide
acuuuauuuuuuaaauau

SEQ ID NO: 34415 - RNA, 18 nt, Artificial Sequence
  Description of Artificial Sequence: Synthetic oligonucleotide
uuuauacuuuauuuuuua

SEQ ID NO: 34416 - RNA, 18 nt, Artificial Sequence
  Description of Artificial Sequence: Synthetic oligonucleotide
uuauguuuauacuuuauu

SEQ ID NO: 34417 - RNA, 18 nt, Artificial Sequence
  Description of Artificial Sequence: Synthetic oligonucleotide
agacuuuauguuuauacu

SEQ ID NO: 34418 - RNA, 18 nt, Artificial Sequence
  Description of Artificial Sequence: Synthetic oligonucleotide
caaaaagacuuuauguuu

SEQ ID NO: 34419 - RNA, 18 nt, Artificial Sequence
  Description of Artificial Sequence: Synthetic oligonucleotide
cgcuucaaaaagacuuua

SEQ ID NO: 34420 - RNA, 18 nt, Artificial Sequence
  Description of Artificial Sequence: Synthetic oligonucleotide
aaccacgcuucaaaaaga

SEQ ID NO: 34421 - RNA, 18 nt, Artificial Sequence
  Description of Artificial Sequence: Synthetic oligonucleotide
ugcauaaccacgcuucaa

SEQ ID NO: 34422 - RNA, 18 nt, Artificial Sequence
  Description of Artificial Sequence: Synthetic oligonucleotide
uauguugcauaaccacgc

SEQ ID NO: 34423 - RNA, 18 nt, Artificial Sequence
  Description of Artificial Sequence: Synthetic oligonucleotide
uagcauauguugcauaac

SEQ ID NO: 34424 - RNA, 18 nt, Artificial Sequence
  Description of Artificial Sequence: Synthetic oligonucleotide
acgccuagcauauguugc

SEQ ID NO: 34425 - RNA, 18 nt, Artificial Sequence
  Description of Artificial Sequence: Synthetic oligonucleotide
aacuuacgccuagcauau

SEQ ID NO: 34426 - RNA, 18 nt, Artificial Sequence
  Description of Artificial Sequence: Synthetic oligonucleotide
ucaccaacuuacgccuag

SEQ ID NO: 34427 - RNA, 18 nt, Artificial Sequence
  Description of Artificial Sequence: Synthetic oligonucleotide
ggcauucaccaacuuacg

SEQ ID NO: 34428 - RNA, 18 nt, Artificial Sequence
  Description of Artificial Sequence: Synthetic oligonucleotide
aagcaggcauucaccaac

SEQ ID NO: 34429 - RNA, 18 nt, Artificial Sequence
  Description of Artificial Sequence: Synthetic oligonucleotide
cugcaaagcaggcauuca

SEQ ID NO: 34430 - RNA, 18 nt, Artificial Sequence
  Description of Artificial Sequence: Synthetic oligonucleotide
acacucugcaaagcaggc

SEQ ID NO: 34431 - RNA, 18 nt, Artificial Sequence
  Description of Artificial Sequence: Synthetic oligonucleotide
ggguuacacucugcaaag

SEQ ID NO: 34432 - RNA, 18 nt, Artificial Sequence
  Description of Artificial Sequence: Synthetic oligonucleotide
cuuuuuuuauucaauggg

SEQ ID NO: 34433 - RNA, 18 nt, Artificial Sequence
  Description of Artificial Sequence: Synthetic oligonucleotide
gcuuuuuuuauucaaugg

SEQ ID NO: 34434 - RNA, 18 nt, Artificial Sequence
  Description of Artificial Sequence: Synthetic oligonucleotide
acaaagcuuuuuuuauuc

SEQ ID NO: 34435 - RNA, 18 nt, Artificial Sequence
  Description of Artificial Sequence: Synthetic oligonucleotide
ggaaaacaaagcuuuuuu

SEQ ID NO: 34436 - RNA, 18 nt, Artificial Sequence
  Description of Artificial Sequence: Synthetic oligonucleotide
gaaagggaaaacaaagcu

SEQ ID NO: 34437 - RNA, 18 nt, Artificial Sequence
  Description of Artificial Sequence: Synthetic oligonucleotide
gggcagaaagggaaaaca

SEQ ID NO: 34438 - RNA, 18 nt, Artificial Sequence
  Description of Artificial Sequence: Synthetic oligonucleotide
gcccauacugauacaggg

SEQ ID NO: 34439 - RNA, 18 nt, Artificial Sequence
  Description of Artificial Sequence: Synthetic oligonucleotide
ugcccauacugauacagg

SEQ ID NO: 34440 - RNA, 18 nt, Artificial Sequence
  Description of Artificial Sequence: Synthetic oligonucleotide
gggugugcccauacugau

SEQ ID NO: 34441 - RNA, 18 nt, Artificial Sequence
  Description of Artificial Sequence: Synthetic oligonucleotide
gugcagggugugcccaua

SEQ ID NO: 34442 - RNA, 18 nt, Artificial Sequence
  Description of Artificial Sequence: Synthetic oligonucleotide
uuagagugcagggugugc

SEQ ID NO: 34443 - RNA, 18 nt, Artificial Sequence
  Description of Artificial Sequence: Synthetic oligonucleotide
uaaaguuagagugcaggg

SEQ ID NO: 34444 - RNA, 18 nt, Artificial Sequence
  Description of Artificial Sequence: Synthetic oligonucleotide
uagauuaaaguuagagug

SEQ ID NO: 34445 - RNA, 18 nt, Artificial Sequence
  Description of Artificial Sequence: Synthetic oligonucleotide
ugacguagauuaaaguua

SEQ ID NO: 34446 - RNA, 18 nt, Artificial Sequence
  Description of Artificial Sequence: Synthetic oligonucleotide
gagggugacguagauuaa

SEQ ID NO: 34447 - RNA, 18 nt, Artificial Sequence
  Description of Artificial Sequence: Synthetic oligonucleotide
caggugagggugacguag

SEQ ID NO: 34448 - RNA, 18 nt, Artificial Sequence
  Description of Artificial Sequence: Synthetic oligonucleotide
ccaaacaggugaggguga

SEQ ID NO: 34449 - RNA, 18 nt, Artificial Sequence
  Description of Artificial Sequence: Synthetic oligonucleotide
ccaaaccaaacaggugag

SEQ ID NO: 34450 - RNA, 18 nt, Artificial Sequence
  Description of Artificial Sequence: Synthetic oligonucleotide
uaaacccaaaccaaacag

SEQ ID NO: 34451 - RNA, 18 nt, Artificial Sequence
  Description of Artificial Sequence: Synthetic oligonucleotide
gacauuaaacccaaacca

SEQ ID NO: 34452 - RNA, 18 nt, Artificial Sequence
  Description of Artificial Sequence: Synthetic oligonucleotide
ucgcagacauuaaaccca

SEQ ID NO: 34453 - RNA, 18 nt, Artificial Sequence
  Description of Artificial Sequence: Synthetic oligonucleotide
uuuucucgcagacauuaa

SEQ ID NO: 34454 - RNA, 18 nt, Artificial Sequence
  Description of Artificial Sequence: Synthetic oligonucleotide
uuugguuuucucgcagac

SEQ ID NO: 34455 - RNA, 18 nt, Artificial Sequence
  Description of Artificial Sequence: Synthetic oligonucleotide
agauauuugguuuucucg

SEQ ID NO: 34456 - RNA, 18 nt, Artificial Sequence
  Description of Artificial Sequence: Synthetic oligonucleotide
acacaagauauuugguuu

SEQ ID NO: 34457 - RNA, 18 nt, Artificial Sequence
  Description of Artificial Sequence: Synthetic oligonucleotide
acaauacacaagauauuu

SEQ ID NO: 34458 - RNA, 18 nt, Artificial Sequence
  Description of Artificial Sequence: Synthetic oligonucleotide
aguucacaauacacaaga

SEQ ID NO: 34459 - RNA, 18 nt, Artificial Sequence
  Description of Artificial Sequence: Synthetic oligonucleotide
uugacaguucacaauaca

SEQ ID NO: 34460 - RNA, 18 nt, Artificial Sequence
  Description of Artificial Sequence: Synthetic oligonucleotide
uggcuuugacaguucaca

SEQ ID NO: 34461 - RNA, 18 nt, Artificial Sequence
  Description of Artificial Sequence: Synthetic oligonucleotide
uuagauggcuuugacagu

SEQ ID NO: 34462 - RNA, 18 nt, Artificial Sequence
  Description of Artificial Sequence: Synthetic oligonucleotide
uugguuuagauggcuuug

SEQ ID NO: 34463 - RNA, 18 nt, Artificial Sequence
  Description of Artificial Sequence: Synthetic oligonucleotide
ugggauugguuuagaugg

SEQ ID NO: 34464 - RNA, 18 nt, Artificial Sequence
  Description of Artificial Sequence: Synthetic oligonucleotide
gaccuugggauugguuua

SEQ ID NO: 34465 - RNA, 18 nt, Artificial Sequence
  Description of Artificial Sequence: Synthetic oligonucleotide
cacuugaccuugggauug

SEQ ID NO: 34466 - RNA, 18 nt, Artificial Sequence
  Description of Artificial Sequence: Synthetic oligonucleotide
auauccacuugaccuugg

SEQ ID NO: 34467 - RNA, 18 nt, Artificial Sequence
  Description of Artificial Sequence: Synthetic oligonucleotide
uuuuuauauccacuugac

SEQ ID NO: 34468 - RNA, 18 nt, Artificial Sequence
  Description of Artificial Sequence: Synthetic oligonucleotide
cagaauuuuuauauccac

SEQ ID NO: 34469 - RNA, 18 nt, Artificial Sequence
  Description of Artificial Sequence: Synthetic oligonucleotide
uuuggcagaauuuuuaua

SEQ ID NO: 34470 - RNA, 18 nt, Artificial Sequence
  Description of Artificial Sequence: Synthetic oligonucleotide
auguuuuuggcagaauuu

SEQ ID NO: 34471 - RNA, 18 nt, Artificial Sequence
  Description of Artificial Sequence: Synthetic oligonucleotide
augccauguuuuuggcag

SEQ ID NO: 34472 - RNA, 18 nt, Artificial Sequence
  Description of Artificial Sequence: Synthetic oligonucleotide
aucuuaugccauguuuuu

SEQ ID NO: 34473 - RNA, 18 nt, Artificial Sequence
  Description of Artificial Sequence: Synthetic oligonucleotide
uuuccaucuuaugccaug

SEQ ID NO: 34474 - RNA, 18 nt, Artificial Sequence
  Description of Artificial Sequence: Synthetic oligonucleotide
gaacuuuuccaucuuaug

SEQ ID NO: 34475 - RNA, 18 nt, Artificial Sequence
  Description of Artificial Sequence: Synthetic oligonucleotide
ucagggaacuuuuccauc

SEQ ID NO: 34476 - RNA, 18 nt, Artificial Sequence
  Description of Artificial Sequence: Synthetic oligonucleotide
aguuuucagggaacuuuu

SEQ ID NO: 34477 - RNA, 18 nt, Artificial Sequence
  Description of Artificial Sequence: Synthetic oligonucleotide
uccagaguuuucagggaa

SEQ ID NO: 34478 - RNA, 18 nt, Artificial Sequence
  Description of Artificial Sequence: Synthetic oligonucleotide
uuucuuccagaguuuuca

SEQ ID NO: 34479 - RNA, 18 nt, Artificial Sequence
  Description of Artificial Sequence: Synthetic oligonucleotide
uuuguuuucuuccagagu

SEQ ID NO: 34480 - RNA, 18 nt, Artificial Sequence
  Description of Artificial Sequence: Synthetic oligonucleotide
auuacuuuguuuucuucc

SEQ ID NO: 34481 - RNA, 18 nt, Artificial Sequence
  Description of Artificial Sequence: Synthetic oligonucleotide
ucuacauuacuuuguuuu

SEQ ID NO: 34482 - RNA, 18 nt, Artificial Sequence
  Description of Artificial Sequence: Synthetic oligonucleotide
aggugucuacauuacuuu

SEQ ID NO: 34483 - RNA, 18 nt, Artificial Sequence
  Description of Artificial Sequence: Synthetic oligonucleotide
aaagaaggugucuacauu

SEQ ID NO: 34484 - RNA, 18 nt, Artificial Sequence
  Description of Artificial Sequence: Synthetic oligonucleotide
gggaaaaagaaggugucu

SEQ ID NO: 34485 - RNA, 18 nt, Artificial Sequence
  Description of Artificial Sequence: Synthetic oligonucleotide
auuuucuaaugguguggg

SEQ ID NO: 34486 - RNA, 18 nt, Artificial Sequence
  Description of Artificial Sequence: Synthetic oligonucleotide
aacauuuucuaauggugu

SEQ ID NO: 34487 - RNA, 18 nt, Artificial Sequence
  Description of Artificial Sequence: Synthetic oligonucleotide
gaugcaacauuuucuaau

SEQ ID NO: 34488 - RNA, 18 nt, Artificial Sequence
  Description of Artificial Sequence: Synthetic oligonucleotide
guccucaucgucauuauu

SEQ ID NO: 34489 - RNA, 18 nt, Artificial Sequence
  Description of Artificial Sequence: Synthetic oligonucleotide
gucagguccucaucguca

SEQ ID NO: 34490 - RNA, 18 nt, Artificial Sequence
  Description of Artificial Sequence: Synthetic oligonucleotide
cuggugucagguccucau

SEQ ID NO: 34491 - RNA, 18 nt, Artificial Sequence
  Description of Artificial Sequence: Synthetic oligonucleotide
cugcucuggugucagguc

SEQ ID NO: 34492 - RNA, 18 nt, Artificial Sequence
  Description of Artificial Sequence: Synthetic oligonucleotide
gccuucugcucugguguc

SEQ ID NO: 34493 - RNA, 18 nt, Artificial Sequence
  Description of Artificial Sequence: Synthetic oligonucleotide
gcucugccuucugcucug

SEQ ID NO: 34494 - RNA, 18 nt, Artificial Sequence
  Description of Artificial Sequence: Synthetic oligonucleotide
cucacgcucugccuucug

SEQ ID NO: 34495 - RNA, 18 nt, Artificial Sequence
  Description of Artificial Sequence: Synthetic oligonucleotide
uccuucucacgcucugcc

SEQ ID NO: 34496 - RNA, 18 nt, Artificial Sequence
  Description of Artificial Sequence: Synthetic oligonucleotide
uccgcuccuucucacgcu

SEQ ID NO: 34497 - RNA, 18 nt, Artificial Sequence
  Description of Artificial Sequence: Synthetic oligonucleotide
cauccuccgcuccuucuc

SEQ ID NO: 34498 - RNA, 18 nt, Artificial Sequence
  Description of Artificial Sequence: Synthetic oligonucleotide
uuggccauccuccgcucc

SEQ ID NO: 34499 - RNA, 18 nt, Artificial Sequence
  Description of Artificial Sequence: Synthetic oligonucleotide
cauuguuggccauccucc

SEQ ID NO: 34500 - RNA, 18 nt, Artificial Sequence
  Description of Artificial Sequence: Synthetic oligonucleotide
ucgggcauuguuggccau

SEQ ID NO: 34501 - RNA, 18 nt, Artificial Sequence
  Description of Artificial Sequence: Synthetic oligonucleotide
cgcucucgggcauuguug

SEQ ID NO: 34502 - RNA, 18 nt, Artificial Sequence
  Description of Artificial Sequence: Synthetic oligonucleotide
gcagacgcucucgggcau

SEQ ID NO: 34503 - RNA, 18 nt, Artificial Sequence
  Description of Artificial Sequence: Synthetic oligonucleotide
gacccgcagacgcucucg

SEQ ID NO: 34504 - RNA, 18 nt, Artificial Sequence
  Description of Artificial Sequence: Synthetic oligonucleotide
ucacggacccgcagacgc

SEQ ID NO: 34505 - RNA, 18 nt, Artificial Sequence
  Description of Artificial Sequence: Synthetic oligonucleotide
ugaugucacggacccgca

SEQ ID NO: 34506 - RNA, 18 nt, Artificial Sequence
  Description of Artificial Sequence: Synthetic oligonucleotide
cucguugaugucacggac

SEQ ID NO: 34507 - RNA, 18 nt, Artificial Sequence
  Description of Artificial Sequence: Synthetic oligonucleotide
aaagccucguugauguca

SEQ ID NO: 34508 - RNA, 18 nt, Artificial Sequence
  Description of Artificial Sequence: Synthetic oligonucleotide
cuuugaaagccucguuga

SEQ ID NO: 34509 - RNA, 18 nt, Artificial Sequence
  Description of Artificial Sequence: Synthetic oligonucleotide
gagcucuuugaaagccuc

SEQ ID NO: 34510 - RNA, 18 nt, Artificial Sequence
  Description of Artificial Sequence: Synthetic oligonucleotide
cggccgagcucuuugaaa

SEQ ID NO: 34511 - RNA, 18 nt, Artificial Sequence
  Description of Artificial Sequence: Synthetic oligonucleotide
ccaugcggccgagcucuu

SEQ ID NO: 34512 - RNA, 18 nt, Artificial Sequence
  Description of Artificial Sequence: Synthetic oligonucleotide
cugcaccaugcggccgag

SEQ ID NO: 34513 - RNA, 18 nt, Artificial Sequence
  Description of Artificial Sequence: Synthetic oligonucleotide
uggagcugcaccaugcgg

SEQ ID NO: 34514 - RNA, 18 nt, Artificial Sequence
  Description of Artificial Sequence: Synthetic oligonucleotide
ugagguggagcugcacca

SEQ ID NO: 34515 - RNA, 18 nt, Artificial Sequence
  Description of Artificial Sequence: Synthetic oligonucleotide
acucuugagguggagcug

SEQ ID NO: 34516 - RNA, 18 nt, Artificial Sequence
  Description of Artificial Sequence: Synthetic oligonucleotide
uugucacucuugaggugg

SEQ ID NO: 34517 - RNA, 18 nt, Artificial Sequence
  Description of Artificial Sequence: Synthetic oligonucleotide
gggcuugucacucuugag

SEQ ID NO: 34518 - RNA, 18 nt, Artificial Sequence
  Description of Artificial Sequence: Synthetic oligonucleotide
ucaggagcuuggucuggg

SEQ ID NO: 34519 - RNA, 18 nt, Artificial Sequence
  Description of Artificial Sequence: Synthetic oligonucleotide
gaggaucaggagcuuggu

SEQ ID NO: 34520 - RNA, 18 nt, Artificial Sequence
  Description of Artificial Sequence: Synthetic oligonucleotide
ugguggaggaucaggagc

SEQ ID NO: 34521 - RNA, 18 nt, Artificial Sequence
  Description of Artificial Sequence: Synthetic oligonucleotide
ccgccugguggaggauca

SEQ ID NO: 34522 - RNA, 18 nt, Artificial Sequence
  Description of Artificial Sequence: Synthetic oligonucleotide
ggccaccgccugguggag

SEQ ID NO: 34523 - RNA, 18 nt, Artificial Sequence
  Description of Artificial Sequence: Synthetic oligonucleotide
augacggccaccgccugg

SEQ ID NO: 34524 - RNA, 18 nt, Artificial Sequence
  Description of Artificial Sequence: Synthetic oligonucleotide
ugaggaugacggccaccg

SEQ ID NO: 34525 - RNA, 18 nt, Artificial Sequence
  Description of Artificial Sequence: Synthetic oligonucleotide
cagacugaggaugacggc

SEQ ID NO: 34526 - RNA, 18 nt, Artificial Sequence
  Description of Artificial Sequence: Synthetic oligonucleotide
ugcuccagacugaggaug

SEQ ID NO: 34527 - RNA, 18 nt, Artificial Sequence
  Description of Artificial Sequence: Synthetic oligonucleotide
cuugcugcuccagacuga

SEQ ID NO: 34528 - RNA, 18 nt, Artificial Sequence
  Description of Artificial Sequence: Synthetic oligonucleotide
ucggacuugcugcuccag

SEQ ID NO: 34529 - RNA, 18 nt, Artificial Sequence
  Description of Artificial Sequence: Synthetic oligonucleotide
cuguaguccugguggcau

SEQ ID NO: 34530 - RNA, 18 nt, Artificial Sequence
  Description of Artificial Sequence: Synthetic oligonucleotide
ugccccuguaguccuggu

SEQ ID NO: 34531 - RNA, 18 nt, Artificial Sequence
  Description of Artificial Sequence: Synthetic oligonucleotide
cacucugccccuguaguc

SEQ ID NO: 34532 - RNA, 18 nt, Artificial Sequence
  Description of Artificial Sequence: Synthetic oligonucleotide
ggagacacucugccccug

SEQ ID NO: 34533 - RNA, 18 nt, Artificial Sequence
  Description of Artificial Sequence: Synthetic oligonucleotide
ccagaggagacacucugc

SEQ ID NO: 34534 - RNA, 18 nt, Artificial Sequence
  Description of Artificial Sequence: Synthetic oligonucleotide
agcugccagaggagacac

SEQ ID NO: 34535 - RNA, 18 nt, Artificial Sequence
  Description of Artificial Sequence: Synthetic oligonucleotide
cucagagcugccagagga

SEQ ID NO: 34536 - RNA, 18 nt, Artificial Sequence
  Description of Artificial Sequence: Synthetic oligonucleotide
uugaucucagagcugcca

SEQ ID NO: 34537 - RNA, 18 nt, Artificial Sequence
  Description of Artificial Sequence: Synthetic oligonucleotide
cggauuugaucucagagc

SEQ ID NO: 34538 - RNA, 18 nt, Artificial Sequence
  Description of Artificial Sequence: Synthetic oligonucleotide
gucaucggauuugaucuc

SEQ ID NO: 34539 - RNA, 18 nt, Artificial Sequence
  Description of Artificial Sequence: Synthetic oligonucleotide
cccucgucaucggauuug

SEQ ID NO: 34540 - RNA, 18 nt, Artificial Sequence
  Description of Artificial Sequence: Synthetic oligonucleotide
caucacccucgucaucgg

SEQ ID NO: 34541 - RNA, 18 nt, Artificial Sequence
  Description of Artificial Sequence: Synthetic oligonucleotide
guucucaucacccucguc

SEQ ID NO: 34542 - RNA, 18 nt, Artificial Sequence
  Description of Artificial Sequence: Synthetic oligonucleotide
ugcagguucucaucaccc

SEQ ID NO: 34543 - RNA, 18 nt, Artificial Sequence
  Description of Artificial Sequence: Synthetic oligonucleotide
ugucuugcagguucucau

SEQ ID NO: 34544 - RNA, 18 nt, Artificial Sequence
  Description of Artificial Sequence: Synthetic oligonucleotide
uuucgugucuugcagguu

SEQ ID NO: 34545 - RNA, 18 nt, Artificial Sequence
  Description of Artificial Sequence: Synthetic oligonucleotide
gaagauuucgugucuugc

SEQ ID NO: 34546 - RNA, 18 nt, Artificial Sequence
  Description of Artificial Sequence: Synthetic oligonucleotide
ccuccgaagauuucgugu

SEQ ID NO: 34547 - RNA, 18 nt, Artificial Sequence
  Description of Artificial Sequence: Synthetic oligonucleotide
cuuguccuccgaagauuu

SEQ ID NO: 34548 - RNA, 18 nt, Artificial Sequence
  Description of Artificial Sequence: Synthetic oligonucleotide
aauuucuuguccuccgaa

SEQ ID NO: 34549 - RNA, 18 nt, Artificial Sequence
  Description of Artificial Sequence: Synthetic oligonucleotide
caucuaauuucuuguccu

SEQ ID NO: 34550 - RNA, 18 nt, Artificial Sequence
  Description of Artificial Sequence: Synthetic oligonucleotide
gucgucaucuaauuucuu

SEQ ID NO: 34551 - RNA, 18 nt, Artificial Sequence
  Description of Artificial Sequence: Synthetic oligonucleotide
uucuugucgucaucuaau

SEQ ID NO: 34552 - RNA, 18 nt, Artificial Sequence
  Description of Artificial Sequence: Synthetic oligonucleotide
uauccuucuugucgucau

SEQ ID NO: 34553 - RNA, 18 nt, Artificial Sequence
  Description of Artificial Sequence: Synthetic oligonucleotide
uuugauauccuucuuguc

SEQ ID NO: 34554 - RNA, 18 nt, Artificial Sequence
  Description of Artificial Sequence: Synthetic oligonucleotide
auugauuugauauccuuc

SEQ ID NO: 34555 - RNA, 18 nt, Artificial Sequence
  Description of Artificial Sequence: Synthetic oligonucleotide
uaguaauugauuugauau

SEQ ID NO: 34556 - RNA, 18 nt, Artificial Sequence
  Description of Artificial Sequence: Synthetic oligonucleotide
ugaccuaguaauugauuu

SEQ ID NO: 34557 - RNA, 18 nt, Artificial Sequence
  Description of Artificial Sequence: Synthetic oligonucleotide
gaucuugaccuaguaauu

SEQ ID NO: 34558 - RNA, 18 nt, Artificial Sequence
  Description of Artificial Sequence: Synthetic oligonucleotide
gcgacaguauuauauacu

SEQ ID NO: 34559 - RNA, 18 nt, Artificial Sequence
  Description of Artificial Sequence: Synthetic oligonucleotide
augaagcgacaguauuau

SEQ ID NO: 34560 - RNA, 18 nt, Artificial Sequence
  Description of Artificial Sequence: Synthetic oligonucleotide
auuaaaugaagcgacagu

SEQ ID NO: 34561 - RNA, 18 nt, Artificial Sequence
  Description of Artificial Sequence: Synthetic oligonucleotide
aaggaauuaaaugaagcg

SEQ ID NO: 34562 - RNA, 18 nt, Artificial Sequence
  Description of Artificial Sequence: Synthetic oligonucleotide
caauaaaggaauuaaaug

SEQ ID NO: 34563 - RNA, 18 nt, Artificial Sequence
  Description of Artificial Sequence: Synthetic oligonucleotide
aaguccaauaaaggaauu

SEQ ID NO: 34564 - RNA, 18 nt, Artificial Sequence
  Description of Artificial Sequence: Synthetic oligonucleotide
caucaaaguccaauaaag

SEQ ID NO: 34565 - RNA, 18 nt, Artificial Sequence
  Description of Artificial Sequence: Synthetic oligonucleotide
cacuucaucaaaguccaa

SEQ ID NO: 34566 - RNA, 18 nt, Artificial Sequence
  Description of Artificial Sequence: Synthetic oligonucleotide
cuguucacuucaucaaag

SEQ ID NO: 34567 - RNA, 18 nt, Artificial Sequence
  Description of Artificial Sequence: Synthetic oligonucleotide
ccguucuguucacuucau

SEQ ID NO: 34568 - RNA, 18 nt, Artificial Sequence
  Description of Artificial Sequence: Synthetic oligonucleotide
ucuucccguucuguucac

SEQ ID NO: 34569 - RNA, 18 nt, Artificial Sequence
  Description of Artificial Sequence: Synthetic oligonucleotide
uaguuucuucccguucug

SEQ ID NO: 34570 - RNA, 18 nt, Artificial Sequence
  Description of Artificial Sequence: Synthetic oligonucleotide
cugaauaguuucuucccg

SEQ ID NO: 34571 - RNA, 18 nt, Artificial Sequence
  Description of Artificial Sequence: Synthetic oligonucleotide
aaaaacugaauaguuucu

SEQ ID NO: 34572 - RNA, 18 nt, Artificial Sequence
  Description of Artificial Sequence: Synthetic oligonucleotide
caggaaaaaacugaauag

SEQ ID NO: 34573 - RNA, 18 nt, Artificial Sequence
  Description of Artificial Sequence: Synthetic oligonucleotide
ccugccaggaaaaaacug

SEQ ID NO: 34574 - RNA, 18 nt, Artificial Sequence
  Description of Artificial Sequence: Synthetic oligonucleotide
auuuaccugccaggaaaa

SEQ ID NO: 34575 - RNA, 18 nt, Artificial Sequence
  Description of Artificial Sequence: Synthetic oligonucleotide
uguaaauuuaccugccag

SEQ ID NO: 34576 - RNA, 18 nt, Artificial Sequence
  Description of Artificial Sequence: Synthetic oligonucleotide
ucagcuguaaauuuaccu

SEQ ID NO: 34577 - RNA, 18 nt, Artificial Sequence
  Description of Artificial Sequence: Synthetic oligonucleotide
ucuuuucagcuguaaauu

SEQ ID NO: 34578 - RNA, 18 nt, Artificial Sequence
  Description of Artificial Sequence: Synthetic oligonucleotide
aauuuucuuuucagcugu

SEQ ID NO: 34579 - RNA, 18 nt, Artificial Sequence
  Description of Artificial Sequence: Synthetic oligonucleotide
ccuuuaauuuucuuuuca

SEQ ID NO: 34580 - RNA, 18 nt, Artificial Sequence
  Description of Artificial Sequence: Synthetic oligonucleotide
guaggccuuuaauuuucu

SEQ ID NO: 34581 - RNA, 18 nt, Artificial Sequence
  Description of Artificial Sequence: Synthetic oligonucleotide
cuagaguaggccuuuaau

SEQ ID NO: 34582 - RNA, 18 nt, Artificial Sequence
  Description of Artificial Sequence: Synthetic oligonucleotide
uacuucuagaguaggccu

SEQ ID NO: 34583 - RNA, 18 nt, Artificial Sequence
  Description of Artificial Sequence: Synthetic oligonucleotide
uuuaguacuucuagagua

SEQ ID NO: 34584 - RNA, 18 nt, Artificial Sequence
  Description of Artificial Sequence: Synthetic oligonucleotide
auacuuuuaguacuucua

SEQ ID NO: 34585 - RNA, 18 nt, Artificial Sequence
  Description of Artificial Sequence: Synthetic oligonucleotide
aaacgauacuuuuaguac

SEQ ID NO: 34586 - RNA, 18 nt, Artificial Sequence
  Description of Artificial Sequence: Synthetic oligonucleotide
aucugaaacgauacuuuu

SEQ ID NO: 34587 - RNA, 18 nt, Artificial Sequence
  Description of Artificial Sequence: Synthetic oligonucleotide
cagguaucugaaacgaua

SEQ ID NO: 34588 - RNA, 18 nt, Artificial Sequence
  Description of Artificial Sequence: Synthetic oligonucleotide
gaguacagguaucugaaa

SEQ ID NO: 34589 - RNA, 18 nt, Artificial Sequence
  Description of Artificial Sequence: Synthetic oligonucleotide
caauagaguacagguauc

SEQ ID NO: 34590 - RNA, 18 nt, Artificial Sequence
  Description of Artificial Sequence: Synthetic oligonucleotide
ggcuccaauagaguacag

SEQ ID NO: 34591 - RNA, 18 nt, Artificial Sequence
  Description of Artificial Sequence: Synthetic oligonucleotide
guuuaggcuccaauagag

SEQ ID NO: 34592 - RNA, 18 nt, Artificial Sequence
  Description of Artificial Sequence: Synthetic oligonucleotide
aaacaguuuaggcuccaa

SEQ ID NO: 34593 - RNA, 18 nt, Artificial Sequence
  Description of Artificial Sequence: Synthetic oligonucleotide
ugccaaaacaguuuaggc

SEQ ID NO: 34594 - RNA, 18 nt, Artificial Sequence
  Description of Artificial Sequence: Synthetic oligonucleotide
auaaaugccaaaacaguu

SEQ ID NO: 34595 - RNA, 18 nt, Artificial Sequence
  Description of Artificial Sequence: Synthetic oligonucleotide
gauucauaaaugccaaaa

SEQ ID NO: 34596 - RNA, 18 nt, Artificial Sequence
  Description of Artificial Sequence: Synthetic oligonucleotide
guccagauucauaaaugc

SEQ ID NO: 34597 - RNA, 18 nt, Artificial Sequence
  Description of Artificial Sequence: Synthetic oligonucleotide
auuggguccagauucaua

SEQ ID NO: 34598 - RNA, 18 nt, Artificial Sequence
  Description of Artificial Sequence: Synthetic oligonucleotide
uuagcauuggguccagau

SEQ ID NO: 34599 - RNA, 18 nt, Artificial Sequence
  Description of Artificial Sequence: Synthetic oligonucleotide
ugucauuagcauuggguc

SEQ ID NO: 34600 - RNA, 18 nt, Artificial Sequence
  Description of Artificial Sequence: Synthetic oligonucleotide
cugugugucauuagcauu

SEQ ID NO: 34601 - RNA, 18 nt, Artificial Sequence
  Description of Artificial Sequence: Synthetic oligonucleotide
uuucacugugugucauua

SEQ ID NO: 34602 - RNA, 18 nt, Artificial Sequence
  Description of Artificial Sequence: Synthetic oligonucleotide
aauuuuuucacugugugu

SEQ ID NO: 34603 - RNA, 18 nt, Artificial Sequence
  Description of Artificial Sequence: Synthetic oligonucleotide
agacaaauuuuuucacug

SEQ ID NO: 34604 - RNA, 18 nt, Artificial Sequence
  Description of Artificial Sequence: Synthetic oligonucleotide
aucagagacaaauuuuuu

SEQ ID NO: 34605 - RNA, 18 nt, Artificial Sequence
  Description of Artificial Sequence: Synthetic oligonucleotide
cuugaaucagagacaaau

SEQ ID NO: 34606 - RNA, 18 nt, Artificial Sequence
  Description of Artificial Sequence: Synthetic oligonucleotide
cuguacuugaaucagaga

SEQ ID NO: 34607 - RNA, 18 nt, Artificial Sequence
  Description of Artificial Sequence: Synthetic oligonucleotide
auaaacuguacuugaauc

SEQ ID NO: 34608 - RNA, 18 nt, Artificial Sequence
  Description of Artificial Sequence: Synthetic oligonucleotide
uacaaauaaacuguacuu

SEQ ID NO: 34609 - RNA, 18 nt, Artificial Sequence
  Description of Artificial Sequence: Synthetic oligonucleotide
aguuuuacaaauaaacug

SEQ ID NO: 34610 - RNA, 18 nt, Artificial Sequence
  Description of Artificial Sequence: Synthetic oligonucleotide
aguauaguuuuacaaaua

SEQ ID NO: 34611 - RNA, 18 nt, Artificial Sequence
  Description of Artificial Sequence: Synthetic oligonucleotide
gaauaaguauaguuuuac

SEQ ID NO: 34612 - RNA, 18 nt, Artificial Sequence
  Description of Artificial Sequence: Synthetic oligonucleotide
uuguagaauaaguauagu

SEQ ID NO: 34613 - RNA, 18 nt, Artificial Sequence
  Description of Artificial Sequence: Synthetic oligonucleotide
caaauuuguagaauaagu

SEQ ID NO: 34614 - RNA, 18 nt, Artificial Sequence
  Description of Artificial Sequence: Synthetic oligonucleotide
cugaccaaauuuguagaa

SEQ ID NO: 34615 - RNA, 18 nt, Artificial Sequence
  Description of Artificial Sequence: Synthetic oligonucleotide
cauuucugaccaaauuug

SEQ ID NO: 34616 - RNA, 18 nt, Artificial Sequence
  Description of Artificial Sequence: Synthetic oligonucleotide
cacaacauuucugaccaa

SEQ ID NO: 34617 - RNA, 18 nt, Artificial Sequence
  Description of Artificial Sequence: Synthetic oligonucleotide
auagacacaacauuucug

SEQ ID NO: 34618 - RNA, 18 nt, Artificial Sequence
  Description of Artificial Sequence: Synthetic oligonucleotide
auauuauagacacaacau

SEQ ID NO: 34619 - RNA, 18 nt, Artificial Sequence
  Description of Artificial Sequence: Synthetic oligonucleotide
uagaaauauuauagacac

SEQ ID NO: 34620 - RNA, 18 nt, Artificial Sequence
  Description of Artificial Sequence: Synthetic oligonucleotide
cuuuuuagaaauauuaua

SEQ ID NO: 34621 - RNA, 18 nt, Artificial Sequence
  Description of Artificial Sequence: Synthetic oligonucleotide
aaucucuuuuuagaaaua

SEQ ID NO: 34622 - RNA, 18 nt, Artificial Sequence
  Description of Artificial Sequence: Synthetic oligonucleotide
gcuacaaucucuuuuuag

SEQ ID NO: 34623 - RNA, 18 nt, Artificial Sequence
  Description of Artificial Sequence: Synthetic oligonucleotide
acauggcuacaaucucuu

SEQ ID NO: 34624 - RNA, 18 nt, Artificial Sequence
  Description of Artificial Sequence: Synthetic oligonucleotide
uuuuaacauggcuacaau

SEQ ID NO: 34625 - RNA, 18 nt, Artificial Sequence
  Description of Artificial Sequence: Synthetic oligonucleotide
ugaguuuuuaacauggcu

SEQ ID NO: 34626 - RNA, 18 nt, Artificial Sequence
  Description of Artificial Sequence: Synthetic oligonucleotide
ucaguugaguuuuuaaca

SEQ ID NO: 34627 - RNA, 18 nt, Artificial Sequence
  Description of Artificial Sequence: Synthetic oligonucleotide
auacaucaguugaguuuu

SEQ ID NO: 34628 - RNA, 18 nt, Artificial Sequence
  Description of Artificial Sequence: Synthetic oligonucleotide
ggcacauacaucaguuga

SEQ ID NO: 34629 - RNA, 18 nt, Artificial Sequence
  Description of Artificial Sequence: Synthetic oligonucleotide
uaguuggcacauacauca

SEQ ID NO: 34630 - RNA, 18 nt, Artificial Sequence
  Description of Artificial Sequence: Synthetic oligonucleotide
aguuauaguuggcacaua

SEQ ID NO: 34631 - RNA, 18 nt, Artificial Sequence
  Description of Artificial Sequence: Synthetic oligonucleotide
aaaagaguuauaguuggc

SEQ ID NO: 34632 - RNA, 18 nt, Artificial Sequence
  Description of Artificial Sequence: Synthetic oligonucleotide
guaagaaaagaguuauag

SEQ ID NO: 34633 - RNA, 18 nt, Artificial Sequence
  Description of Artificial Sequence: Synthetic oligonucleotide
uagagguaagaaaagagu

SEQ ID NO: 34634 - RNA, 18 nt, Artificial Sequence
  Description of Artificial Sequence: Synthetic oligonucleotide
uacuuuagagguaagaaa

SEQ ID NO: 34635 - RNA, 18 nt, Artificial Sequence
  Description of Artificial Sequence: Synthetic oligonucleotide
uuucuuacuuuagaggua

SEQ ID NO: 34636 - RNA, 18 nt, Artificial Sequence
  Description of Artificial Sequence: Synthetic oligonucleotide
auuauuuucuuacuuuag

SEQ ID NO: 34637 - RNA, 18 nt, Artificial Sequence
  Description of Artificial Sequence: Synthetic oligonucleotide
aggaaauuauuuucuuac

SEQ ID NO: 34638 - RNA, 18 nt, Artificial Sequence
  Description of Artificial Sequence: Synthetic oligonucleotide
aaucuaggaaauuauuuu

SEQ ID NO: 34639 - RNA, 18 nt, Artificial Sequence
  Description of Artificial Sequence: Synthetic oligonucleotide
ggauaaaucuaggaaauu

SEQ ID NO: 34640 - RNA, 18 nt, Artificial Sequence
  Description of Artificial Sequence: Synthetic oligonucleotide
guuuaggauaaaucuagg

SEQ ID NO: 34641 - RNA, 18 nt, Artificial Sequence
  Description of Artificial Sequence: Synthetic oligonucleotide
agcauguuuaggauaaau

SEQ ID NO: 34642 - RNA, 18 nt, Artificial Sequence
  Description of Artificial Sequence: Synthetic oligonucleotide
acaucagcauguuuagga

SEQ ID NO: 34643 - RNA, 18 nt, Artificial Sequence
  Description of Artificial Sequence: Synthetic oligonucleotide
uauauacaucagcauguu

SEQ ID NO: 34644 - RNA, 18 nt, Artificial Sequence
  Description of Artificial Sequence: Synthetic oligonucleotide
acucuuauauacaucagc

SEQ ID NO: 34645 - RNA, 18 nt, Artificial Sequence
  Description of Artificial Sequence: Synthetic oligonucleotide
guauuacucuuauauaca

SEQ ID NO: 34646 - RNA, 18 nt, Artificial Sequence
  Description of Artificial Sequence: Synthetic oligonucleotide
uuaagguauuacucuuau

SEQ ID NO: 34647 - RNA, 18 nt, Artificial Sequence
  Description of Artificial Sequence: Synthetic oligonucleotide
aacaauuaagguauuacu

SEQ ID NO: 34648 - RNA, 18 nt, Artificial Sequence
  Description of Artificial Sequence: Synthetic oligonucleotide
ccauaaacaauuaaggua

SEQ ID NO: 34649 - RNA, 18 nt, Artificial Sequence
  Description of Artificial Sequence: Synthetic oligonucleotide
aaaaaccauaaacaauua

SEQ ID NO: 34650 - RNA, 18 nt, Artificial Sequence
  Description of Artificial Sequence: Synthetic oligonucleotide
ggaagaaaaaccauaaac

SEQ ID NO: 34651 - RNA, 18 nt, Artificial Sequence
  Description of Artificial Sequence: Synthetic oligonucleotide
guccaggaagaaaaacca

SEQ ID NO: 34652 - RNA, 18 nt, Artificial Sequence
  Description of Artificial Sequence: Synthetic oligonucleotide
agaguguccaggaagaaa

SEQ ID NO: 34653 - RNA, 18 nt, Artificial Sequence
  Description of Artificial Sequence: Synthetic oligonucleotide
agaaaagaguguccagga

SEQ ID NO: 34654 - RNA, 18 nt, Artificial Sequence
  Description of Artificial Sequence: Synthetic oligonucleotide
ucuguagaaaagaguguc

SEQ ID NO: 34655 - RNA, 18 nt, Artificial Sequence
  Description of Artificial Sequence: Synthetic oligonucleotide
uguuuucuguagaaaaga

SEQ ID NO: 34656 - RNA, 18 nt, Artificial Sequence
  Description of Artificial Sequence: Synthetic oligonucleotide
aguuguguuuucuguaga

SEQ ID NO: 34657 - RNA, 18 nt, Artificial Sequence
  Description of Artificial Sequence: Synthetic oligonucleotide
caaaaaaauacaaggcag

SEQ ID NO: 34658 - RNA, 18 nt, Artificial Sequence
  Description of Artificial Sequence: Synthetic oligonucleotide
uaggucaaaaaaauacaa

SEQ ID NO: 34659 - RNA, 18 nt, Artificial Sequence
  Description of Artificial Sequence: Synthetic oligonucleotide
uuugauaggucaaaaaaa

SEQ ID NO: 34660 - RNA, 18 nt, Artificial Sequence
  Description of Artificial Sequence: Synthetic oligonucleotide
augauuuugauaggucaa

SEQ ID NO: 34661 - RNA, 18 nt, Artificial Sequence
  Description of Artificial Sequence: Synthetic oligonucleotide
gaaaaaugauuuugauag

SEQ ID NO: 34662 - RNA, 18 nt, Artificial Sequence
  Description of Artificial Sequence: Synthetic oligonucleotide
uaauugaaaaaugauuuu

SEQ ID NO: 34663 - RNA, 18 nt, Artificial Sequence
  Description of Artificial Sequence: Synthetic oligonucleotide
acaaguaauugaaaaaug

SEQ ID NO: 34664 - RNA, 18 nt, Artificial Sequence
  Description of Artificial Sequence: Synthetic oligonucleotide
gggaaacaaguaauugaa

SEQ ID NO: 34665 - RNA, 18 nt, Artificial Sequence
  Description of Artificial Sequence: Synthetic oligonucleotide
gacaucugaaaucuaggg

SEQ ID NO: 34666 - RNA, 18 nt, Artificial Sequence
  Description of Artificial Sequence: Synthetic oligonucleotide
ccgugacaucugaaaucu

SEQ ID NO: 34667 - RNA, 18 nt, Artificial Sequence
  Description of Artificial Sequence: Synthetic oligonucleotide
ucauaccgugacaucuga

SEQ ID NO: 34668 - RNA, 18 nt, Artificial Sequence
  Description of Artificial Sequence: Synthetic oligonucleotide
accuuucauaccgugaca

SEQ ID NO: 34669 - RNA, 18 nt, Artificial Sequence
  Description of Artificial Sequence: Synthetic oligonucleotide
auaaaaccuuucauaccg

SEQ ID NO: 34670 - RNA, 18 nt, Artificial Sequence
  Description of Artificial Sequence: Synthetic oligonucleotide
uauauauaaaaccuuuca

SEQ ID NO: 34671 - RNA, 18 nt, Artificial Sequence
  Description of Artificial Sequence: Synthetic oligonucleotide
uuaaauauauauaaaacc

SEQ ID NO: 34672 - RNA, 18 nt, Artificial Sequence
  Description of Artificial Sequence: Synthetic oligonucleotide
auuuuuuaaauauauaua

SEQ ID NO: 34673 - RNA, 18 nt, Artificial Sequence
  Description of Artificial Sequence: Synthetic oligonucleotide
acuuuauuuuuuaaauau

SEQ ID NO: 34674 - RNA, 18 nt, Artificial Sequence
  Description of Artificial Sequence: Synthetic oligonucleotide
uuuauacuuuauuuuuua

SEQ ID NO: 34675 - RNA, 18 nt, Artificial Sequence
  Description of Artificial Sequence: Synthetic oligonucleotide
uuauguuuauacuuuauu

SEQ ID NO: 34676 - RNA, 18 nt, Artificial Sequence
  Description of Artificial Sequence: Synthetic oligonucleotide
agacuuuauguuuauacu

SEQ ID NO: 34677 - RNA, 18 nt, Artificial Sequence
  Description of Artificial Sequence: Synthetic oligonucleotide
caaaaagacuuuauguuu

SEQ ID NO: 34678 - RNA, 18 nt, Artificial Sequence
  Description of Artificial Sequence: Synthetic oligonucleotide
cgcuucaaaaagacuuua

SEQ ID NO: 34679 - RNA, 18 nt, Artificial Sequence
  Description of Artificial Sequence: Synthetic oligonucleotide
aaccacgcuucaaaaaga

SEQ ID NO: 34680 - RNA, 18 nt, Artificial Sequence
  Description of Artificial Sequence: Synthetic oligonucleotide
ugcauaaccacgcuucaa

SEQ ID NO: 34681 - RNA, 18 nt, Artificial Sequence
  Description of Artificial Sequence: Synthetic oligonucleotide
uauguugcauaaccacgc

SEQ ID NO: 34682 - RNA, 18 nt, Artificial Sequence
  Description of Artificial Sequence: Synthetic oligonucleotide
uagcauauguugcauaac

SEQ ID NO: 34683 - RNA, 18 nt, Artificial Sequence
  Description of Artificial Sequence: Synthetic oligonucleotide
acgccuagcauauguugc

SEQ ID NO: 34684 - RNA, 18 nt, Artificial Sequence
  Description of Artificial Sequence: Synthetic oligonucleotide
aacuuacgccuagcauau

SEQ ID NO: 34685 - RNA, 18 nt, Artificial Sequence
  Description of Artificial Sequence: Synthetic oligonucleotide
ucaccaacuuacgccuag

SEQ ID NO: 34686 - RNA, 18 nt, Artificial Sequence
  Description of Artificial Sequence: Synthetic oligonucleotide
ggcauucaccaacuuacg

SEQ ID NO: 34687 - RNA, 18 nt, Artificial Sequence
  Description of Artificial Sequence: Synthetic oligonucleotide
aagcaggcauucaccaac

SEQ ID NO: 34688 - RNA, 18 nt, Artificial Sequence
  Description of Artificial Sequence: Synthetic oligonucleotide
cugcaaagcaggcauuca

SEQ ID NO: 34689 - RNA, 18 nt, Artificial Sequence
  Description of Artificial Sequence: Synthetic oligonucleotide
acacucugcaaagcaggc

SEQ ID NO: 34690 - RNA, 18 nt, Artificial Sequence
  Description of Artificial Sequence: Synthetic oligonucleotide
ggguuacacucugcaaag

SEQ ID NO: 34691 - RNA, 18 nt, Artificial Sequence
  Description of Artificial Sequence: Synthetic oligonucleotide
cuuuuuuuauucaauggg

SEQ ID NO: 34692 - RNA, 18 nt, Artificial Sequence
  Description of Artificial Sequence: Synthetic oligonucleotide
gcuuuuuuuauucaaugg

SEQ ID NO: 34693 - RNA, 18 nt, Artificial Sequence
  Description of Artificial Sequence: Synthetic oligonucleotide
acaaagcuuuuuuuauuc

SEQ ID NO: 34694 - RNA, 18 nt, Artificial Sequence
  Description of Artificial Sequence: Synthetic oligonucleotide
ggaaaacaaagcuuuuuu

SEQ ID NO: 34695 - RNA, 18 nt, Artificial Sequence
  Description of Artificial Sequence: Synthetic oligonucleotide
gaaagggaaaacaaagcu

SEQ ID NO: 34696 - RNA, 18 nt, Artificial Sequence
  Description of Artificial Sequence: Synthetic oligonucleotide
gggcagaaagggaaaaca

SEQ ID NO: 34697 - RNA, 18 nt, Artificial Sequence
  Description of Artificial Sequence: Synthetic oligonucleotide
gcccauacugauacaggg

SEQ ID NO: 34698 - RNA, 18 nt, Artificial Sequence
  Description of Artificial Sequence: Synthetic oligonucleotide
ugcccauacugauacagg

SEQ ID NO: 34699 - RNA, 18 nt, Artificial Sequence
  Description of Artificial Sequence: Synthetic oligonucleotide
gggugugcccauacugau

SEQ ID NO: 34700 - RNA, 18 nt, Artificial Sequence
  Description of Artificial Sequence: Synthetic oligonucleotide
gugcagggugugcccaua

SEQ ID NO: 34701 - RNA, 18 nt, Artificial Sequence
  Description of Artificial Sequence: Synthetic oligonucleotide
uuagagugcagggugugc

SEQ ID NO: 34702 - RNA, 18 nt, Artificial Sequence
  Description of Artificial Sequence: Synthetic oligonucleotide
uaaaguuagagugcaggg

SEQ ID NO: 34703 - RNA, 18 nt, Artificial Sequence
  Description of Artificial Sequence: Synthetic oligonucleotide
uagauuaaaguuagagug

SEQ ID NO: 34704 - RNA, 18 nt, Artificial Sequence
  Description of Artificial Sequence: Synthetic oligonucleotide
ugacguagauuaaaguua

SEQ ID NO: 34705 - RNA, 18 nt, Artificial Sequence
  Description of Artificial Sequence: Synthetic oligonucleotide
gagggugacguagauuaa

SEQ ID NO: 34706 - RNA, 18 nt, Artificial Sequence
  Description of Artificial Sequence: Synthetic oligonucleotide
caggugagggugacguag

SEQ ID NO: 34707 - RNA, 18 nt, Artificial Sequence
  Description of Artificial Sequence: Synthetic oligonucleotide
ccaaacaggugaggguga

SEQ ID NO: 34708 - RNA, 18 nt, Artificial Sequence
  Description of Artificial Sequence: Synthetic oligonucleotide
ccaaaccaaacaggugag

SEQ ID NO: 34709 - RNA, 18 nt, Artificial Sequence
  Description of Artificial Sequence: Synthetic oligonucleotide
uaaacccaaaccaaacag

SEQ ID NO: 34710 - RNA, 18 nt, Artificial Sequence
  Description of Artificial Sequence: Synthetic oligonucleotide
gacauuaaacccaaacca

SEQ ID NO: 34711 - RNA, 18 nt, Artificial Sequence
  Description of Artificial Sequence: Synthetic oligonucleotide
ucgcagacauuaaaccca

SEQ ID NO: 34712 - RNA, 18 nt, Artificial Sequence
  Description of Artificial Sequence: Synthetic oligonucleotide
uuuucucgcagacauuaa

SEQ ID NO: 34713 - RNA, 18 nt, Artificial Sequence
  Description of Artificial Sequence: Synthetic oligonucleotide
uuugguuuucucgcagac

SEQ ID NO: 34714 - RNA, 18 nt, Artificial Sequence
  Description of Artificial Sequence: Synthetic oligonucleotide
agauauuugguuuucucg

SEQ ID NO: 34715 - RNA, 18 nt, Artificial Sequence
  Description of Artificial Sequence: Synthetic oligonucleotide
acacaagauauuugguuu

SEQ ID NO: 34716 - RNA, 18 nt, Artificial Sequence
  Description of Artificial Sequence: Synthetic oligonucleotide
acaauacacaagauauuu

SEQ ID NO: 34717 - RNA, 18 nt, Artificial Sequence
  Description of Artificial Sequence: Synthetic oligonucleotide
aguucacaauacacaaga

SEQ ID NO: 34718 - RNA, 18 nt, Artificial Sequence
  Description of Artificial Sequence: Synthetic oligonucleotide
uugacaguucacaauaca

SEQ ID NO: 34719 - RNA, 18 nt, Artificial Sequence
  Description of Artificial Sequence: Synthetic oligonucleotide
uggcuuugacaguucaca

SEQ ID NO: 34720 - RNA, 18 nt, Artificial Sequence
  Description of Artificial Sequence: Synthetic oligonucleotide
uuagauggcuuugacagu

SEQ ID NO: 34721 - RNA, 18 nt, Artificial Sequence
  Description of Artificial Sequence: Synthetic oligonucleotide
uugguuuagauggcuuug

SEQ ID NO: 34722 - RNA, 18 nt, Artificial Sequence
  Description of Artificial Sequence: Synthetic oligonucleotide
ugggauugguuuagaugg

SEQ ID NO: 34723 - RNA, 18 nt, Artificial Sequence
  Description of Artificial Sequence: Synthetic oligonucleotide
gaccuugggauugguuua

SEQ ID NO: 34724 - RNA, 18 nt, Artificial Sequence
  Description of Artificial Sequence: Synthetic oligonucleotide
cacuugaccuugggauug

SEQ ID NO: 34725 - RNA, 18 nt, Artificial Sequence
  Description of Artificial Sequence: Synthetic oligonucleotide
auauccacuugaccuugg

SEQ ID NO: 34726 - RNA, 18 nt, Artificial Sequence
  Description of Artificial Sequence: Synthetic oligonucleotide
uuuuuauauccacuugac

SEQ ID NO: 34727 - RNA, 18 nt, Artificial Sequence
  Description of Artificial Sequence: Synthetic oligonucleotide
cagaauuuuuauauccac

SEQ ID NO: 34728 - RNA, 18 nt, Artificial Sequence
  Description of Artificial Sequence: Synthetic oligonucleotide
uuuggcagaauuuuuaua

SEQ ID NO: 34729 - RNA, 18 nt, Artificial Sequence
  Description of Artificial Sequence: Synthetic oligonucleotide
auguuuuuggcagaauuu

SEQ ID NO: 34730 - RNA, 18 nt, Artificial Sequence
  Description of Artificial Sequence: Synthetic oligonucleotide
augccauguuuuuggcag

SEQ ID NO: 34731 - RNA, 18 nt, Artificial Sequence
  Description of Artificial Sequence: Synthetic oligonucleotide
aucuuaugccauguuuuu

SEQ ID NO: 34732 - RNA, 18 nt, Artificial Sequence
  Description of Artificial Sequence: Synthetic oligonucleotide
uuuccaucuuaugccaug

SEQ ID NO: 34733 - RNA, 18 nt, Artificial Sequence
  Description of Artificial Sequence: Synthetic oligonucleotide
gaacuuuuccaucuuaug

SEQ ID NO: 34734 - RNA, 18 nt, Artificial Sequence
  Description of Artificial Sequence: Synthetic oligonucleotide
ucagggaacuuuuccauc

SEQ ID NO: 34735 - RNA, 18 nt, Artificial Sequence
  Description of Artificial Sequence: Synthetic oligonucleotide
aguuuucagggaacuuuu

SEQ ID NO: 34736 - RNA, 18 nt, Artificial Sequence
  Description of Artificial Sequence: Synthetic oligonucleotide
uccagaguuuucagggaa

SEQ ID NO: 34737 - RNA, 18 nt, Artificial Sequence
  Description of Artificial Sequence: Synthetic oligonucleotide
uuucuuccagaguuuuca

SEQ ID NO: 34738 - RNA, 18 nt, Artificial Sequence
  Description of Artificial Sequence: Synthetic oligonucleotide
uuuguuuucuuccagagu

SEQ ID NO: 34739 - RNA, 18 nt, Artificial Sequence
  Description of Artificial Sequence: Synthetic oligonucleotide
auuacuuuguuuucuucc

SEQ ID NO: 34740 - RNA, 18 nt, Artificial Sequence
  Description of Artificial Sequence: Synthetic oligonucleotide
ucuacauuacuuuguuuu

SEQ ID NO: 34741 - RNA, 18 nt, Artificial Sequence
  Description of Artificial Sequence: Synthetic oligonucleotide
aggugucuacauuacuuu

SEQ ID NO: 34742 - RNA, 18 nt, Artificial Sequence
  Description of Artificial Sequence: Synthetic oligonucleotide
aaagaaggugucuacauu

SEQ ID NO: 34743 - RNA, 18 nt, Artificial Sequence
  Description of Artificial Sequence: Synthetic oligonucleotide
gggaaaaagaaggugucu

SEQ ID NO: 34744 - RNA, 18 nt, Artificial Sequence
  Description of Artificial Sequence: Synthetic oligonucleotide
auuuucuaaugguguggg

SEQ ID NO: 34745 - RNA, 18 nt, Artificial Sequence
  Description of Artificial Sequence: Synthetic oligonucleotide
aacauuuucuaauggugu

SEQ ID NO: 34746 - RNA, 18 nt, Artificial Sequence
  Description of Artificial Sequence: Synthetic oligonucleotide
gaugcaacauuuucuaau

SEQ ID NO: 34747 - RNA, 18 nt, Artificial Sequence
  Description of Artificial Sequence: Synthetic oligonucleotide
guccucaucgucauuauu

SEQ ID NO: 34748 - RNA, 18 nt, Artificial Sequence
  Description of Artificial Sequence: Synthetic oligonucleotide
gucagguccucaucguca

SEQ ID NO: 34749 - RNA, 18 nt, Artificial Sequence
  Description of Artificial Sequence: Synthetic oligonucleotide
cuggugucagguccucau

SEQ ID NO: 34750 - RNA, 18 nt, Artificial Sequence
  Description of Artificial Sequence: Synthetic oligonucleotide
cugcucuggugucagguc

SEQ ID NO: 34751 - RNA, 18 nt, Artificial Sequence
  Description of Artificial Sequence: Synthetic oligonucleotide
gccuucugcucugguguc

SEQ ID NO: 34752 - RNA, 18 nt, Artificial Sequence
  Description of Artificial Sequence: Synthetic oligonucleotide
gcucugccuucugcucug

SEQ ID NO: 34753 - RNA, 18 nt, Artificial Sequence
  Description of Artificial Sequence: Synthetic oligonucleotide
cucacgcucugccuucug

SEQ ID NO: 34754 - RNA, 18 nt, Artificial Sequence
  Description of Artificial Sequence: Synthetic oligonucleotide
uccuucucacgcucugcc

SEQ ID NO: 34755 - RNA, 18 nt, Artificial Sequence
  Description of Artificial Sequence: Synthetic oligonucleotide
uccgcuccuucucacgcu

SEQ ID NO: 34756 - RNA, 18 nt, Artificial Sequence
  Description of Artificial Sequence: Synthetic oligonucleotide
cauccuccgcuccuucuc

SEQ ID NO: 34757 - RNA, 18 nt, Artificial Sequence
  Description of Artificial Sequence: Synthetic oligonucleotide
uuggccauccuccgcucc

SEQ ID NO: 34758 - RNA, 18 nt, Artificial Sequence
  Description of Artificial Sequence: Synthetic oligonucleotide
cauuguuggccauccucc

SEQ ID NO: 34759 - RNA, 18 nt, Artificial Sequence
  Description of Artificial Sequence: Synthetic oligonucleotide
ucgggcauuguuggccau

SEQ ID NO: 34760 - RNA, 18 nt, Artificial Sequence
  Description of Artificial Sequence: Synthetic oligonucleotide
cgcucucgggcauuguug

SEQ ID NO: 34761 - RNA, 18 nt, Artificial Sequence
  Description of Artificial Sequence: Synthetic oligonucleotide
gcagacgcucucgggcau

SEQ ID NO: 34762 - RNA, 18 nt, Artificial Sequence
  Description of Artificial Sequence: Synthetic oligonucleotide
gacccgcagacgcucucg

SEQ ID NO: 34763 - RNA, 18 nt, Artificial Sequence
  Description of Artificial Sequence: Synthetic oligonucleotide
ucacggacccgcagacgc

SEQ ID NO: 34764 - RNA, 18 nt, Artificial Sequence
  Description of Artificial Sequence: Synthetic oligonucleotide
ugaugucacggacccgca

SEQ ID NO: 34765 - RNA, 18 nt, Artificial Sequence
  Description of Artificial Sequence: Synthetic oligonucleotide
cucguugaugucacggac

SEQ ID NO: 34766 - RNA, 18 nt, Artificial Sequence
  Description of Artificial Sequence: Synthetic oligonucleotide
aaagccucguugauguca

SEQ ID NO: 34767 - RNA, 18 nt, Artificial Sequence
  Description of Artificial Sequence: Synthetic oligonucleotide
cuuugaaagccucguuga

SEQ ID NO: 34768 - RNA, 18 nt, Artificial Sequence
  Description of Artificial Sequence: Synthetic oligonucleotide
gagcucuuugaaagccuc

SEQ ID NO: 34769 - RNA, 18 nt, Artificial Sequence
  Description of Artificial Sequence: Synthetic oligonucleotide
cggccgagcucuuugaaa

SEQ ID NO: 34770 - RNA, 18 nt, Artificial Sequence
  Description of Artificial Sequence: Synthetic oligonucleotide
ccaugcggccgagcucuu

SEQ ID NO: 34771 - RNA, 18 nt, Artificial Sequence
  Description of Artificial Sequence: Synthetic oligonucleotide
cugcaccaugcggccgag

SEQ ID NO: 34772 - RNA, 18 nt, Artificial Sequence
  Description of Artificial Sequence: Synthetic oligonucleotide
uggagcugcaccaugcgg

SEQ ID NO: 34773 - RNA, 18 nt, Artificial Sequence
  Description of Artificial Sequence: Synthetic oligonucleotide
ugagguggagcugcacca

SEQ ID NO: 34774 - RNA, 18 nt, Artificial Sequence
  Description of Artificial Sequence: Synthetic oligonucleotide
acucuugagguggagcug

SEQ ID NO: 34775 - RNA, 18 nt, Artificial Sequence
  Description of Artificial Sequence: Synthetic oligonucleotide
uugucacucuugaggugg

SEQ ID NO: 34776 - RNA, 18 nt, Artificial Sequence
  Description of Artificial Sequence: Synthetic oligonucleotide
gggcuugucacucuugag

SEQ ID NO: 34777 - RNA, 18 nt, Artificial Sequence
  Description of Artificial Sequence: Synthetic oligonucleotide
ucaggagcuuggucuggg

SEQ ID NO: 34778 - RNA, 18 nt, Artificial Sequence
  Description of Artificial Sequence: Synthetic oligonucleotide
gaggaucaggagcuuggu

SEQ ID NO: 34779 - RNA, 18 nt, Artificial Sequence
  Description of Artificial Sequence: Synthetic oligonucleotide
ugguggaggaucaggagc

SEQ ID NO: 34780 - RNA, 18 nt, Artificial Sequence
  Description of Artificial Sequence: Synthetic oligonucleotide
ccgccugguggaggauca

SEQ ID NO: 34781 - RNA, 18 nt, Artificial Sequence
  Description of Artificial Sequence: Synthetic oligonucleotide
ggccaccgccugguggag

SEQ ID NO: 34782 - RNA, 18 nt, Artificial Sequence
  Description of Artificial Sequence: Synthetic oligonucleotide
augacggccaccgccugg

SEQ ID NO: 34783 - RNA, 18 nt, Artificial Sequence
  Description of Artificial Sequence: Synthetic oligonucleotide
ugaggaugacggccaccg

SEQ ID NO: 34784 - RNA, 18 nt, Artificial Sequence
  Description of Artificial Sequence: Synthetic oligonucleotide
cagacugaggaugacggc

SEQ ID NO: 34785 - RNA, 18 nt, Artificial Sequence
  Description of Artificial Sequence: Synthetic oligonucleotide
ugcuccagacugaggaug

SEQ ID NO: 34786 - RNA, 18 nt, Artificial Sequence
  Description of Artificial Sequence: Synthetic oligonucleotide
cuugcugcuccagacuga

SEQ ID NO: 34787 - RNA, 18 nt, Artificial Sequence
  Description of Artificial Sequence: Synthetic oligonucleotide
ucggacuugcugcuccag

SEQ ID NO: 34788 - DNA, 3825 bp, Homo sapiens
gcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctaggtaacagtatataatactgtcgcttcatttaattcctttattggactttgatgaagtgaacagaacgggaagaaactattcagttttttcctggcaggtaaatttacagctgaaaagaaaattaaaggcctactctagaagtactaaaagtatcgtttcagatacctgtactctattggagcctaaactgttttggcatttatgaatctggacccaatgctaatgacacacagtgaaaaaatttgtctctgattcaagtacagtttatttgtaaaactatacttattctacaaatttggtcagaaatgttgtgtctataatatttctaaaaagagattgtagccatgttaaaaactcaactgatgtatgtgccaactataactcttttcttacctctaaagtaagaaaataatttcctagatttatcctaaacatgctgatgtatataagagtaataccttaattgtttatggtttttcttcctggacactcttttctacagaaaacacaactgcaggaaaatagcttctgtctggttttcttaaatatctgctatctttaaattcaaatctatatctccttgaactttaatctggtaatcagatggtttttgaataccaacacccgtgtactttgcctcaattccctgaggttgtttttattcacaaattcaaccaattgtcctaagactacagctttccttctaaaggctgtggttctcaaggttctatctggaatcttttgtgaattaagaacatgctgcctctttatgttgctgttgtaattattgagataaattccgtgtcttgccacaagtttaaaaatgccgaatacttctagataacccctttccttccttgttgtctttttctgattcttggccactttggcaagaaatcccaaggaggggatttcatacctttagcagcttctgtgttagaccagtcagttcttggtaatttaacttattgtggccaaacttatgcatgttaatggattctttgaagttttggaacaacattttcattcgctgttgagaaccttcttatttaaaaaggtcactcttatgacatttacttatgtatgcctccaaaactgtattataaggcagtgctttttcaaatctaggcagttttatttgcataactagtttatttgtaagtgaataaccaattctaattggtcgttagcctgaaaatctttggaagaaaagttcctattttccagtctcctttgtgtaaggtgtagcatttgttggatgtataaaaatatcacccaaatgctcagcttccggacaggcctggcagagactgttttcatttgctttttacagcctatttgcatagtagaatataggagtgaattaatcattactgatttccttggcactggcagcagttgggggtgagggcagaggagggatccgcagaaggcagagaaagagggccttttccagtggactcagttgacttccatgtttaccatacacacctgtggcagacagtgccatctggaaaggcgcttacgctatggagagagaggagcctggtcttacagcatccttctgtggtgtcatcctccttgcccctaacttttctccttcacccaagtgttcttgacttacgtgcattatctttatgtgtaacgtatacttgcaaccgaagaataccactcccacttttgattgattggagcttctcaagtgtaattggtccttattgccacttggaagttacccagagattctccaaaatggaacatcagagtcatatattttaaaccagcattcattaaatatacatttaattgagtagataatttcccacatcttccaactccgaaatgttgtgattaatcatctttattctgtgaacatttccaatgtgtgaaattaccctttaggttaattgttagtcacttccatggagtttcttgtgatggggagtctactgatgttcagtgaagtttgtttcattttctgtgtctctcataagccccccaaaagtcctcactcatgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggcttttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcgtccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgcgagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgag

SEQ ID NO: 34789 - DNA, 3825 bp, Homo sapiens; identical to SEQ ID NO: 34788

SEQ ID NO: 34790 - DNA, 128312 bp, Homo sapiens
aggacacagcgtccggagccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaaggtaacagttactgtctgtggtttaaaaatgaggtgtggagcaaataaacaggttggaagtgtggggtggggtggtggggtagggtggtggggcagggtggggggttgtgagcagtcagtgggcttgtcgccgattagcactgaagcagtgtttagctggacggcctttctgtgggcccctctgacagtgcccttcccaggaagatgtgtttctctgtcctcagccacatgaaaatcttttgcctaccgtgcctgtcaatccattgcctgcccgcccctcccccaccccccgttttacacctgcctgtccagtctaccgctctctagggcatccacgctgagcagtgggaagaactttaagccctgaagagcaggccaaaggcaagcaagaaccccctcgaacagcttcccagcttagtgaggccttatttcattgattctctgaggcacattgttttttcacatgttagcatttctgaaattgggatgcagctcacgatcaagtcacagtttaactggacacattatttttctttcttagtggtgcagaaaagtaacagtgtgtcttacaattgactgcgtcctagattctgtgagatgcaatacgttattaaccatcacgcacatttcctgaactctttcaatgagcagacaccagcctgggttagactggagccctaaaagcacgacacagattccaccctggactggcttctgttctgcctgggaaaacccaaagtacgtttggagaccaagagcaacataaagtagcataggtggaatagtccatgagaagtgcgagcaaaaggtgccggagatcagagaacaccaagactgtacttgtaaatgacaactggctttgtgcaattttttctgggaaaggataaggagtgactatagaactgtaaagaaagaatgcactttgctacagccttgcagagttgtgcaaatgccgatgactaaaggagctgaaagaggaaggaggggataagggatgggggctgggtaggggtgagattaggaccctgggagctgcaagccactggagagatcaggaggaaagggagggagacctgctttaggcgagaagagaacagtatttgttccaaatctcggttcagaataagttcatgtaggtgatggggccaactggaacaggtgaaggcctatgaatgagtgtctcagttagggtctccttagagtttaatatgaaaaggtgttagctaagtacagagctggtacctgagagagtaaaaggaaactctaaggtatcatggaggtagcaattgcaggacacagctcccacccctagggctgagagaaccaagggaagagacaggaattattaagacttggagcatagatgagaggtctgtggagctgacattaggacttgggaggaaggcgtgcatggaggctgctgctggatctctgaacctgacctcgggtctggacccctgaggagaaagccctggcaggttggtgcatgtggggccgagggacaatagcttaacaaccagcataaaagagagcagcatgggacacgcttcaaccatgcgcatggatggctccaaaacctgtgtgtggctggcccaggacgcagggaggctgcagggggaagagacaagttaaacctgacttgtctgggaagcaccattgtcctcaggtcactttcctctgtcaagcctggtgctgaagttatctgttgtctccaggggccaagtattaagagtaatcagaaactcagtcctttcttctaggagcttcccttcttgcatgaaaatcctgataaaactggaaaaaaaaacctcatgattaaattttttcatgtattcattctttccttctatcaaaaaataatctccaggcaccgtgctaggttcattggtatacaatggcaacaagacctcccagcccctgcctatgtgaggcatctgtggactgcggaggaaaatccaatatgccattgttctctctttcccataagaaattacaattctcagttcattttattctcactgtgctctttgtgaccctcaaagggggtcacatgataacaggactgtagctgctggcctaaaatgagcccattcctgtggcgctcatgtcgctgtgacagagaataaccctgttttcagaatgctctggtgccctccctctcaatctggcctttcgctggcatgggtgggcgactcctgctcagggactctgccttctccacagtgtgctcccagggagatggagccactcgggctgagggccttggccagggcacctcccagggctgggcctggtctgggctggcgttcactggatgccatcctgatggcctggaaattgagatttctgtctggcacgcctcccgatggctccccacctgctaccacattccaggagcttccaggatgtctgggtaagacagaggcacccccaacagattcagtagctctgagagggatctgtggctccttcctaagcttgcggttcttctggaaacttctgcctctagaagatggtccctctaagaaaagtacaaccacccagcccataattcagctcccaggttttccctcaaacctccatgtctcctgtaagcagagcaagagtaaaatcagataccaaatttcctcattcctcagctcccaatccctaagggcataagatgaaaatcttcagatctctgctttcctccctctttttttcttcctctgttaacatttgtcaagtgttactaagtgtctggcactgtactaagtgcatcacctccctgaactctccgaacagttccacgagagaggcctctctgtgatccccccggtactgatgaggtcactgaggctccagagaaggattagtaactggtggggttggacctgggattcacacccatgctgcgtgacccaggacaggcaggcatggccgttacaccacactgacccccgtggatcgagatctatccaatagtctggtcactgatatcactaagatagagtggccatataatttatcatccaatcagggcagttttgcaagtgaaagggagcactattaataattgcactgggacaataaatgtaaaccaacactggacctggaaaactgggacgtgtgtttgccctataccaaggtaagctagacacagccactgccttcatggagttcagaaccaggcaggggcggctcccacgtataattactgtgcagcacaacgtggagaccgtggagtagaaggaaacacggatgggaggtgaggaggaggtctgtgagctcagaggaggcaccggggctggagagggtgagagaagacttcccaaggagttcatcctgataacgtgcattcccaatgacgagcgctctctccactgcacaagacaagtatacatctgcccgtgttggctgtggacctggcgctgtgtcagggagggtttatgaagatcactaggtgggtctcttggtgtcatcccttcatcccagcttctgggttaggatggatatctgtgggggggcctgaggactcatgaaagtggggcgctaatcatgttttggacaccacaccctggagcacctgggacagctgtggcctttgtcctgggttcagcatcaagccgaggatgtggcaagtaaagagaggctgggcaccaactccagtgtacccaggctccgggtcatgtttgtccaggctaagaattctgtcctggttctcagtgcagaaggaagaatcatggggctcattttaggccttggctgccttctgttaaattgaaaacagagcaggaaggaagaaaatttaacaggctcagttctaaaacaacaagcacaactgtgcccttgccagaaacccctcctccccatgttgattgaatggtaaagagaggaggggaggtgagagggagagagagagagaggaagagagagagaaaggaaagaaaggaaagaagaagaaagaaagaaaaggaaagaaagaaagaaagaaagaaagaaagaaagaaagaaagaaagaaagaaagaaagagaaagaaagaaaggagggagggagggaaggggaaaagaaaagaaaagaaaaagaaaaaaagaaggaaataccagtttgggaaaaaagaattttccaccagcccttctgagccttggctgggcttaattaaagttacagacatgtgtaaagggcagggtagggggagtctgagctgctgagaaaacatgtttttaattatactgtggaatttctccctggggtatgcctgtacgcagttaagcgtcaaggacagggatgccgctctggggaggggaagctgagcatgattttggaagccggcagaagaggctattgtgaaaaccagacctgtcaggctaggaaaagaatggctggtggtctttgaccagggagtgacgcgtgaaatgcagcaaccgcccccgccccccgccaaaaacaaacacactctcacagagttagaacaacagtgacctctcaacaaatatttttcaaagattaccaaccaaccattacctagagcagcggttctcaaccttggctgcacggtggaactacctgagacgtgttaaaaagaagaaccctgatgtcccatgccccaagattctgatgtagttgatctggggtatgatctgagaccccggcatgttttcagcctgcagccacatgagaagtgctgacctaatcaacaggggtgatgatttgaggggcggggactataggcaaaaaaaaacagcctaattcaaggatgagaagagggcacaggtgaggtgggaacagtcctagggccagacaaagaaggaagggagaaaggaggtgctgatccctcccctactcctgagaggaggcctttaagtcaccgtgccttgtggagaccagattcttcaaaaatacaagaatgagtgagtgagggagtgggtggatgccaggagagtgcgtgacaagccttgcaagggaggatgacaatgcactagcttggtttggaaattttacccctggaacaggcaggccaagctggctggtcccctccctgatacacagccctccctctttatatatggagcaggggacggtgtgtggctggtttcttagcaagcaccatggttccaagttggcaactggggagttctgaatccaaaaaggagggagatgaacgtaagtggagggcaggcctacaaggttgcagataagcttaattctgtctccttactcttctgcctttgcaacaaccctgtgatcttgcgacaaccctgtaaggcaataacaaatggctcatgtttattgagtgttacctcatgccatattgtgctttcgtgtttaacacaattgtctcatttcaccctcacgactgctctgggaggtaggtcctggtatcacatccatttcacagatgagaccatttggcacggaagagttgagtgggctgcccaaggtcacatagctaagatggaacaggctggataggaaccccagtaacttgacctcagagtaaccttctcttaaccctgagtgtacactgtaggaaaaatgagcagtcccatttcagagaggacaaaactgagactcagaggttaagcaagccccaaagtggttgttaacccagatcttcccactaactcccaaatcagcatcagtgtttaacgtaccagacctctcccagatagatgttgccgcatggaagacagccgatctacgtgatagaaagccaatattgcaagcagtcgtctaaaggagtcaaatgtgttggatttgaactggatgtctcatttctttggtgaagacactggaaacaacttccaggtttcatcaattgctcctatcactcaacgttgctatcttactgaacttgttccccagccttacccactgatggaatgatccagaatggaagacaagacaccaatgtacatgaccctgggggaggctgtttcttaaatctacagactgttggtgacctgagccccatgtcaccaaaggctttcctggagaagcctcctagaccagtcttgacaaaggctcactcattccgtggatatttattgggcacctattatgagttctgccccatgtggggtgctggaatcacagtagtgacaacgacagatgaggttcctgtcctcaggaagcttactgcccttgagggcttcacttacttggaggagtgatgaacctgaagtgcggtgtgtgttaagaagcggaagtccagggccaggcgcggtggctcacgcctgtaatcccagcactttgggaggctgaggcaggcggatcaccaggtcaggagatcgagaccatcctggctaacatggtgaaaccccgtctctactaaaaatacaaaaaaattagccgggcatggtggtgggcacctgcagtcccagctactcaggaggctgaggcaggagagtggcgtgaacctgggaggcagagcttgcagtgagccaagatcgtgccactgcactccagcctgggcaacagagtgagactccgtctcaaaaagaaaaaaaaaagtgcctcacggagagtctattcttttcttcccatattgtgtgtgtgtgtgcgcgcttcctccaacacatcctccctatatatattttgagtaaaacatcttgtaaaaagttacagctacataatcaccacctgtccctaaatagtttttgctttttctttcttcaatgcacgatcattttcccccatcaatttattttttagtttcttataatcttgttgccagtaggctgttttttaaaaagcagaacatggtttgttcttactagcaggaaaggagcatttattgagcctctgctatggtgtcttttattttgctgagagcctatttacatttctttgagaggaaaacaacaaagggttacatgaaagaccatgtgaatagcccctagctgatctattaaacttgctattccccggccagctgcttcagatctccttcagatcttatgtgtttccttcctaaggtccctggagtaagggttgcatagacctattctactctccaactcacatgtccctctccctcttcctctccataattccacatctccaacccccacccctatgtgcaatgccacagggtgtggactgccacagccactggatctgcttttggaatcaagagtccttaagctccaaatggaaccgaaatttaaataccaactttcaaccatatgttaacatcagcagcctcttccaatgtaaaaacccatggcagtgtgccctgctttgtttctttaagcaatagaaacttgaaggaagcatgttggtaggccagatttttgttggctttgcaatggatcacagtcatttattcactcattcattcactgattcattaaatgaccacatttgcaagggcaaggtaatggggagggccagaaaggacactggccccagaaacaggaggctggattttggttctgatgctgccactgctgatgtgacactgcacaggtcacctgcctcctctgagcctctttccttaactgcagagtgagtggctacagagaaatctttactacctgttagatcagcattacctgggagcttgttagaaatgcaagctctggtggggccatactgaacccaaatctgcattcatgtgcatagtgacagctaaaatgcactgaagcagatgatcttgatgatcctttatgaaagtctcatgctaatgcagttttctaaaatagaggcagagtggaacccagatggacacaaaatctggttgatataataaaacaaggtagagggtgtatggtggggagggggtaaaggaaggaaactgtttaggtaaagataccacaaccaaagtcctactgcacacatgggatctgaggagggctgtgtctgctctggttacgttttctataatctcttagcaccactgaactttctctctttttgttttgtttttccagattcgctttgtggtggaactcgtgtggcctttatctttatttctggtcttgatctggttaaggaatgccaacccactctacagccatcatgaatgtaagcatagcagggtagcttgggcaagccctgaagagactttggtctgggccttttgtctagaaagatcttggggtgggagtgtggggatcagatctgcttatcatcatttcatgtctatgatgcatgtaacagatttatcaatgttacacaaattataatttttaaaaagtctttagagacagggtctcactctgttgccgaggctggagtacagtgttaggaccatggcacactgcagcttctatctcttgggctcaagtgatcctcctgcctgggcttccaaagtgctggaattataggcatgagccactgctcccagctaatttttttgttttttgtggagacagagtcactacattgcccgggctggtcttgaactcctggcctcaagtgatcctcccacctcagcgttctaaagcactgggattacaagcatgagccaccttgtccagcccaaattttcatgttttaatcctacacattctaagcaaatacttgtgtgtagttactaagggactgtgcacttatttttgtttgctttgttgttgctagtttttatttttttatacctaaactctctcgttttaaagagaacagatttgtagatgagttctcgaaaatatttcaggaatcaatatagagaatatgttatacatggtgccagagaaaaatgaggacaagagatgctatacaatcgtactgaagaaaaattttatttcttggacccctgaggtgtctgcagacctgaaaggaacctagtgagagcctcttttacactctgcccctgtgggaaagccttcacctggtttccggccctctatgtggtgaatgtggaagcctcaagcgttatgcaaatctgcccagtcctctattcttgatcttcaccttctcgttcatgagtttcaggccccagttctgaatcagcctcctgtccatcagactcttctttacctctccccgaggagcccataacctgcagccctactgcatgcttggggtaggtgctcagttcaccgtggttgaaggaatagacgagcgtctgctcaagcagcagcagcaactgcgtggagtcttcttgaactaacactcctatgcccctctcggcacaaaatgacgtgtccccccttgcttccccttcacatttccacccatgcctattacaacatccgtctgtctccccactacaccgggagcttgagagaagaggccatgtctctagcacccagcacagggactggcacacatgagatgctcctgcttcttaaatgctgagaatgaaggaggacatcagaggggcccgggccccttcccaaaaaggccaactcctaggtctgcatcctgcttggtctccatgactaatcccgtcttgtcctcattttctgttttaaaggccatttccccaacaaggcgatgccctcagcaggaatgctgccgtggctccaggggatcttctgcaatgtgaacaatccctgttttcaaagccccaccccaggagaatctcctggaattgtgtcaaactataacaactccatgtaagtgttgagatccctaccatgcaggggaggaagttgcacaccccttcacgtgctgaaatgcacacgtgcgtgcacggagcatggagcactgagtgttcttgtggctttgctgagcccctaacctcttaggagcagagcaggtttcctctctggaacattctgttaactgtcagggcacttggggagaaatctccaagctaaggccacgtgcacaaaatttcttggtccttatatccccagaatgtgacctggagtctgatggcagcccgctgcagagatgtgtccactgccttctggtcattgacctgcttgggtggagtgaatcattgtaggagaaaaactcagttccctcaccctgatcaacctggacagatctctcttcctttaaaagctttcttggacatctaagggctaggaaaaatgtcagggagcattgggaaggtaaatgaagtcaggtttacaaagtcaagtttacttcttgggagaaaaatacaatttccaaatcctctgttataattgccatcggccccctggagtggtgagatctcggaatatggctcgggtgcagtggctcttcactgtgggcctgcaggctattctgaaaagctgatgaaaaccaatgacccctcttccaagaaaaatggccacataccaaacattacactgtacatctgatttcagggaattgtagatgccaggttagtagcctcaggtctagggtcaaaattcaagtcgaatcccacaggaagagggtctgccttcggaattccctttcagagcattgggagaacatcatgggagcatattctagagacagaggcttagggtgtggacagggccatccctcacccactgtgctgaccttaagcagcaccttgtgcagcccatacctgaaggccaccagcaaaggcctgttggggagcaggctttacccgacctgtataaacaccaggctaggtgaaaactgagatacctggttactttagttttttccttgggggagctcagtatgattcttccaggagaagcctgcttttagactaaaaagaaaaaaagtttgataggtcaacctaatgattggaggtggccttccccactgtgaacaaactatggctgcatgtgccctacaatggcagagttgagtagttgtgatagagactgtatgatctgtaagcctgtaatttttatgtttgctgacccctggattaccagatgatagaagaggaaacatctgtcttcctagcaaagtcaaggaagtggcatttagcaggactcatattgctgcaagcactgccttgcagttttagtttacaactgcactttcagcttaagaaacacctgcccatccagagagatcgtgtggggtcacatggtgggatcagggaggcctgaagacagctcagtggaggctgcatggagctttggtgggaacggccctggcagtgtctatagatgttattgcggaaaactgaggggtgggagttggagaagggggctccagactctagctgtacttggcatttgaacccggaaagttgggtttcatgttttgcactcacattatgagtgaaatattggcttattcaaggttcttttgcttgcaaggcacggaaacccattcaagcaatcttaaaccccagaaggaaatctatgatttggatactagacattctcacagagccaagggcagcaaggcggggctcaggagaggcaggccaagacctggagagctgtcaggagctgcttcctcaactctcttccatctgggcctgccagccctggcctctgtatctactccattcacctctctccatggaccagtctcccctgctcctcaatgcctgggctgccattgttcatgcaattcacaatacctcggcctgggcaatcagaagctcatctctgaacaccatccaaattcctgggaacaaatcgggttgacccagctttattctccctgtcccatcagccttggcagaggcgtgcatgtgcatgcgtgccaatgtgtgtgtgcagggaggtccttgtggatgaagcatggctgtcagagcctacctgcgtgaatgggtggaagggcaggtctcagagaattgggtaaaaactggataaaccctccagtgatatccaccaatgtcaccctgtttaaggcttctctgggcaagagacacacagagcatgggaccgagaggcgagcagaccctgccaaaactgggagactgaatagatcgctcaccatccttgtcagttagcctatatgtacaaggaagtaaaattatctctttctcctgccttggcagtattgtaaggatactcaatgtagtagctaggccagacacatagtatctttaaatatagcatgagatggccaagcacggtggctcatgcctgtaatcccagcactttgggaggctgaggcgggtggatcacgaggtcaggagatcgagaccatcctggctaacacgatgaagccccgtctctactaaaaatataaaaaattagctgggtgtggtggcgggcgcctgtagtcccagctactcgggaggctgaggcaggagaatagcgtgaacccggggggcagagcttgcagtgagccgagatcacgccactgcactccagcctgggtgacagagcgagataaaaaaaaaaaatagcatgagatattattactgttataaaaataacagctatttccttattaatgaggctttgtccttacagcttggcaagggtatatcgagattttcaagaactcctcatgaatgcaccagagagccagcaccttggccgtatttggacagagctacacatcttgtcccaattcatggacaccctccggactcacccggagagaattgcaggtaagcatgactgcagtgctctcaagcatcatttccctcacctatggagagactgaagatataggaaagaacagggagagttggtgaaaaatatactagcggaggcaggaagggatggggtctggaggcggcttgaacatcaccttggtgaagatgcctcttcctccacagaagcctggaaggtaggaagttgggaaggaaggcaggaaaggtctcatccacgttaagtctagagacagaaagaatgctaagagagatggcactatgggaagtatgaggctaggtcaagggctagaagcaggggagacgagtttacagagtttcgtaaagatatagagcaactctcacagagttctagagcgagagctaaccaggaacatgaagcagcaaggccaactatcattaaggagccagggaggtcagagatcatgtattatcatgacataaatatgcataattgtactatttctcccagtaatatttagcacccaggccccgaggcagagcaagtggagagtgggtgatgcagggctgggggtgtgtatggaggcaccacagaaggtcaacaggcagcgggctgaaggcagggactggactacatgcatcaagtccaggctgcacgaggaaggatgagaaggcagatgagcacggaaatggactgggggaaatgaagaggcaagggaatagaagtctcagtgggtgccatgaccctgtttaagtgattgagaaaatgaacaagatgaaaaggttaatggctgtggtcagaaagtgaaatatgtgaattcaggatttcgaaggtagggtgggtgatgactggcccccagatgcggccatggtgaagtggggcaaaggtgcaggtgcatggtgaggggaaggaggaaatgggaggtgatgatgttggccccacacggacaccacggttgtgcaggaagatggcaggagctgggcaccagggtgggagccacctggagtcaggaagagtgaagagaaaggatgaagaggctccctctcctgtgtctctcctccccaggagaagaacaagaaacaatccgaaagtaataacaccaatgtgcctttacaaagtgtgagtgggtgttgtgtgctgtcacgtgtgtagtaggctcctctgtggatggctagagggactggacatggccactggatcccacttgcaagagcagaggaaaagagtggtcgtgaggaagtaaagccccccaaaatccaggggttgctgcagctttgggtgtggagcgtgccctctgaggaaaggctgctctgggggagattgcccaggaaacggggctcagaggccacgaaagcagctgttaggggcttctgggagatgtgtgctcctaggattagggagttgactctaaggatgaccttagaggttaacagggatgagaaaggggtcaccaaggggtctaccaggggaatgggagaggctgtattgatagaacagcttctgctgcaggttccaaacaagaaatgtgggagaatggttgaaatcagccccgggggcaccttcccgtgcatgcgtgcagctccttcaacattcagtcgaccttcagtgcctcctgtgagccaggcactgggctagtctctgggggtggagagatgagtcaggcaaatgccagccctcagagggctcacagggcagaaggtgagagatgagtgagcagaaaatgaccacagcgcgtgtggggcccagtggagggaaggaggggattcaggagcacaggagagtcaacaggggaaacttctccgaggagaatctgatcctcctcccatctggccaccttctgaagccctctctccccatccaagtgagaaaggacaggcgtatgaccagattggtgtatgaagatgctgaattacgttctcattgtttcaaactagtaaaccatagattttatgtagtaacttctacaaactgcattacaaacactccattctttgttgccctgggtagaagtttattttagtgagcccaagtttgaggaaccttatatggtatgagtacaattaccattttaatagtaagaaatcccccttcccctgtgtaccaaccagaaggtgtttttttcctaatttaaacaaacagatgcagacgtgggctgtccagctcctggcgggatgacatacctcatgcatccagtgggtttgatgatgaggcagacatttcacttaagtgcctgatcatcagattgagtcctgctgggaggaagtgtgaaggaagtaatttcaaaccacagtttctctgtggcttttacaatgtggatatgagaaccaaaatcactacttcttaaccccagagcaggactgattttgaattggtatgcaggcggttccttctgcaggcttcgggctgtgagaagtccctaacagagcaaatctggggacaagggctcaggaaaggttggccacggccccctaggaatgggggctctgcaagatccctggccttagaggctgtgagagggaacaggggtccatccccaagtaagggacacggtctttgaggaaatcccaggccagggcctgaagggcactgtcaggaacacaggctgtttcagtctgttgagattcaccggggcgctgctcactgtgagcacggactcctcaggccaatgtggcagaagagcccacctttgaaagcgagcgggtgggggtggcggggctggtgctggtgcgtgcttctgcacagccacctgggaaggtatgccgctggttgacccaggcagaggttttctttcatggcaaacctgcagtactgcattctcagcagggaggattaatggtaaaagaccaggcatggagcccccttccctctccctcgaagcaagctctgtggtctctcaatcatctttaaaacaccttcttcccgggagcctcctacattctcctggcttccctcccacccccaccctcagctcctggggcctcagcagccccacccccaagcctctaatcttcccagggaagggaacaagaagaaccacattttaaacgaaatttatttttctttcctcaggctcccagttcacatttctccctcaggagtctagggaagcttctgtctggtatcggcctcctcttcacctgggcccccgccctcctcaggtgtaccagaagccagcacactcccccttcccccccagagccacagcagccctgtctcctgggtggtcttgtgtgccaagcctgggcaacatcactcccagcttttcttgttttgccccttctccccagcaagatatttgtatgtaaggtcaggtgagtgagttaaagaataacgaagagataaacagtcaaatggagtcctgactgtcaggtcaagacaacagttatttactgaatgcctcatgtcattcaacagacatttattgagactctgattggatgtcagtctttaatgctgggtgtcagagagaggtgacttcaagggcttgcatctgtgcacccagcattgctaggtacaatgaggagtataataaaagcaggagccatagcccccaactctcaagagatctcccatgtgtgtatgtctgcatatgcgtgcgtgtgcatgtgtgcgcatgtgtgcatgtgtgtgtgcatgtgtgtgcatgcgtgtgtgtgtgcgtgtgttggggatggtgttggtggagtgagagtgtacaaggctgtgtatgaaggggtaattgggaaaagaacaatggagctggcacccagggacaggaggaaaagcaggagggctgggtttggaagacagccggatttatgtttttgaagagggaagactagaatataagggagcagcccttctcagagccctcctcctcccttcgggccctgtgtccagctttccccaaagtccttggatctttcctatgcaaaggggagtgacagtgggcaccactctcagggaacccattactgtgagagaagccactgtgccactgtgtggtcgaacttcaagaccggcttcccctgccccagctgcatggacaggcctgtggggttggcgcaagacccttccagaggaaactagctgcaacataaatccggatatggtgctgttcagggaaaggcacaacctggggatgagaagggtggctgtccagcacacaggggcaggcctcttggccactgggggaggggagaatttggagaggaagaggatgggatgccgtggaattgggaccaggaaagaatggggacatgtgatggttaaagctagttagagaagaactgggagataaacagtcacccatgcccctgaagcactcggggtgaagagattggcattttcacgcaccccagtgctttccctttgtgttgaagtcccttcgtagacatccaggcccataaggctcttctctggccagagcctcatgaactatagcactagcagggttgaggccaagcattggccctggaagccagccgaggaggagggtgcttgtgtgaatctcccaggaggggtaagaattatattaattcgatcataataagcatttattgagtgctgttttgaggcctgggagctaagcacttcacattccttaccccgcatcaacaatcctatgaggtagatgtggaaaatgcagacacggggacaggctcaatcacttgccccaaggtcaccttaactgttaggtgttctttatgcctccttataaagaaaccctgcttcccacaggtgttgagaggagctggagggagcttgactagggctcatcaggcaagccccggcatgtgcctggctctcctctttctacctggagcttttcctgcccttaatggccccaactcatttctcttagtccatgtcagtgccctgagcatctcagcccaagctgagatgatagaaacacccagaggggtcctctaccctgtgacagctgcggtgtgggaagagcacgtgtctcctccaatcctagaccagagtttctcagcctcagcatcactgacacttggggctagataatcctttgtgtgggggagggaggagtgtcttgggccttgcaggatgtttagcagcatctctggcctctacccaccagcacctccccagttgtgacacccagaaatgtctttagatcttgccaaatatttccaggaggatgaaattcccctgtttcagttccccagccccacctcaatgagaagcactgtcctagaccaaccccacaaagcatctgacacccccatccagccctggctaactttttccaccttcttactaaattgggcccagctgcttcagcagtcaatgtgttgggggcagcccactggcaagagcctcacctctaggggctcccagagaccccaagaacagaaccttcctctgagagttgagttacaagtgtttccaatcgactctggctgttttcctttttttgacccatttccccttcaacaccctgttctttctcttattcatatgtaggaagaggaatacgaataagggatatcttgaaagatgaagaaacactgacactatttctcattaaaaacatcggcctgtctgactcagtggtctaccttctgatcaactctcaagtccgtccagagcaggtagggggatgtcactggccagtggtccctggaggggagggaagcacccagcctgagaaaggcaagaaatatattggcttttttcttctttcttccttgtgttcacattcagaatccatcacttaatgccttgtatttagaaaaaaaccgggggatcacttgagatcgtgatcattttcaacataggattcgaagctgtacacatcctggtgaccttaaaacatctcaggtttttataactggaaggaaccttagagatcatggggcacaaccttctctttatagatgaggaaacagaaatctattcatttattactcaaatatttagggacagttgtaggtactagaacacagtgtgaaccagacaggcaaaaccccaggccagggagcttccattccagtggggccacaggcgatgctcaggtaagcagagactccgctgtgtgacttctggctgtgatgggtgctgcaaggaaaatccggtagagtcgagggttagagagggacggaggggcaggtttaagggggatgctcaggaaggccttcctgaggaggtggtatttgagcagagttgtctgtcagccacacagtaagtgagaggggagttccgggcttggaagctgccagcacagtgctggcaagtgctggggtggcgtcccgaggctacagaacctgagatgctgcagaagagcccacttctgctttcctggaccacttccttctcagcaccaggcaaactccttcttctatcccctggcacatttctgacctgtgtatacgcccccaatttatctaacccctttaaataatctcctctatttatgcagagcattcttaccactaactcacgacttgcacatcccttagctcccttactcctcacaacaatcctgagatgggtcagagaaggaggcttgcgcgtctggtgatggggtgatttgtgcacagttacagggctagaaattgtcagagccagatggaatccaggtcctctcaatcctaatccagtgtttcttacttcagtcctgtggctctcaaagcccagagaccagcagcatcagcgatgcctgggagcttgttaggaatgcaaattatcagggcccactccaggtgaactgggtccaaagccctgggataaggcctagcaatctgtgcttcacaagccctccaggtgattccgcaggctcaggtgtgagagctgcagctgtcctctgggccttctgggctccccgcccagcttcttcagtgtgatgaacacagcgagaatgctagatctgcagcagctgatatcccagacaccctcccgactccctcctggctgggtctgatcctcctccagactccaggagagaacgagacataaacagaacttcagagcctgtgttaaccctgagatcaaggtctgcacagggtgctgtctgagtccagaggagtgagggaccccaccccacctggtcagcaccagctcctggaagcaggttctcacactggttccctgcacaatgaaggagctcatacctgcttttctggcttctcagaccctgaggttttcaccgaaactagacaaggggaacctagggtcagcctggaggcagggtgagcttggcgcctgcagtgcccaggccctgggtggtgcggctccggccaggccctgtttagcttcctctcccacccccacagagggggtgctgtcggcaccgattgctcattttcccctttgctttctcttcagctcgtaaaactcaagtcctgacaatgccttgatgacttccagttggtaataaaagggagatgaagataaggacaggaatttcggggaaatttctttccagttccttactaatgtgacatttagatctctagtactgtgcttctggcatcagtgccaaggcctttcatgttggagaatggaggccggggtcaccaggttgtgcctttatttcatgttgctggctctgatgagctgatgctctgctgattagcaaacgctgagccatctgcgcttcgcagaggcacgttccagccaacccggccctccctgcccacttcccaggatgctttgccttgtgggctcacctgtcttctagctcctgatctgtatctccacctccatccagttccggggctccttatcagcactgttcccagaactgtccatcacgatggcaacgttctctctgggcgctgtccaacatgggagctcgcctctgtgttgtcactcatgctcattgaacatggatttgtgtcctttaccatcaggactggatacccctcctggtcctttctgcctggggtcttagcacagctcagaaggaacctcaccattccctctctccatctagggaattagaagatgacaggggcacagttctctggctcacccccagcccagtaaactcctggacatgcttcaaggcccagctcagatgttgcctcctcagtgaaataatttataaacccacccttctttgtcctgccttctccctcttccctactcactggagagttaacaggtgatggttaagctctgggttcaaatctcacaaggccacacacttagctatgtgacttcaggcaagttaattaaccactctgtgcctctcgtttcctcatttgtaaaatggaaatagtaaaagtgcctaccagcatggcagttgaagttaaaagaaataatatatgtgaacacttggaagggcgcctgacacatagtaaactctcagtaaatactagctgcttttagtggctattcttaacacaccctcttcagtgctctggtttcactatgttttatgggtccctgagatcgaaagtgtccacaccgactcatggtcagctgtaacctgtgcctcgtgtggggaccaggctgccatgtgtagtctggacagtgtaggaggtggcagagctcaggcctgttctgccctccagcccagagagccacgtcgttagatgtcatgggagactgtggtgccccgggaatctcacgaatttgcccacggtactcagtgtctgtccaatgctatgggagtccaggactctaggagccagttaaggtgctgggtggccacaggtccctggccaaggtccaggcctctcccctgccacctgatcctcgagaggccatcacgagggttgtacttcaagaaccactatccttgagctacctaggagctgcagaatgtgcactctgcagggcttagggcctgcagacaagatagatgcagggtgtctagttaaattcgaacttcagataaacaacaaataattttttcaaataattgtgttctattcggtccctatttgggacatatttgtactaaaaagtattcatttatctgaaattcagattcgactgggcatctggtgcttttgtttgctaaatccaagagcaaatttgttctagctacttctcaaccccaccttcagagaggaagccttgatggtactgtaacatcatgctgtaagaaggggatcccttgaattgtaaatggcactctgataagatgaggtatggggattgtattggtttcctgttgctgctgtcataaattaccacaaacttagtggcttcaaacaacacagatgcattatcttacagttctggaggtcacaagtctgaaagttagggcatcagcaggactgcattccttactgcggagttctagagaaaaatccattttcctgcctccttcagcctccagagacacgccacattctttggctagtggtctgcttccatctccaaggccagtgggggcttatcaagtctttctcacatcacatgactctgtttcttctgcctccctcttctacatttaagggacccttgtgattacacaggggcccacctagaaaagccaaaataatctccttattttaaaatcagctaatcagtggctttaatcccatctgcgatcttaattcctgtcgccatgtaacacaaggtattcccaggttctgtgggttaggacgtgggtgtctttcctaccacagggcagtttctagtgttgcctcttctccctgcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtggtaagggaggggtttggctgctcgccaattgcaaggtgattcctggggtagcagagcctcacgaattgaccttggggagggcgtgagcctggtgttctggacaatccttgcaaaagctccaggctcccagggctcaaaaaatcacaactgatagtatttctagaacagtggcccagggacccagaagtcactatgaggttcaccattaggtatgtggctgtggcatgtttgtgtccactctaaatgtggggataatcccctttacctcctctaacagagtggtaaaggaaggaggaggcctggtttgactccctgacctgctatttcctagccaggtgatcatggtaagatattgaaccttttctggtcccagtactcatctataaaacaaatataatactttacagagtggtaggaattatacaagaaaagtatacgcaaaacatttcataaattttaataaatgatggccccatgcttcttcctctggaaatggtctcaacctcaatggttggtgtttctagagagaaaaaacgacagagaaagtttcatagtctcaaaaatttggaaagccctgatctagctcaaccctttgttctagaactgcatcccagacagactgcttgggacctgaaaatatctcctcctttgctagaaggataagatgagaaggaattagataaaggaggtgtagagcagaggttttcacactgcaaagtgcataaaaaccatcagagggccgggcgcagtggctcacgcctgtaatcccagcactttgggaggccgaggcgggcggatcatgaggtcaggagatagagaccatcctggctaacacggtgaaaccccgtctctactaaaaaacacacacacacaaaaattagccaggtgtggtggcgggcgcctgtaatcccagctactgaggaggctgaggccggagaatggcgtgaacccgggaggcggagcttgcagtgagccgagattgcgccactgcactccagcctgggtgacagagcaagactccgtctcaataaaaacaaacaaacaaacaaaccaaaaaaacccatcagagaagttggtaaaagatgcaagtgctaaatccccacccccaatcactgtgattcagaagaaccaggccaggcccagaatctatcctgttaccttaggcgattctgatgaagaccattgtaggccacactttcagaaacactcaaaattagaatccttcagagaaggtggcatatataatatttctagcatggaattatgttttttttcttttgcctacattttaatttctagaactgtgttgtagggaatgtcagtcactaagaacttgattgaggaactgtgttttgtctgtttcatgactgctctctcaagtcccaggaaactcactttcagcttgtcttaaaaagcaagctgaaggcttttaaaaatgaagcaacatgaaataagacaccgcagtttctggcacggtccacgcttaatccccttcaatgtgtgactttccgtggaaagttactctacgattttcccagctcgtcagggtggggccccagagtgagtatgaagggtcagagcctagggatgccaccatcagtgagagcccaggaccccagaaaaggtctcttggctcaccacactgtaggaaaaataaaaagcaatgtagtccaaatgtctctatccaaagtttcaaaaagaacttgattttagacacgctccttgacttgttttcagaatcagacagaagagtgaggcaacaaaggtcccttattccaggcagctgaataccagcacagccaggagtccagtgctggtgtttgcagagccaccagaggctccctctcaggtgtccagggcccgcatgctttgtagaatgggcagaatgagcaatgtctgtgcacctgggctttgcaggcagggcctgggtacccaggttcgtgcaatcctctcgtcaccatgaagggagcagcatcattcttcccttcttgaagcaccttggccaccagtataggtaaatttacctcccaggacatgaccattgattctgggatgtcaatgccagagatagtagggtaaatcggcacctgggtaaaactttccattggagactagaaccaaaactcaggacactggcttccaaatgtttctttatcagacaagaaagaccaagtctttccttacgtcttcacatgctgccttggcaaatgctagcattcacaaaccctgggctaccttgacctgtcacccttgcagacctcagacgggtcctgggggcttgctttctcggtttctgtatgcaggcactcaaacctgcatcaggcacctgtgaagggccgggcactgtgctgaggccaaggctccaaatgtgaaccttccaccctcactgaactcacagccagaccagagacaagcaaacaggacatttcacagcagtgcagcctagaaagggccaacaccagcagcatttgtccccccgagcggtagcttttagaagcttccccagtgattcaatgtgtcctacaaatgcctggcccccactcccagagattctgagtcagctggcctagggtgcagccttgacttcactgtgttaaaaagcttcccagataagtccaatgtccggccaagattgagaatcactgacctagagtttaatttaccacctcagtctctatagaccacgcataataatagtaccccacacacctctgagggtccaaagaactttcatttgatcacccatgagaccaccgtggtgtggagatgctttctctctcctgttctcttaacaaagctggtgagcgacagagcctgcagtggaccgggagatggcccagaggagaaagctctgccgtagtcggcctcagttaaccacggagcaccacccctacctgctctcctctcactcctgcttccgtctcggtggagaaagatccaaccgaagcaggacacatctagtcttctggtgcctttaaaatgtacttttccatttgacaaatggattacactaaaaacaaaaatttacaaaaaaaaaaaaaaaacctgaaagaaattgcaggcattaaaatgggactttgcctttattgctcctgggcccatcctatttgggtttttagaaaaacaagcctgaggcaggcccagaaaggctcagggcagaccctccgatcctctgaaaggagcatcaggcaggcaggggttgctccggggccagggaaggggccccgctgggacgcggctgttattgcagctggttggcgcgcagccatgcttagctgcagtgcgggaatgctgggccttctgttctgggctgtttctcatacgcacgtaggccagtgtataaataaggttttattaaatgccaaatgagttctcattaacaaagaaagagggaaaatctcagtaaaccaccgtgacggcatctacccactttgagtcaggagctgggggtgtgagtgcaacctccgagacaagggaacctgtggagcccagagaatcggaggggggcgctggggttagcaccgactgagaccagctgtgttttctctcggttccttggagatcagaagtgagtgttgtcatcttcaaacaatccaaaggcagtacccatggccttactacatccctcccacaccatcccacccatccccgcgcgtacactcacacgctcatttgcacactatcgcacacgctcacttgcgtgcgcacacacagattggtgacctaggtggactgggagagaaataagagccaaatgactggattttctccaaggaaatttattaatagcccctcttggtttcacctgaaggagcttgtcttcacctgcggcctttgcaggcttaacgcccccagcttgaaacccagaagctcagacttgggcccaaggtattattagtgccaacactacctgaaatgtttcgcacctcataaaaatggtgtgtcagtttcgggtgagaggttgggacgcttcccatctgatttggcccaaggcatgcatgcccctccttctccttcccctcctcctccccctcttccccctaccatccttcctgttttctctccaactctggtgcacagctttgaaatcttgctgagaagcaaatctgtcccttctgctttgaatgtttatttgtggaagttcggcaggggaaccgaggcgggtgccaagacctgccatgctgctgggaagtctgagtctccctcccttccccctcctaaatgcttgttgatagagaaaagtcagcctcctcggcatttgggctcacggttttcctttgaaaatgcttccagtgtggcatgattcagctttcttttctgtcccccaaccactgctctgttgtcatttttacttttctgattgcattttatccgtgtctctttgactacggggtggctggacgttgagttccaggaagaaaagggcccaatcttggggttctgactacatgcgcccatcaatgtcctgtttcattcttggctctggctccctgaattcctgagtcactggggagaagcgtgggtggaccgccccctacccagtgagagttgccacagttgctgctctcctgggtcattggttgcagattgttaaacttcacctatgcatttcaactttcgggtggatattgctacgtcaagtgtctgggaaagcccccacagctacaggattttacagtgaggtcccactaatgacttgatgtcatgacttcctcattctttccaatttctcccacttctccataagggttttgggaaggggagaagagaaaggagtgattcctgagtgccagtaccagggaacagcagggctgttgggaggaaacaaaactaaatcaggaaggtttttgttgttgtttttggggggttttatgaaaatattcaagccacagcaaatatatttgatttatagcattagtattttttctgcctgcatctacaaaaatctttacctattaccatcaaaatatcctctgggtgaatggatttcaacaaagaagaaataaaaatgaaatagaagagaggccccttcgtgcacattgagcctactggctggattgtcacttgcctgccttgatgtcttttcagctccaggcaggcagtaggccagggcttattttcatgacagatcagatgttcttttatggatttacaaagaaagaaatactgagaagtcaaaactgaagtcacttaagacaagagcaggcccctgggaaggctgccattgaggataatgagtcctggggtcctggcctttgttcagtaaatacgcactaggcgcctacaatgtgtgcaccaatgtgtgaggcgtcaggttctctccagggtcagttggttttaagaaaggttttggcttctgatatgttttatctctacagaacagtagctcttaacctttcttatgggttaggattaccttcgagaatctgactacagctctagacctgttccctaaagaaaactaagttcacagggacacacaggatggggctcatggagcagctgaagccagaccccaggttaatagcctttacattaaaatgtttttctacctaccactaatatgcattctttagtaagcggtctcaatatacaccgattcttccttaactctgtttatgaagtattcagcatcctccctgcccccttcagcatcctccctgcccctgagcacaggatccaatggcgtgaggaccacaggcctgggcagctgctggggcatacaggcatctcttagtggctgagagactgggccctggctctatgttggctcctaacttgctgccatttaaaggaaatcttagcctcccatccgtaaaatcgagaaaataagacttgtcctacacagctcatgaaatagtaatgaaattcacattagagaagagatggaaaaacactttgaacaaaaagcattttgctcttataaaagcacagcctcttttgagaggccctttgctccccatttctccttcttcagacccccccagactaggagaaggtctgtctcatggagtgaccttttggctgcctctagattccaagctcagttttgctttcattaaccacagatactgggacggacagaaaaagacctagtttctgttgagccaaagagtctcataacttgtctgttcacatacccaagagcccaccctctagttgagacactcagttccctctcattctgggagactgcatgtctctgtgacctcctggtagagaccgtttgacatgtcccccaaccccccagtgattgagtctgaattctccactgatgacgcatttcctagcactcagggtgtcccctcctggttgccccctcaccactgaagcccgcttcctcccttttcatttgatgcttaacaactgtcagtttgcaagaaacatgcttcaaatccacattctcccagttgcctagcaacaacttccctcccggataaatgtgggtttcctgtagctcagcccaggactgaacacagcagcacacacttctgtccactgcttcaactgcttttcacctctggtctgcatgccttcaagactgcagctcatccctcccttcagaaccttccatagcctgcagaggccatgtctgccccaaaaagacacattgaacctgaggctacttatttacccttgtgttaggtatatcctcaacttagaaattaatactgtttccagattgtcttctttgaatcacagaaagtaaaacaacaaaacattcaatgcttaagacatttcatgtgcggttgggtgacatctgtttgatgaacacatttgatccaaagcatcagaaatactatgccaacaagactttttaggaggtgataaacatgtctgttctaccttaagaaaaaaatattacacagtcccaagggagagacatggttttgatcccagacaacccaagcagagacctcttagggccggaatcatcttggctgctgcctaggaccttatatcaatttcttaagcacaggatcaaggcctaaaggccccttagactgacctcagttagtagaggcagatcccttcacagccttatcttccttagaggtctagtctgaccttgaacttcggctggcagtgctgtcagttgtgatgtgtgacatggaagagttatttgttacttggaaaattaagagaacttatttggcataggaaattgtgtgtgtgtgtgtgtgtgtgtgtgtgtgtgtgtgtgtgtgtgtgtgagatgatgtttgccattttgatctgtgacttttttttccagaaatagtttctcagttccattccaactaaacttacagtctcttccggttctttgacagaaacaattcatgtgaatttgaacagataatagggaagggggaaccaaaagaagaggagagccctgggaaagttattttataatttatggcaacctcagtcaggcaactgtgaacaggtacatatggagggctccctcgggactaggcagtattcagagatgtaaggtgtgaggaccggaccctcatcatttaccattcccactaaaaagagctgggaaggaaattgtagctgtagcaccaggcacgtaactggagcttagtaactatttggtgaaggaatattattaaattattaacaagatggaaaaaagggtattaaccacacaaaaatacatctcaagctattgtttctctgttccctttcccccaaattcctagtcttgctcttatctggctgtctctctagtcactctttcttgctgactctcttcacgttcctttctccacctggaattcctgggccctccccttttactgacagacactgtcctcactctcacagtcatcagtttgtctctttacaaacctcagctcaagtgtcacttccccgtccccaggtgaaactgactgctccctccctgtaagtcaccatgatgactgctatatatagccctcatggaacctaaaacctcaacagacacagtctctttcctactctgttatagtttatttactcattaattaccacaacacgtattattgagcacctactgtgtaccatgcccagaagataaaagacaaacaaaataaaacctattcctatgcttaatgagtttacagtctagtggagagatagatacattaaaaaataacagcaaaccaaaataaaagtggtaaataaatgcactgagaaagacaggaatagctaggaggggcacctaatccctagggaaggaaagctggaagagcatggtgatgggggaagaaggctttctggagaaggtgaggtagtttgaaatgagttgactctggccagtaggggtagagtgagaatggggtgagacagggtgggttggtcattttgatccattagtcctcaaagtgataggactagtggctaaggactgcaggctttacagaagcctacaaaactatttgagatttgaagtttttttttttttttaattggctccaaaagaaaatgaaaaaactttagaattataatgaatgaatattaaatgaatatttaaggaaggtaattttattcaacttcattgttaaatttagttaaaacaagcccttgagtttcattcaacactgttttatcataccgttgatgagagaaaacaaaactgattcctggccagggccactgtcagcgtggggtttgcacatctttcccatgtctgcttgggttagctccaggtactcctgtttcccccacatccccaagatgtgcccattagtggaaacggtgtgtctgcatgattccaacgtgagtgagtgtgggtgtgggagtgagtgcccctgccatgggagggcatcctgtccaggttagattcctaccttgtgccctgagctgctgggatggaatccagccacccatgactctgaactgaaataattgggtgaataattatcttactttttaattaatctttgaaaatgtatgtatagttcacatgtatttcaatatttaatattagaagtattttagtctttattttgaagtttggtgatttattgtaaccagaaacaagctatagaaacttaattttgggccaagtgcagtggctcacacctataatcccagcattttgggaggccgaggcagacgcatcacttgaggtccggagttcaagatcagcctggccaacatggtaaaaccctgtctctactaaaaaatacaaaaattagccagatgtggtgggcacctgtagtcccagctacttgggtggctgaagcaggagaatcacttgaacccgggaggcggagcagtgagcagagatcgtgccactgcactcccacctaggcgacagtgtgacactccatctcaaaaaaaaaaaaaaatagaaaagaaagaaacttaattctggtttatatcaattagcctgtggtaaaattggtttcattatagccatttcacttagttgaagtttccaataacctgtggatgaattaagtgaggatttactatattcataaaatcttaaattccaaagcctgtttgcagttcaggtttttccactttacaaacacttctaagtattcacaatgattgcttaaaattcataccagataaatcattaaataagttgttcaaagtcaaataatttcataagtaaaaattaggagcttttagaaaactatacctacatagacctagacctatagatagacagagatctgaatagatatggacacagatgctttccaaagtgttcatgtgatgtgtggtggagtttcaagaccagagtgtgcctggggcctgcagaagtaaaggagaggggatggagagaagattgtccacatggccatgggcaatctcccacccacactcaagtgaggaagacaggaaacaaattcagaaagaagagaaaataatcaaaactgatgggagcttgtgactgatttacttatgcgcagcctccctggagacatgagtgtggctgttccttaggttgtgcctctgggctcctaccccctcttagatgccttcctattatctaggacctggttgctttttgtctgcatagcttctttggattccagtctttgatgccagcttcctcctaaagtagcctttcagatgtcccttggttaccctctgctatctaagggctcatcctaccccacactcattcccagcaccaatttctggatctccaggctggagatttagacaatgggatgggaagaacccatgatgggtcccagacagaaagtggtgccagccacagaaagggcacacaggcacagaagttggtttggggtaagacgatgtggtcagttcagaacacgctggatctaggcagatgcccagcagacagttggatatgtaagtctgaagctctggggagaggtctaggttggaggtacagatttagaagtcatcaacaaaaaggtagcagattaaatgataaaggaaatgagactatccggggagtgtgcagagtgagaggagcaagggaggcccttgggaacctcagcacttcaggggaaggtagaggtacagttgctggtgggaaaggcagagaagtagcaaagcaaaccaggcaaaagcagtgtcacagacgaccagggaggaaaaggacatgatcaaaatgttgagaaaagcagagaggtttgaaaatacaagaagcaaaaatgtccactagacttaaaaaccaggagaaaactggggggttcttgataaagcatcttagtaggatggtgagggtagaagccagggaagtgttggtgaggaagtgaagtcactgattacggactatgcttaaaagaatgtgggaatgaagggtggaagagagaaattagactgtagctagggagacataagcgatcagaggtagattctttctctcctgtgggagaatcttgcacgtatacacagcatgacgacagtgatggaagggctggcgaagcctcagggagactcttggaggtaaaccccatgaagggaggactttgtttcattcactgccgtgtccccagcacctggcacaatagcagacactcaatacatatttgtcaaatgtgggattttatcatttagaaactgcacctggctgtgagtaacaaaagtcagagaaaccgtgggtttcatttttctccccaggcagagtctggagctgggtcctccaagaggggtttggagcaccacaggtttcctcaagacccccaggctgccctgtgtttccctccttcatccccagcatatgcctgtcatctggtgacctccaaacacctgtgctgcctcctccagcacatccatgttgcaggcagggaccaggcaaagggcagaggggcctacttcaaaagaccatttccagaaaccccatcctatgacttctcctggtgtcttggttaccattgtgccataggctcaccctgtatgcatgggaggctgggccaggcattatgacttttagcaatattgcatagataagcatcaatctttgtcactgtgacgaagcctagtcactcagtgctaggcaaggttaatggaatgggttggtgtgtgcattattcttgaggtctttcttatgcttcatgttatacatttattaggacgtttaggcaacagggggataaaaatgaagaggagatgcatgctatgatctgaatgtttgcatcctccccaaaattcatatgttgaaatcttcatccccaagatgatggcattaggaggtggggcctttcggaggcaattaggtcatgactgggattagtgcccttgtaaaaccccagaaagccagcttgccgcttccaccatatgaagacacagagagaagatgccatctacgaatcaggaaatgagcccgcaccatgcaataaacctgctggagccttgatcttagacttcccagctgccagatctgtgggaaatagatttctgttgtttacccagcttatggtattttgttgtagcagccagagtgaactaagacagtgctgatctcgtattcttggagggaacccttagtctttagggaaagcaaagccaccatttggggcagggtgttctccaagtgctgccacatatgctgatgtggttaaactgcaaactatggtaaaaatgtggaggtctgtggaattgtcaatcaggaaaaagatataaaaagaagttaaagtcttcgtgcttctggaaggatatgtgccaaattgttaacattgattatccttgggtagagatgtggggaagtttgcagagacagttttgccttgtactttatataagtaaacagctactacttcgttgtcttaaaaaaaaaaaacagcctatgtgctcttcatgtgactcagaactacctaggcaatacgattaattgaattagtaaaattgagtgattatgaattttcaggaagtcattaatttaccacttctttattacatccacttctaacaggacttcaatataggggaatttgacttcaagataaaaagaccaaatttatttacccttttaaaaaaagacaacttaaaagcagacttgtcttacagaaccttccttagttggacatcgatgagtgtacagaaaatgcaatggataaaaagcttggtgatacaaagataaaaagtggggtcctgtccttaatgaacataccatttcatggagtatcaggtgtataaacaattataatcaatctgcttgttattctgataagatcatttactcacacatcaaatactgagtgcccaccacatgcccagcatacctagaagtcatccagtatgatttctgtctacatggagcatagagtcttacaggggagatagatgacaagtaaacaccagaataattaccaatggtgaagagcacaaggaaggaaacagaactcctaaagagagcgtggctgggcaggggtgagcaagaggcatagaaaaaggggcatctaaatctacttgggaggaagctgtttctcacataggtcatcatgttaggaatgagacttgagggatgagtagaagtttgccaggcaaagaaggaatgggggggaatagagagcagagctaggggcaggagacagctgacgtgtgagcagacataaaaagaagtccactgtggcagcagagaagcaggagagaaggcaagtgagggagccaggcaccagctcacagaggtcatgtgtgtcaaaacgtagtaatggccttctcttctggagacagtagggagccatggaagatgtttgagcagggaaagcgacatgactggattggcctgttgggtaactcagaccacaatgcattggaagggagggggctagaggcaaggggactggcaagaaggccagtcctttttctatgcctattttgatgaaatattctagaagggaagtgaacaaaggtagtcctagagaggaagaacaaaacagataggatacttccttagtatttgctcattcgacaatttatttttgcatatacactaaaaccttttttattattaaaacgttttattgtaggaaaaaagtatgaaagtagagtgaataataaaatgagctcccatggatctatcacccagcttcaactattatcaatatttggctgttcttgttttaactgttctccacctttttttcctgaagtttttttgaagcaaatcacagacaacatatcatttcaccatatgtacttccctctgtatctctaacatgtaagaacttgttttaacaaaatcaccatgctatgatcatacccaacaaaatttatcataatgtcttaataatacctaatacccatttcatgtccactttcccccaattgctacagctggtttgttcagatcagaatcaaaatccacctgtggccattttactgctatgtctctcaggtctcttttcatctctaataatctcaggggagacaggagggaggacgggcaggacttggggctaacttgcttatcgacacacagttttgcctacttgcttcctcccttcacacccactcttcttctcagccccacccttgtatggaaaaaacagaaattaaagtgctttgcccagcacccactgaagctatttcgaaggagtttgaagagtactcccggcaagacaaatgcctcggtccagtgctcaggtcaaagaggggagacgcttctcagtgatgtggtgtcaatagcagcttagttgttctttcctctggaaaattctacccatctgctttgtaactcccatacctaacaaggccttttatttcacaattagaaaataagcctgaaatatgaatgctgcctgagtgtacctacatttattctagagtttcagggtcaaaaagaatacaaggacctctgcatctacagccaagaggagaggggcaaagacacacagctacaaatgagaacctggctggtcaaagcctaactccacctgtttgtcagcactgatgcaagttaggtcagcccaatgatcatttaggagaactgtgctggcaaataaaaagcagaggcttttggtccccagatacttggatgagaattacaagtccagctggttaaaaggcacatgcccagtgctcacttcacacctactcaggaagcacacttgagttggaaaaccactgtctttacacttagaactcagtcctacatgactcctctaggatcagtgattccatcagttttgaaacatgaagcatgaagtcaaacaggacatgaccttggtttccagaaaaccagatgttcacatcagtctctggagcttggaggcagcacacctggggacttccacatcccctgccgaggtggcaaaagcaggagcagtggtgagttcacatgggctggggtttcctgaacactgctggcaattggagaatctgcaagggaacttctccgactcctaccagcagctgctttaaaataaaggtgatgtagctggtcaaatcctccatgagagagcagtgttgaatggaggaagagacacaacctgtctgaaaatggcacaaaggaagaaagatgtaaacaatgacgagaagactgcagtgtctacaaagctccgaggtgaacagatgggcaccccaggcccgcagcacttccttcagtctctgccagctgcactctgttttccttcctccaggaatcttgtttggtgtcactaaaacagcaattagaatcactttgaaatagtgatagtatttaatataactatgaaactatctgtgattgacaagtgcagcaaggagtcttggaatgagagcctttattttttcaattaaataaaagagttttttgtttctaaaagtaatcttgcagaaaagatcctgcgatcagaaagaaggagggggggagttttcaaacatataggagatcagactgtgcctatgtgtgtatatacctacaaacatatatatatttaaaaaattgttttactgtcaattacagcttcccacactcctagacagccgttctcaaggtatcaatctgagatcttggggaggaatattatctgatatgtcaccaagaattcaagaggtgagtagcctgatggtagtaattataatttcattatgtctttccaccatttaccccacttatgtcaaataatttaattgtatttcaaacctgttcaaggaaaagtacatttgatctttccatctagcaatttcaaagcacctgttcacatcccaaattatctgtgctcttaagtaagaggcagaaagaaaggaaccacccttctgatttcacatcaaaaaagaaatgccactggcaataagcaacttgcctggtgtggcataaatcatcagaagacttacagttgaatctaagtcttttcagtactgaggtggttcattattctgttacagtcttaaaattcacataaatatatactgccaataataatagcatacacctttatagcttacaggcactcttcttctaagtgttttacctatgttggcttatttcatcataaagaaaacaatggacttttgtgttgttttgtaaaaagatgcgcacattttaattaacatctgattgcacaagtctcctcccatatagaaatggattcttccacgcaatagataagaggtgctggggatatgatgatgaacacacagatttggtcatgaccctgtgggaaagagagatgggaaaaaaacaattctcttcaagtgtgatgagtgttacgaaagggagggaaaagttgaaacaggtttttttccaaacttttctccctccattattcgcagctgacttgggctccaccaacctggaaaactgcatggttggaatctgtctttataaaacgcatctcaacctgggccgagtatgcacactgatgtgggaaagttagagaagagcccattgtactaatgctcacctgctacagtgggagtctctgttaaacagtcttttcttcatagcattaaaaaaatttatatcactacaataaggttgaaattgatagagaatgtacaaacaatccccaaagtatatcaacactcttagttctgagtagaagttccagaaggcttcttgactgtctagatagcaagtctaatcatttgtgaactaagttaaagcagaaggcccagtttatatgaattggtattacaccatttgacctgagaacagccccttcatctctgagtgctttgactaaatgagcaacataataatagtaataaccccttacaagatgtcataagactcactgttgttgaagcaatttgagattttgactttattgaagcatagatggtgattataggcatgactcactgtgtggattctccctgggctcatcagtttcagagggcaagtgttggcatgtggacaaagagagggatgacacgtaaacatggcttattgcaatggggaaatattttcagtctcactgattgaatcctaatggttttataaattccccagtaccactgaaagcaaagcaagtaatcaggtgtgttttaggaataaaagcagcattattttaatttcgtattttcccctaaagcaaagccaaatggcattatgggagccaagctactggcagctccaccagccttctcctgagttctcggcattacagatctaccctcaaaggatgaggccagcaagcaccacagggtgcccacatggagaagagaaggccaccaacctcctcttagctggcacagaattgaaaaagtgtttttccaggaatggatacttcatctgttctgtatttgctagaattttaaaacgcacacacagacacacacaggcgtgcacacacacacgcacacacacacgagaaaaccacaaaccacacatttcaaggaaatggaagaattcattggtaaaattaagctaataagattattttccaaatataagaaactaaattttagactatttagccaaagaaatttgctctgatcttgcttttctacaacagaatcattccccaatcattttatttccctctttttctccccagtatccccatcttggtgggacaacagaacccaagaactggcttaacagtaaaatattttctgcatttgcccaaggacacattcccaacgaattcaaataaaggagactagaagaagagaggctatactacagtgctctaggggtcactctgtgatttgttgttgttgttgttgttgttttgagacggagtattgctcagtcgcccaggctggagtgcagtggcacgatgtctactcactgtaagctctgccccccaggttcacgccattctcctgcctcagcctcccgaatagctgggagtacaggggcccgccaccatgtccggctaatttttttgtatttttaatagagacggggtttcaccatgttcgccaggatggtctcgatctcctgacctcgtgatccgcccgcctcggcctcccaaagtgctaggattacaggcatgagccactgcgcccggccactctgtgattttctttaaggctcatcctagtattctcctagtccctaagtagatggcagtaggttttgttttttgtttttcgcagctggattaaggattgctgagaatatatggatgttttcttttaaatgtggaagtcaaaccaaacgttggagcattggcctcacagcagattatgactctagctgccttaaaataacctgaagactttgccttgccctagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaagtaagttttctgagtcctgcttataaattggcctctcatgttggttaagttgatggtttaacacttctaggtgaaaccaaacctggggttgcatctgtcttgtcttgctgagtggccttaggtaaagagacttctcccagaaagtccacttccccttgcagaaagggggcattgcttataagcaattctggacatgaaccacagaaagaactgaggcccacttggaaagggaacagaggggccatttcccactgatgtaattgaactagggctaagttcaagaggaagagaatgatccgcaaggaagcaacccagagttccaggtgaagctcaggtcagaagggccctggcaagtaaacacggctgtgggatgcttttacaaacacaatatcgtgaaaatctatgtgtgtagtactgaattacattccaaatggcaaattcctggcaaatcatcttccccacctttcactatttttttttttttggtcttctatggggtaaaggaggatggggtggggaagaaatgtaactggctgcccctctagttaaaaactgaaaagaggcagcaagggacatgccaaaagtagttggactctaagatagctacacacaacaaagcagctaagcagctaattgaagggaaattactgaggctcaagctgagattccaagcgggggccttgtttggcctctcagtccctttcatctgagaaaggcctcagttcctagcagtaatcagaggcaggcttctcagcctccttctcctaaagcagaataaaccacagggcaagtcgcatcctttgtttctctgatgaggccattactgagagtcactgtggcattttgctactaatgatgagcttgttattggtggggtacagcctattaatttaggttattcatcaaatcctccagcatggagttgaatgagacatgtgatgtggatacactaatgactatattgagttacaagcaatggggagtttctgtaaaatctgtcccttgtctcctggcagcatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgtaagatcccagctgggcttgccttgtgtaccctggacctcccagaagtgtgtgtgtgtgtgtgtgtgtgtgagagagatgtgccttcctggtagcacatctcatgtttgttttttgctaagtggactcttgcgtttcctcccccatccacagtcatcactggaatgctttgcttcagtgcccctgcctgggccctcccctctctactgcagcctacaatgaggttttctttcccattgcttgaattatatccctaatggaagggttcacaattctctgaatcctggctactcagataaagacagggaggaagggaggaagggtattttctcccagggggtccaaatctagctttaacgagggaggttctgagaaaataatatcatcaatattacatggacttctgagatactaagaaattagattctgtcagcccaggaagttgggagatggtgaattgttctgggaaatagcaatagactgagaaaataaaaacacttccttgaaaagcctttccctaacactaagtgataggggcagaaaagacacaaccaaaagttctctctcacttttctctctgttcgtgtctctgtcttgatctctgtctggttttaggccaactcaacttttgaagaactggaacacgttaggaagttggtcaaagcctgggaagaagtagggccccagatctggtacttctttgacaacagcacacagatgaacatgatcagagtaaggggggttggaggatggggaggggaggggaggaggaagcggtgggggcaagaaagttccacttgtttccttttcccaggaaagagttaatcgctattggagttagatcaaaatacaacaagcaggccccaaaggccttcattccaagcagtcaccaagtggggtcactgactttggatgagaaatatgtttcttgaattctgggagaagtctaaaagctgccacaagaccagtggcttcctggagtttcctacttttatgaattcactcaagggcctcaaattcaaagaggcatctccccaaggggccagctctgtaactccaaagatggtggaatgtgtttgtctggtctcattttcagctttgcaaaatgaagacaagagttctatatatcagggacactcaaaagaaaacaaaaatatccataagcaaaagaaagctttttatacaccatattcaatgacccccatctggcccctcctttgcccctacacatcttccctctattctagagacccatggacttggggaaatgggatatagataggtatgtttcatagtggaacaagctcaccagctcttcagggagccttagcatctctatcctcaatcactaaaaattagaaatggctgaagaacaagaccaaagatcctatggaatttctaagcagagcagtgactgtatttcttcttcccaaggataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggaggtaaggggctgcaagccccacagtgggccccttgaagatagccccatgagtggggccagagctcccttagcaagtcaagtggtcttgaatttaagctttcattttccccactgaagaaacaagaatccctacatcccctgtacagttctcattctctaacagcttatccatacttaaaacttatctatgctgaaaacggtttcctcttcacatctcctacttctcatgctgggcacctcctcctgtagccccctttaagcatctgtgtctgtcctcaaccctcttctgtctgacattgcttgagtggccatctatggccagtgtcccctcaaccccacagtccattgcttgctggacactcctgccctcaagttctacaagcacatcagcctcaacatgtcccctccaaaaactgtatgttctccttgcccatagaacatatccttctcctatatttcctatcctaattaacgtcctcagcatttgcccgaattctcaagtgagggatttcagggtcatccctaattttccttcttcaccctccacacagtagctgtcacttactgagtgttactttatgccaagtactgtgccaactgcttttacacacatatgcttcatttaattctcacagctccatgaggcttgcaccattatcattgccaatttgcagatgagaagccagggcttaaagaggttaaataagatcccacgcatgaccattaagaggagcgaacaggatccagctctgggggtgcctgagttcagagcctgcctttctgatttctcttaccaagctttgtctcctctccctcctaaatatctctcaactctgcctcttgcattccaggctctctgaggactagaggccttgtcatctctgcgccagcccattccaagggcttccttcctggaatccagggtccagcctctgttggcccaggcatttctctacactggcaccagagttacattccgcacacctgcttacgttgctctctcacttaaaatcttaatgactcgacccccaaataacacaggtcccttccaaatctgtcctaccccaccttcccagcccttgctcaactctgctacctggccctttcacgcctacaggcattcccattccatgacctcttgggattctaccctttgcaaatgctgttttcattgcccatttattagagcgcttttggtcacaagctttttgcttaaccaaaaagaaagcatttattggtggacataaataatgaagttcaggaggatccaagagttggaagccaccatgagacccctgtgtccttccacctcacttttctactcgcctctgctcagcttcatctctggccaggccctctcctctgctgatgccctagctgcttacagcccttagcagtcatctatacaccaaaaatccctttcccatagcagaagcaatgctcctagagagtttccctgttggtctggctcctgtacccacccctgtgtactctgattgggaggcctgggtcagctgcccaccatggggccatttctatgagcaggattactgtgaagtggaggaagatgtttccccaaaagaagaaacacaaggtagaaaagtgtatgtccaccaatgcctgaaatgactgtccctttcctcatctgctgagcttctactcattcattctttgagactcagcactcagctcttaaatgtcacttctgctttgatggaggtttagtcattcactcctctgtgcttcctggccctctcttcacacctctctcagacccctctcccagatagattagagttggctgttgacatgtccatctctggctgggcagctaaactggagttatttagaatcagggagcacatgtcagtcattttcaaattctcaacctcatactcccagtaaatgactccatctaagggtggaccactcttgcccatgggccaggtctgggtctgtgtcatctagaactgttggaaggtaggggcttctgtgagcagtaggagagggaataaactcgagggccctcgggagcatgccctcttgtctcagacttgtgagtcctgaggataacaaactagtgaagaaaagcctcgttctatctgtcacctggtgctcttgaggactttctgttgccctggtgccaccacaattttccagagtgtgtgaccctcgctctccaaactctggaagtggcagccgaggctccccagtggcctttcagaaggtgccagtcatgacagcagcaccaaactgcaggcaactactaagcgatcaccaacttgtctgaagataagaatgaccttgaatgcattttataaaacaggattttttttttaatttttagattttctttctttattttaccttaagttctgggatacaagtgcagaatgtgtaggtttgttacataggtatatgtgtgccatggtggtttgctgcacttgtcaacccatcatctaggttttaagccccacatgcattagctatttgtcctaatgctctccctcgcctcgcccctaccccaccccaacaggctccggtgtgtgatgttcccctccctgtgtccatgtgttctcattgttcagcttccacttacaagtgagaacatgtggtgtttagttttctgttcctgtgttagtttgctgaggatgatggcttccagcttcttccatgtccctgcaaaggacatgatctcattcctttttatggctgcatagtattctatggtgtatatgtaccatattttccttatccagcctatcactgatgggcatttggattggttccatgtctttgcaattgtaaacatacatgtgcatgtatttttatagtagaatgatttatattcctttggttatatacccagtaatgggattgcctggtcaaattgtatttctggttctagatccttgaggaatcacactatcttccacaatggttgaactaatttacattcccaccaacagtgtaaaagccttcctatttctcaacagcctcaccagcatctattgtttcttgacattttaataatcaccattctgactggcatgagatgatagatacccatttgtcagatgggtagattacaaaaattttctctcattctgcaggttgcctgttcacgctaatgatagtttcttttgctgtgcagaagctctttagcctaattagatccatttttcaattttggcttttgttgcaattgcttttggtgttttagtcatgaagtctttgcccatgcgtatgtcctgagtggtattgcctaggctttcttctagttttcatgattttagattttacatttaagtctttaatccagcttgagttaatttttgtataaggtgtaaggaagggatccagtttaagttttctacatatggctagccagttttcccaacaccatttattaaatagggaatcctttccccattgcttgtgtgtgtcaggtttggcaaagatcaggtggttgtagatgtgtggtgctatttctgaagcctctgttctgttccattggtctatgtgtctgtttacaaaacagattcttaagcatcaacccagatcgactggctcagaatttccagggaagaggcctggttatctgcatgtttacagacctattagatttgtgggacctgcagttcccttgtacagttagttactcaattaacatctccctcctctcatggtgcctctacctgctaagcccttattcccagccaggcccaccaccatccacccactgctgttataacataagcaggacctgtgcgagggggtgtggacggaggagagaggctctgttgcttcatttgtgcagcatggagttcagtggttctcacaatgtttttgcaaagtatataaagaatactccttgtctacttgacattcgtatcgtgacataaatgtcttgttttccagaaggattattttttccaagcagcttgttcctaatgcagccccaggcaccaaacagatacttaaaatatattaattgcttaaatggttaagaattcagtctctggacccacactgcctgggttcaaattcctattatctgtgcccagtttccaagtctataaaatagggatattaatagcacttacctaataggctcgttatgagaattaaatgagctaattcatgcaaagcactgacatatagtaagcacttaataaatattagctttttaacaaaatacaagccaaaaaacactgcttaggagaggaaatgatgttagtgcctcctgtaaataggcccagcctccaagctggtgctcctctaggaatcacaacgctgcaaatcacatcctccggggccgccaggacttcacgagggcctctgagcagaggggtatgatgggagcagaagcccagcagctgtgatgatgtggtttctgatcttcctgcccttggggtgggggaggaggaaagcaaggggcaatgaacagaaaggagaagatagcggggaggaaatgtgtgaggaagaaacacatcactgtggcttgtcctggatttttctgcttctgttctcgtgttttgggaagtctggaggagacttgaaaatcattcatgtccccaccctgaggatggcttagtagcagagaggccatgaaaactctttgctgatggctctgaaagcaaggatgttgcttcactgggctgctgaaggcctgcctgggggttctgagcagagagtacaggcccctcccaggagggcggcctaaccaccatgctggcatttctgtggaccatggtctgctgtctcagaccccctccacaatagggtctgcaatctcattcaccccataaatacattctgtctttcctctgatcccctcccattagcagggggaaataaatggaagtcagacggcccagttagaaggcaggcagtggagtaggaaaatagatgatggtggtttggggagcctcacatcactcatggggagacattcattcccatgggccttccaatcacccttttctccaaatctaaggacacaggacaaatgggtcctcatacaggcaaatatcttaaactggtatgtgtattcatttatagttctaatttatatgtgtctttattcacatatattttgcttctggagaaaagctcaattagaaaaattaatacattattcttcttattgcccttcagctaaaacaagcatacacacccctcccctttggattttttgtttagcaaaaggttaggcctggcacagatgaaatactattcagagttcacagtgtattttcatttcataatatatttgattttcaggtcttgaatttcacatcaggaagctgatataggaagctgaattcagccagattttaatacgaaaatacctctgatcaaggcataaaattgtactttaaccagtaaccactgtatttctctaagctgtgaaaaaacatgcattcattaactgctttttcctctgctgtcaacacagtcaatacatgtgcataactccttattgtctacatggtgattatcttgctgatgaattctcaaaggccagagatttggactattttttctctgtaaccttgcatgttcctggccacatgccaccaccacccaaacagaatgtacgcagggaatgtatttttcaggataacctaagaaaaaataggattaagaagataaagctgctgatcatgtaatgtactttagactcagatatataaatatttgtgaattatctgtcctatttctttcttctattaattcattgactctagatgtgcattggaaggctagggagaaatcaggggatcgtgagaaagagcacagaagtctgcatcacacaaacaatattatttcaagagccatgaactagatcctaagcaactcataggcaatgacctcatttcatacctctagtctctaagaaacatataactggcctgaggaaggaaaatgtgggcaaggggtagaccggggtcatgggtggaggtccaaatagtaatcaatggagctcatagggtggactgatattgaagctgctatgagccagccacatgctgggcactgttacatgtcatctcatgcaatactcccaattacctgcctagtaagcataattgtcattttatagaattaaaaacagactcaaagaggttgacagtctaatgtaacacaacagctaaatgggggatctggaattataatccagagctgcctggctctgatgagaaagctctttctgctgtcatatgcagcccacattaatagggggctcagaaagtattctctggataaattatataatgaatccaatgaaggaagacattattttataatatgcagcataataggcactattatgattggattttcctgcttgaaagtagctagattagagtaggaaaccaaaaagatgtgaattcattcagtcattcatgcatttgcatggattgagctacctacatttgaataaatgctgttaatccctgattccttggaagctcacattggagagataagcatgtcattaaataatgccataatagtggtatctcagaggactagcagaacataattcaatctgacagagtagaaacagattgtacaaatccaattcaaaacatcataaatcctctaagcactgtcaattcttcctccaaattatctctgaaattcctccttctttcccatttatggcctccatttacagaagcgtgtactgtctctcttagctgtttgccaggccgccagtctcttgctgttcagctctcaactgcttccagcaagatctttctaaaatcccaggcttgccaagacttagcgcccacagctccacagtgactcctcattgctgttaaggtaaaggccttcccagtctagcccttcatgcttcttccatgttctatgggactgccccaggcttcccacctggtaccactgagcctttccatccttcccccactcgactgccaggtcaacacccacacccacgcttcaggactcaggtcctatgtttcgggccttcttctgtgcaccattcccttccctgtagcccttgatcatgatttgtttatacgcctccgcaccttcatggccctgaacccctcaagggccgaaactgccttacttttctttttgacttcccaacttaccttagtggagctgtagtcacatagaatagacgctcataaatgcttctctgggctgtaaaggttgaattttccagctaagcaaggaagaaagacaatttcaggcaggaggaagggcataagcaaagtgcagagatgtgaagctcaagagaaatggatgggctgggcagaggtgtggctgcagcatcaggggagaagaagtagtgcctggagtcagcaggcacggcttgcaaaagcttcacctataggtgaaaggacaccatctcttgcaccaataggctctgtgattggaggcaactttgctgttttactgccagaaaactgaggatgataacccaaactgcagttcaagtggcattcactggtgtggctgaaatgggtgtttgtggccagaatgtggtctgattggtcagtgcccagctctgttgattagcagatgttttgaatatagtagcatccatgtgcccaagttgttgggatgattcaacaagaaactttaagagctcaagtgccctgcagttgtcagccaggtgattctcttcctttggacccagttagacgcaggcattacctcgtggctttgccccagtgtgaatctttgtcctccaacttgatctttttatttgtttcattattgtatttaagttgtttattttagagacagacattttttaacagctgtgcatttcctgtccctttgttttccagtcgtcatgtgtttccttactctctgtgggtgaacgtttcagatgtctgtttgcggtgcccagcgtgcaagataaaatttattgcagtgccttcggcctctaactcaccattccaaccaattcagatagcccaaggctgttttatccagtggatttttccatgtagtgggaaataaatcttgaatgttactgtttagattagccaggaaactcattctgggatgtttgcccacatccattggcatttctcaaaaggaaccccaggtgtctaccttgacaccagcagggccacttgagccctccgctggcattcatcgcccgctttgttctcagcctgagtttaggagttacagatgtgagaggcgggattatacagccaacatctctaagcgggcagtggctcccttaccctcgaagacctcactcctagcacgtcctggatgtattcgtcaaaatatgtcctcttatgccacgtcagcacagggttgctccccactttgatcatcaagtttaaacaaaaggaaagattttctttctttctctgcctctactggacatcatttcccacctaacagataatttaatgtatctgttactgaatgtgtttgaattacagacagagaggtcacagttaaagaaggaagcctgctgctactgcagcttgtcctcccaaggaggtgtttgatttagctgtgtaaacaaatgactgcattctccagaggtcctgaacacagctgcctgcgctggagagggctcaaacctcttccgccagggtgaactctgcttcctggtgagtgccagcaaaacaaccaacaaagagctgtaggacttgtgtggacttcaaatggtggtggtcctgccacttgggctcagccacagcagttaggaaactaaaggggaggaggaaagccctttccttgctttattgtcattggctgtcatagggcattacaatggttctctttgagattctgagctccggctataacatttgcccagaatctgcctctgaggccttaagacactgtgtttttattcagcaaagatgccctttgactccttttcccactagtggtgctaggtttgagcaccttacactggccccttacaatagccagttcttgtctacctacattcttccctaacattcatgattgcatagttactcttagtgtagaagcagacagcttttacacatagactccatggccgtagcctcatagaacctactatattctaacttgcaagctaatcagaccaaatatatcaaaatcaaaaacctctgctgagagtttattcattcatctctgtctcccaaacgtacttatgtacatacgtgcactaatatacatgtccattagccaagattttgatttcagggatcaaagcaagtaccaatagggaatgaggtcacttgctgcatggcaggtggcttccccatgagaatgcaaggccacctcatgactcatacttcagagggtgacccaggaacttctgattcatgtccaaagcagcttctacaattgctctaccttgatctagggaagatgtggggaggatgacattcgggattagctttataaggccttcctgtgggcagagttgtctgactttcacctagtgatcaacaagcagctagcaagcatcagtgtgtgaggccccacgccctctcagctcccctactgcccacctgggacatgggctttggcatctgtccatagcattgttctaaccaaatgaggtgttatggatcagctcaggatgggatatgttcccagacatattatttaaagaaaatagctcccttcctcccctgataaacagctgccatggctaaaaggtaacctggctggggcttaaaagtctgttgactttcaagatattttgcaaaaacagtcataaaaatggtatttatcagatcctaactatttgtgagacggtttggtataccatagtggttaaaaacacaggctctttccagaggaggtttactttgcttagtcgtgtctcctaagtgaacttggacctcataaggttgttgtgagaatgaaatgggtgaatatgagtaaagtccttggaccagttttggccgtatagtaagccttcagcaagcatctgcttttattcctacagggaggcaattgtaagcccttcacaaacagcgtctaatgtgatccttagaacaaacctatgagatagggcatatctcaattttgtaggtagggaaacagaagccacacaattaggaaatggcaacagatctgttagactcttaaacactatgctacaccaatttgcaaggcaaggaagacaaagcacctttgaaaatgggtcagatgttttagggtaaatgaacgtttgagaatcttttaagttttttttcccccagagattatcaaggtatcattgtagggggatgcatcaggaaacatgactatgaatcagctgcctgataaaccagccaggatggagcccacgtcatcacagcagtcagcaatgccactgaaaaacatcagctgcttattcccgtatagatttccccttaagacatgaaaagggagttcaaagagaatgggccagatatctctgagagtcatattactaaaatatatttatttttactagcttttttgttttaagaggtatactgtcattagcactgtagcaaaaattcacgttttattaatttctcctagtttatcatgtgattctagggtaggatgcagagttatattcaaaatacacaaatcaactcaactcagtaaacatatatcgaggccctatcatgacaaaatgctattctagagaccacggcgaacaagccacggccccagcctcaaagaatgtactatctttggaactgtgctggccaatacagtaaccagcagccacgcagggctatttaaatttaaattaattaaaagtaaaaacacaatgcctcagatgcattagccacattttaagtgttcaatagatatttgtggctcctgcctgccatattggacagggcagatatagaacaattccatcactgcagaaagttctactgaacaatgctgctctggagcagaagatcttcttgttcagggatgttacacccccgcttgtggctagagtgtggcttatcctcagagcaaggataggggaaccatggcactctgcaggctcagcactgaagacacggatgcaggctctgcttctgacctagattgaccttgggcaaggccctttgctcctctgatcccaatttcttcaccagccaagtaagaacatcagaccacaagccctctagggctctgtccaaatgccccatgactgagtgaactggtagaacattctatgtgtgtgtcacaacatgaagagcaaagactttcatctccccaaataattttgtttttcgttttaggaattaaatttcagattcactctaattgccaatactaaaattctctatatgcagttctaaacttgacaaaccaataaaaaaagattatttgactacttatctttgtacaacattgaggtctccctaaagcaaatttaaatgcatattttaaaaatgtattctagcagttcagttcagaagccccctggcccaagcatcacactgtcaatcctttgtcctcaagcagcatggttgggtgggttaagtactgacaaacactgggtgtcaggcccatggtcagggactgtgctaacagtctacatattagatgccacctacccccaccctcaacagacccaaactatttatccaatagcaaaccttgcattatttctgtccagaagaaacaaacatttattgacaacttttggtgtgtgacctgtttaagtcctacatctcatttaaggactggtcaatgttaggctaggcaatgcctgtttgtgagagaatcactgcctaaagaaaattctccatttcccttagctctatggtgggtgactacacatactggtatttcttaaagaaataccaattccatttccttttaacataattattaatatctcattagcatggtgtcactgaagcctgggcccaaagaaataccaattccatatcattttaagatcattattaatatctcatcagcgtggtgtcacttaagcctgggccctttagaatttttcatgtacctgtgttcctctgcccatatcagctggaacactaatagttttcttcctttttatctagaagactgagaacattacatgggacctgcccccagggcatggaggctgaggtgggacagtttagttcaggaggcccaagaagtgttgggtgtgcagccccttgttcaaacacagcctctgaatcgccagaggcttccggtgcatactctgaggcgcaggtgggactcgggagtgagaggtttcggcgaatgaattgggattgcctacttcttcccagtgcagtggagcttggttctgtggtcaggtccttacgccctgtctgcctttctcgtttctttatttctcgggtagtagttgtggaatcaaatgacctggggtttgatacctactctaccacgcctctgggggagtcactcagactcgttgaacctaagttccggggctgccaagtgaggataagtagtaattgctgatccacctacttgacaagatagtagtgagggccctgagcgccaggctgtggatccagcctttcccacggttcctggtgtggcaggaagaactctaggcctgaaggtgaaattggggagggagtcccagctctgccactgtctctctgggtgacctcaggcaggtctcctcaaaaaaataagatactttataaagctcagtttcctcttcagtaaaatgaggattccaggtaactcacagatagtttgtggggatgaatctgttccttaaagcctgcagtacatcaataacccagtcttcctgcttgctttcccccctctccactaccagtgatcatagtctgatcccataggtgatatcccagctcaaaaccctacattagcttctgtggctgtttaaggcctgcccagaactcccctggtcttagcactgaaagcacgtgtccggggaagccctgcattggtcgttcatactactgagtcccgcagggcaaaccgtccggtcccaccctcctttctagtgctgctgtcacactcacctcccttcaccctacactcccttctgtgccttgcaattacctagggagttttttacaagatatggatgccctggccctgccactagagattctgatttaattgcttggggtagggcctggcataggtatcttttaaagctccgcagtggttctaaagcacagccacagatgggaaccactgatctattcttgtaggtccccagatacctcatgtgctgttccctgtgcctgagctgacctttcccccactttcctctcctcggctaattcctgcttatcctcctactcaggaggctcttcctccaggcagccttccctgatccctccaggaagacttagctgcgtccctccgctgggcttccccaatacactgggcttgctttcattagaacctgatccttccacattatggttgttggtttgctccaatcctctccctcattagctctcaactttctttcaggaagagatgtttatctttccttcttgtattcctagagtcgaccaggctctggcacattgcagattctcagtatgcattcagggaacaacttaatcaagacaagaccatctgacttcttgtgagttacatgctaagaaagaaatgtcgacaccaatagccctcacaatgataggaacaggaggttaaagaaaaggaaatagatgcaaatagcaatataagtgctttaacaaatctatacaggaggacaaccatcatattcaaattttcaaacattcttagttctgctcttttgtgggtaatggtttttttttttcctcttccaggagaagaaaagaggcatattatagaaattcctcctcccccagcattacttgtcacagaattgtaattggaagtgatttccctgactaagttattttggctgtctgttattttctctcttcctccttgctcttccctcagctggccatcctgtgtgtttggagagagccagaaaggttcaaggctaggaatgtttctctctctctttaaagctctttaatcgtcaggctttctgatcttcaaagcaggctgtagccagtgtgaccccactccctcgcctccccatgctggagagtaaaagcctggagtatttttgtcattttgaagacttgcatatttggacagccttggacatctggaaagtgtggtcctcactagctctgcagggataagagcacgtcagcacttccaagctctctggcgcccctacatctggacacgttgaaaaattaacaccagactctggagttaagcaaacattaagtttataggcctccttgcatttgaccatttcctgggacagcagcccttatcctgtgactttctgtgtgtagagttgagtctttgcagttggtcctcctcacactctctcaactttgtgactctctgcagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtgatgtttcaggaagggctcgctgcatttctccaaagtcagtgggaaattacatttggtagagagaaagggattgagactggactcataaatcaataaaattaagttaaataagaaaaaataagatattttataaagctcaacaaagagtccttgaatgaaagcaattacagagtcacattgtggctaatattcaaaactgagatttaaactgaggactaggaaatagaattggatccttttgaagcgtttaggagaaagattttaagagaatgagttccgagtcaccctgtggtcgggaggtgtgagtgagctatccaagcccgttcccatcctttgtccctctgtgtcttctcaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattcgtgagtctgaagttcgcgatcctcctccatgacacgctaatgggggtgctggagtgggctggggtgggctgggggtgccctcaaggcttccatgtctttagagagagccccagggaccagagccaaattggagagcatggagctctgactgaggaacctgcttctcccaagctccaggcaggcacagatgagtcagtgcagtggtgggaaagggaaaagagttgatgttgtagctggaaaagggaaggggaaaattaaagcaaggaaagtgaggctgggggaggggacaaattccccactatgtagtatgtttggtatgtggaagggttctggtcagaatgtttgcccaatgattgccacatcagcattcattttggactctgtatggccagtaggtctggttcctgggagccctggaataatgcagccccttccctaactaacatttccatgatgtatgctcaatgacaaggcagaggaatgtgttggatgagctcaggacctgcctccctggacactcccatcccaggcctgtatatctgttgaccaggaataagccaagcaagcagcctactgtttgactgaatatggatttggggggtggtagagaaagggccggggtggagggttgggaggctcatttgtcattatagatggggtcagacacactaccaaaacagcagcagagatctacaattgagttcacctaaaactcagtgtggacacaggaaaccctcttttaataactgtccaatgggttttccagcctcagctctacagaaaacttgagataacagtggccagtctgcagttagtttgggttcggacaataggcagagctgggaaatggagccaggggcgaaagcccaggtccactttaggatcaggacgggagtggctggtggggaagtgaggtgggtgtggggaggcaatagggagctgggtcatttggtatgggagagtcctctggtggctagtcccagaagtgcatgctttacgaacatatgcttctctccctagggccaccttgagtgaaaccctcccatgctggaattgggccctttcagtgacaacacacaacagttttcaatagataataatcccaagggctttactagcacatgaaacacagggaaaacgtgtaaagttcacaagaaagtcgttccagtgtatcaaatctatcctgtttgccaggtggatataccagggtctcctccacctgtgcatggctggtggtgggtccagtggctgttggataactgatgtattgatggatcattcgccttctgaaagtgccaaactgattagttattttgtgtgtctttttgtgtaactagggtttgaccttccagggcagactgtgctggggcggctgaccccttggggagccaagttattgctcttaccaccaccacttgcccttgtcagtcctccaccctcttgggtttcagtgtcagcatgtagctgtctactcagatcccatccacatcatcaagtctgcagttttttccttgcaaggccttacagggaagatctttgacatagaggatataattttattgacacattttacttgcagagcattcacccgggctaaccagaaagccagcactctgctataaacaaaaaataatgcttcagggctaacatggaatgtgttaaaagattccagcccattaaatgtccaggggaggttttcctgttttcctttccctccatctgggctttgttctcaacacattcattcaacaaacatttattctgcctctaccaggtacagagcactctactattctgcttctctccttttgctttagtttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatggtaagccaaatggagaaggcccagaaaatcttgaatactttggttcctttcccctttcctcctgttcatgtgcctggattagtcatgtggccaccaaggagagcgtgacatctagcttcccagcccttccttttagccaacgtgggagacactcaaagagacgaaatctcctgaaggagccactgtatcacagcatcctcccatctcccacttcctgcccaggggtccatggtccacacagacttcccagtcccattccgtgaccatctggagaagctgctattagcagagccctgcacagggtgatagtgtaattaaagtggtcttctctttccaaacacagaaaaaatcagttcagggagtgttttcctgggcttacaattttaactactggctagagttgaaatggggaaagccttttgccttttcagtagcagtaggggaggagatctggattatttacttatcatcatcatggtcacctcctacatggcttcaccaaaaaacattctgctgcctgaaaaagctccaacacctctctctcttttaaaggatggaatttggagtccatccttcctcagtgataaggagtttttatagccacaggcagcatctattggtctgtcctctgcaaacttgcaactcctctgagagctagacttggaaatgaaacattattttgcaatgcgctgctatccttcatttttagctcctccaccgtagatgatagtttgtacttgttaaatgataaggatataaatttaggtcattttttatattttattgggtggaatttggtataatttttagacttcaggctttacaggctcctgagatggactgattgagcttgttctacttcttccccatcatgataggaagtgctgtaccacactaggcagtgtgtgtagtgaccacagactggctgagtgtctcccatcccatgctggcccatatctggtacccacctgatccacaaatgttccatcagatcctgttcaaacaacacatctccagttaagccaaatcttgccctttctccttacggtaaaatgtactaaatctgaaggttttgtctttttaatgttgctccatgatccagtgatctgtggccttggttatgctctgtgctagagtcctaacaagacaaatgctaaggtagaggtcattctgctcaaacaacctgaccccacctggatgtgggcttacatttgcaaagggcaccaaagttctaagagatgaggggaggagctgagccccttgtccttatctaggtttcccttgttctttcccatccctcagtctgcttcttttcccagtaccaacatgtttgtgtcctcagaattaaaggagtaaaaatgtgtaaacatctgactagcaacagccatgagattttgcctggcttgttgataagcagcattgagatctgccctcctaagaatgggccattaggtcttcaaagcttttacgatgtgaggtaaagaatgttcaccaggagtttcatgcacaaaagggtttctctttgtgggaactagaacattgttccagtgatgacggaaacagggctttccataccaaaacagggttttcctttgaatgactctcccacctttcccttgtctcttcctccccacctcaacaacacaggaaagaagctggaagcagggacaatgggaaggtccctttgttactcgagctattagaaacaaaaagaaaagtggccatctgaggaagccacagctggtgaaactgtagggtcacagagtgaattacacctctggcttaagtcagtgaaaagtcctagaagtttgtggtcctagaagtcctaaaagtttatgggactttgttttgagcaaggataagaaattgatttcaggctgggcgtggtggctcacgcctgtaaccctaatactttgggagacagaggcaggtggatcacttcaggtcaggagttccagagcagtctggccaacatggcgaaaccctgcctctcctaaaaatacaaaaattagccaggtgcggtggcacatgcctgtagtcccggctactcaggagactgagcaaggagaatcccttgaacccaggaggtggaggtctcagtgagctgatatcatatcactgcactctagcctgggcaacagagcaagactctgtctaaaaaaataaataaataaaaaagaaattgatttcattcttctgagaactgcaacaactaccttaaagtgattccatccaaaacccacatgttcagccatggacttgcttttatggagctgcgtgtgggtgacacacaaaatcaggagctctgagtcctaatttagacttttatttagatttcctcaaatttgggttccagttaagcgtgggtctcttctgtgccccgctcccctttgccatttgttttatctgttcttcagtctgttctgtcagtacccacaggcaggagagcagaaaggagaaatggcagccacagcagacaaatggcacattcgttccactcagctctcgcatgcccatcacagatacagctcattggtctcttttctatgagaggaagccagagctccagggaactactgccaactgatcagaactcatttaggacatggacctatttgttcctttatgttcctgggaagagcacaggatgaattctatgtactcatttacgtgttcagagagtaaagtgcctcataggatgcctccagcaaaagataaccaagaaggtctaatacctttgacaatctcagtttatcctatagtgtaattggatagcagttcccctagcaaaagttgctagtttggtcctattttctacatagccaaagtgattgattcattggttaatgtgaaagttactgagtactgccagcaggttctaggaaatatatttgtgtgatattcatggatggggaggatcaatccacttccaagtgatttggattaattactggtattttcacctgtgtgggtagcaaacctcagaaaatcaagtatagatgacggcataggacaggccaggccccaggcaaaatgttgaagctcctctggagttccctcccatctccctcttttgttttccatatacctggtttatccagggccctggagatgctccaagaccccctacccaggtcttcctcccttgtcccagctatatttctccatattaccactcttctcaccgaggatttgcttacttaacacataataaatactattaaaagagaaacttaggcacattaaaatgttagagttgattccagcaaacagtgattcacaggaggctccagatcacaagtggttcagggccccactgaggggtagggaagcaagacaaagaaaaacaaagcaaatatttgattggttcaagtggaaagtccctgattacaggttagtgggcagtttgtgattagttaagtttctctaagttgggttttggtttgctgatgtaggaacacagaatgctggggccgtttcaacctaatggtctcccaattaatttttttaacattactgatgactgttaggagtctaatgtgctactcctcccagggaaaatggcattcctaggattaaaggaactcagcacatggagtgtgcgtagaaatttagacactaactgcaggctggtgggagagagccctttagggcagaatgagaaggcgtccggccaagggcaggagttactgacgcatggcctcttggtttcagcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtggtgaggcccttgggctggcccctgtcctacaacacgtttccttggaagggtccgtagcagtcctggaggcccagcctgccctctgagggggtccactttgcctttgacctaaggttaaaaagttcacgtgaggctaaaatgtacaggggcaaaagtgggagcagtcctcaccccgagcgatgcaacagtgactcctcaccacgcctgcttgattcatctgccctggaaagtcattaaaaaaccagttcaactcatgggtccctttatttactcacaagagagagccagcagcccatttcactagttttcctttcctactctttgagaagaatcagaagggagggagcttgccactttactatctgtctaaagagatgtttccattaattaaaggtttttgttttgcttcaaaaaaacttgaattggagtatttccacaagtatctttaacatgctctaccaatgtttgcagaaagaagtgcagaaatgagactgtccacagagtcaggctcgctggccaggagaggactcccgaagctgacttctgatggcctgagaaacttcctagttcacaattcccagacccagacaaagagcactgtcttttctctaattgttttcaaatgggccatttccaccctctaatcagcctctggccctggagggtgcagttccccttgtcctccggagtctccctgtctctgtgctgtagagtcaagaagggacaaccacctgccctcactgggaaaagacagaaagtctgacttgttctcacgactcacacttattaggctccagaggtgtcagggcatctgcctttcatttcttaggttaaataagaaatcaattgctgccatttgtagtacccaattttctaaaatgatcacaatggataagtggcaagaaatccttatgactcatctgtgggcagagttgggctattttggtaatccttgagtaggcagatggaatttgaggccatcttcttgggtacatagatcactaggaagctataggtctagcaactgtggattagggctgggctgagaattgtttcatgttttttgtgactgtatagctagagactctcttgtttgcagagagacactctgaactccccctggccgtcaagggaaagactgccttcaccctcctgagctgaccttacactgagagacaatggggaccctcttttggccctcccctctacctcgagggcatctgggtgctgttgcattggataaaaggcactgctctttttctgtgccctctccgcctcactgcagagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggtaagcatcctcctctatagggtaaaggtaattgagttcttcagatccccagccctctccattcatctagtttaaatttcatttcttccaagctctttgtcagaaccagcatttgaagtttaaatctagaagttaaaaatccaccagcaaatcctactggctctacttgagaaacaaatccagaatctgatctcttgtcaccacctccaccacaaccttcccaatgccagtctcttccttccactaccacctcccatcagtccattctgcacactgtattcagggagatcctttcagaatcaaggtcatgtggtgtcagccctctctgtcaaatgcttgcactggcttttcctctctttcagagtaaaacccagtgtctcaaccctggcctccaagctgcttcattatccggcctccaactctcttcttcatcttacgattttccctactcctccatgttcctctgctccagccacgtcggcctccttactgactgtttaatacaccgagcgcatttcctcttcagggcctttccacctgctgttctcatgccagaagcacatttctctccccacaacctgcaacccgcccctcatatctgcaggcttgcttccttactttgttaaggtctctgttcaaatgtcccattatcacagggatctttccagactgaagagatctacataactatggctctgtaaacaacattcctccagggttcctgtccccttaccctactttattttggggaacattcttcaccatctgatacaatgatgtatcttatgcatgtatttactgactctctgcccttagtagaatatgagcccagagagcatgcatgtggtctattttgttaactgtgacagtcccagtgcccagaatagtgcctgacctttggtgggcactgaataaatatctaagtaatctgtagcatggaaaatcagcttctgaaaattggctgtttgcacggtcgtgtatttgcttggtagaaaatcaaattttccttcaaattagcattttctggtaactagagctgccccatcttcctctgagtggtctccaagtcagccaatagccttgtgctgtggcagccatgcctggctcttgatgctgtagccaaaagcaggcaggggatggtgaggctggtccagtccatggggagggacaaactcacagctctcagatcatctcagggcagcctttgttggcagaaataggtaggcagccaccctgaataggaggaaggcttctagactgggtcaggaggcctgggtttgcatcctagtggcaagcgtgcattcatttactagggctgccataacaaaataccactaactgggcagcttagacaacagccatttatatctcacagctctgaaggctggaagtccaaaatcaaggtgttggcagggccatgctccctctgaaacctgtaggtgcttgggcactccttgacttgtagatgcttcctgctgatccttcgtctgcacatggcattctgcctgtcttacatggccatcttataaggataccaactggattggattaggtgcctaccttgctcccatgtgacctcatctcaactaatcacatctgcaatgaccctgttcctaaacaaggccacattatgaggtacctggggttagcactctggtatcttttttcttgacagcacttctgacaccaaatgtgtgttttggttttttgttgttgttgttttggcaccaaccaattctcctatattaatgggttgtccaagaattcaattgaattctgacactatccagaattcacacagactccacgggttcagtcccacaaggcttccccgtcttcagatgccagctggaaatgtggtgcccaggctacccacacttttgccaaaatcctgtacttacaatcacagctttaaaatgaaggatgcagctcaggaactgccacatggaagagaagcacagtatggggtcgggggaagagtttctatgctctctctagacgcaccactctcccagcacctcaaagtgttcagcaacccaaaagctctccaaatcttgttgttcgagagtttttataaccctatctccagctccatactcccccattggaggttgagggttgggactgaaagttccattcttcacatgtgtggtgtttctggtgaccagtccccagaaactgcagctatcttggggctctaccctgagtcacatcattagcataaactcagatgtggtagaggaaggggcttattatgaataaaaaaagacactcctttctgccaggaaattccaagggttttaggagatctgtgccctgcacaggagctggggacaaagaccaagtatattttgtgttatgccacagaccccaacatgtctttttggagggagaccaaattcaacccatgacagtgactttgaacaagacatttgaacttagtctgttttttctatcctactagattgttggaaacagatataatagatgaaaattagttgattaaaattgaaatttgtgcataattcaaaagttttattttagccaagctaaagctttcatttattcaacagctatttactgagcagcacctgtgcatgaggctcagcagggccaggttctgggaacagagcggtggagataaagatccagacctgccccgaggaatagacagtccagtggcagcaaaggccatgaaacatacggcaactcttaaaaaaagccgagaccatgattttacaaaatcaacattttgtagggagcagaactttcaaagagaactggactagaaatttgggagtctttttcttggaaccctggtagatccagtagaatgagggatgggggtgtagggttaaaaacactgacattagaactggattacctgtgttggaattcctacatttctgtttcactatctgtgacggggggcagatggctgaatctcagtgtgcctctgtttcctttctcacaagaataatattactacctatctcctggggttgttttgaggtttagattatttaacacatggaaagcactcacagcaatgcctgccacagaaagaatatccagtacatcttagtgatgatcaccattattattatctgactcctggaaaaggacttgatttaattctctcatgaaacgttttcttggaaaactgatgtcaaccaagattattggtcttgctgttgcttataacaccccaaaaacatgactgtgtggataaaaatatgttggaaggggtagtctttctgggagcctgagaatagccatgtaataataactgcaaatatctatagttacaatttgaggttcaggtaaataaactctagatcttatagaactgcggtaaggtaggatagggagactccttcgactttctctgtttatttgtctctatttttaggagactatggaaccccacttccttggtactttcttctacaagagtcgtattggcttggcggtgaaggtgagtcctttaaaacacaaatcttaatgtttgaaatcaactccttgggctctgtgcaagatgtatatggatcacagaggtggccctctatgtaaacggtgtgattcctgatgagtcagctgcctcctggggctctgccccttgatgggcattgcagcgtctgggggaccacctttcacaagttgctgggccctgtgtgatcatgaatggctgatcatggatgaagccctgggtcctgtacaccttgtccagtagactaaattgccctatttaaaaaaggccaagccacttcagggttcaaagaacttttgcagcttttcagtataaagcagaaatccagggaatcatgaaggaacctttgcattcatctcccattgccttccttgtgcctttttattcttctctgccttttcaaaatataaattagtttattctcccaagatgaagactcctcctggggctgaggcagagctgttatcttcagggcaatacctcagattctcctggtgttgatctttcttaggggtggggaaaaaggctgaaagggcatttgcccacaacacatcttaggtaaaaggcacctttactactgaaccaaacaggaggcctagctagagaaagttctagaagcagggaaaagcacagactcttttgtgaggtctgagaaagcaaagaaattccagggtgaaagcgggggactcccctagagctgaagtactctcccatctgtttgttgctcacctacctattctttactttgtattattgggcctgggccaggacttatcctgcaagcactgagatggatgtttgttttctctgggggattagtctttttttttctttttttcttttgttttttgcttttgttttcactgggtcaaacaaacaacactttaacagctcaggattttttcattgtattgacttgtctacctgtaaacttgttaattttttactataataaaattatcatataataaatgaaaaatttcaacacagggcttgtgggcattttatttttctctacaatcccaacagatactctgcctcttaagaaaaaaagaaatcataaggaaaatatgctccttcaaaagtgaatcacaaatatgtttgccaacggaaggcaaatatttttcacctgtctcataggctggactgaaatggatttctaaaactctctaaaaccagaaaagagctgagtgtctccacccaacctccctcctttcacagattaaaaaataaaaaatggagcccaggagacatccagtatcttcccctattggtcacctgggacaaaatctggaacatgcacatgcattgcctggcaggaactcattccagtgattaaactcttcaggaggatgtttcctcttgctatttcattacctatttgtgcagtttgatagctagtaaagtgatcaaaggaactgtggggcatagattcaaaagtccttcaggaagcagaaatagaagaacagtactagaggcagcaggtccctgaccagcaggcccactacctgctgctccagcacacatcctgcacattttcagagggtgggggacagaggggccctgggtggctgttgcattgagaaatctcgccctgctcctgtatgtgcacttgaggccgagagcccttggatgcctggtgacagtggtttcctcctgcccctgccttcctctctggcagactgactggcccttctgctcctcttccccttccaggatgtcctgatatctttttaaaccaaatgccaagtttgccaaaaagtgtctgtttgtgtgtgtgtgtgtgtgtgtgttcaatgcgtgtgtttataccacacttcacaatttgtccaggcttgtattaataccatcaccaggctcaaccctggtgttaattccaagatacttaaatgcccatctaggtgaatttctcaggtaaaccatatattcaagctgtagtttaagctggctgcccgtcatagcactttgaatagactttgtttttgtttttgttttttgagacagagtctcactctgtcggccaggctggagtgcagtggcactatctcggctcactgcaacctccgcctcccgggttcaagcgattctcctgcctcagcctcctaagtagctgggattacaggtgagcgccaccccacccggctaatttttgtatttttagtagatacggggtttcaccatgttggtcagactggtctcgaactcctgacctcatgatacgcctacattggcctcccaaagtgctgggattacaggcgtgagccaccacatccggcccctgaatagacttttactcaaggttcaccatgactttcacatgttttgtattggagtaaaatgtgccagtggtgggctaaagaaaattaactcatttcaaattcaaacctggttttcttaatttttttaaaatcacagtttctgaaactgtgggctcctcatggcacattgagaggaggaggtgaaactctccaagtctgaagctcctgttataaatcttcctctggcaaagattgtgtgatcaggcttgagtacctcacagtcctagagcaggtcaaaggctggctaggaaactcatttgctccctgtacctctcccctcctttcctgcctttgctcgttctcagctcccggtggtagagtaacactggcttctgattggtgcagggtgttcaaccagagaagaaagagccctggaaaagaccgagcccctaacagaggaaacggaggatccagagcacccagaaggaatacacggtaaaaccccgataaagaatacacagcagaggcgaggaaaaggctctaagcactgcagagggccagagcaaaacatctcatggcaagggtggaaagaagcctaggaaactgactctctctgtggacaagtgttaaaccagatcccttctcagaggtccatctgcatgtgtgtggaatgaatggttcagcccagacattagcgcatatttcctggagaaagcaaataccaactatgtagtgtgcctgtgcccttgttaggcaaatcccaagtgagttgcacaaatgtgctgacttccgaggatttagcaagaacaataactttggtcactgggacttaaagcggatatgagctataaggaaagacaaaaataaatgcttctgtgtccagggggaaagagactccaggggagctgactacacttcacttacggcttacaaatctagaaggccattcattgaaaccatcagaagcctttcctgacagtggaagttacctaataatccctaaactgacgacccagatttacaagttttgttttcctggcttttgctgccctcatcttctctcttaaactagttctgtatttctcccaaggcttttcattccctaagcatacgcatttctctgtggccaaaatgctctgggtttagacaggcagcacagcccctgggctctgcctgacagggcaggagagggtctggcctttatccctccagcccaccccaggggccatttcataaaactaaagccagagacctgcagcccctcccagagttagactgcagtacaccatgcctctggcaagatcctcctcccacagtggaaagtctaagccaaatcaggaggctggggactggttccacctcagttgcaggcaaggccaggaggcacggatagaagaaacagtggactttttccccctagggaaagaaatgcttagagctacagtattaagatgacaaattaagctgtgccatatagggtgaaatgaagcagggatagatgggaggtcagggagaagtgagagcactcggtgagggtctgcactggagggggcatgggaggaagaaggaggggagtggggtttgagggatggtgatgaggaagcgtggactgccctacccacctattggaaaacctgggagttctgaggagcaagaagccttagtcaaagtcaactcaaagattcaagccaaggtgactaagagaatggcggtccagaaaaggtcatgggagaatctgaaggcagatgttgttttgggaagatgaagaacctaagccgcttccagaaattcatgaggaaatgccccgtggactgttggcaatgagggcctaggaccaaggttgagcttggggccaactctccctatagacagtgagtgcattctgacaagcatgggctctgggttcaaatcccaactctgccactcatgcctatgtgtccttaataggacgcttgatgtctctgtgtctaaggtttcctggactatggaaatgagcctaataaatgtctaccccttaggaccattgtaagagtacattgaggtaatttgtgtaaagcagtcgaagcagtgcctggcatataggaggtgctgtataaacgtttgatgctagtattactattattattctggagtcttccttgcaacggtgatagccgaagccacaggggcaggtgacgttataggcagaatacaagggcctggagacagagccctggggccatgtaattaggcattatgtttacatcatgttcattttttttcctccaagactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtgagtcttccagcagagaagctggctgccatgctagcctgtcatttcctggcttagtctttccctatcagcggctgtctactctttcccacaaattttagtgacaaatatttgcggccccaaaaatgtgtaaaagctttctgcagtattcaaagatcactaatatgtattctcttgatggggaggtagaatacgtttattgccccttttgtgtgccggggaagtggacattcattcagagagttgaagtgactttcctgaagccaccaagttgtcatggctcagcgggggcaaaagccaggcaccacagttgcctcttgtttctcacaccttgagtctttccccccatctcaacagtccatggtggtgatcaagtcatggccactgtcatcatgtgcatggaagctatagagtcctcctatttcctttctcttttcttttctttttttttttttttttttttgagatagtaaccattacccatgctggagggcagtggtgcgatcttggctcactgcaacctccgcctcccaggatcaagcgattctcccacctcagcctcccaagtaggtgggactacaggtgcataccaccatgcccagctaatttttgtattttttttttttttttttttttttagtacagacagggtttcaccatgttggccaggctggtctcgaactcctgacctcaggtgatctgcccgcctcagcttcccaaagtgctgggattacaggcgtgagcgaccgcaccaggccgagtcctgctattttcaaggaacattccttttcctaccaatcattaggcaggcttcaacatcagctgatgagggttagtggtcgttctggagaaagtgaaaaaagaatcagtctctagaggggcttgtggagtaaccgcctggtaacagaaggtcagggcagggaaggcaaaggggctctgcgcggatctctcagctccgcaggcgccccactctcctccaagggacccgagcgccatctgctgagaggagaacacggcccgccatggtttcccaaggagcagcagacacggacctcgcagggggcagcgaacccacgtgacacagtcttcaagtcctttggagagccccaggaaggaacaacagcgtgtacaccctgtgatggaatgttctctagggcggttcagtgtgaatggaatgtggggccggtgccattctaattggttctgtttccctctagtggttgatcgcggagatttcggcttctccatcaggacaagttcagatagcctgagatggtatcagaactcagggacagagctgggtgtggcggccctgcatccatctgctttctctccatgctaactgatatggtcagagagctggaagcaaattccaggaccccagggctccgcaaaggcaaacacattacttcatcggctgctgacatgcaacttcccccaggggttaaaacaatgtttaatactaacagtaataatatttttgagttttactttatgctggcgctgttctaatgttgtaagtgtattaactcatttaagccttacaacaacctaaggacatgggagtcatagttcccatttaaaaaaaaaaaaaaaaaaagcccaccattgctctgaggctttttatgttttggatccaaagctaatattggtggtggtaattcccatgcctggcttcgatcaattaatcagcaaatgcctaggactgcttagggttctggccttcatcaagaccttacccgggctttatgatgatgacacctggcttttcaatagccatgactgctcacccaggaggcaacgcctcgagtcatgcaccgaacaccttttattgatcctctccaacaccaggctccgtgatggctgagctggggacacctgtgactgcacgtgaacattttgaggctgggaatcccaaaggccctcggcgttggcctgggagcaccatgaaacaagtagaagcagagaaggatggcagaggtggccctctgcattagggcctggatgtatacactggtgctaagggggccccacagctaataggggtttgagtttgactgacagccccaggcaggaatctgtgagagttctcactgaacctggtgtgggggtggccctcctaaggcatgttgctaaaggccatctcttctgccactgacgcctgtgttctgcaggtccatcctgacgggtctgttgccaccaacctctgggactgtgctcgttgggggaagggacattgaaaccagcctggatgcagtccggcagagccttggcatgtgtccacagcacaacatcctgttccaccagtaagcgacacaggaactgagaccgccccatcccctctcctcacctctgcccccagcacacttctctagagcccagctcaggggtgccaggcctgggcacaggcagagatacagactcttatttggtttcccctatgtttaaagtcctttgtcctacttgcagtgagaattgtccctgagaatatgggactctgcctctgctgctcagagctgagggctcctccctcagaagggtgaggctgccttcgctctgacagagcagctgatcgatccccgagccccttgtgcagccctgaagtacttcctctctgggaccaaagacaggagaaccattgttcctttttcctgttgaagccacggcctgaaaggcaaacttttcagggggcttttcagttactttttttccccaataagatatcttttatttcttatctaagaagctacgcatagtcattgtgaaagaaaaaaaaggaagggaggaaggaagggaggaaggaaggaaggaaggaaggaaggaaagaagggagggagggaggggagaaggaagcgagggagggagggaggggagaaggaagggaacaggagggaggaaaagggaaggggaaggaggaaggaaagggaaggagggaggaagtaaatataggtaaacaaaaaattgaaaataaaagtcacctgtaatttcactactcagagataaccgctgagttataacattggtatataattttttagaactttctcctatacatgtatagatagataaacacatatacttcaaaatgataaagaatagtaaaactatgcatacaattttataacctgacttttttttcaaaaaaaaggattgcttttttaaacataagatatcaggaacatctttcatgtcattacatattcttctataaaataatatttaatgtttacagattattccattgtatgcatgaactatgtaagccatcctcttattagatatttaagcagggtctgctatttttgtattgtatcataaacaccaccacagtgagcatcttgattgccaaatcaagaatacttgtcctcaattatttctgtaagatcagctgctggaagtggaagtgctaagccactgcttttctcgttgtcccatcctcctagcctcacggtggctgagcacatgctgttctatgcccagctgaaaggaaagtcccaggaggaggcccagctggagatggaagccatgttggaggacacaggcctccaccacaagcggaatgaagaggctcaggacctatcaggtgctcagagctggatggagacagggccacagatggcaaatccatggctccccagtgcacccaggaggcaggggaggcttggagcaggagagcttctaagggtgggaacacctctgtgaagttacaccaaaaatctaagagcagcccccagatcattttccctgcagagcactgtctcacagcagcctgggttttatttgtcctgagattgatgtgcttgaacagtcttcaaagggtctgatccgaggaggtgagggttgccctttctgcatttacaaagcctgaacagtattagggctttgaacgctataaacatctaagaggcagcaccaaaccactgctgggttaaggtacccccacaatgccacttgccctgggcctttctcttcctcaccctccacagccccttaactctcccgtccttcttgtgcctccaggtggcatgcagagaaagctgtcggttgccattgcctttgtgggagatgccaaggtggtgattctggacgaacccacctctggggtggacccttactcgagacgctcaatctgggatctgctcctgaagtatcgctcaggtaacagctgctgctcagtctcctgggctgggctctcactgcagccctagctgtggtccccactctctcacctgccattttgtagctgagtacaggaaccacaatgactacactcagaagggggtttatcagtgacttggtgaatctaagttccagctaaagcctcctgaggtttttacaaatataaacagagaatcactgatgatgcaacctacttcccaaaatattttagaaaattctcttgacctgcagcccttctgtctggaataatggatgctactctaggtgaatgtcttctctgaccatggggacccaggtcacctgcaaacatacctagaagctccatagctgtcagatgaccactcaggaccagtgtgagggtgacctgctgggcattcagtgctccagagggtggccacagatggaagtggctcctctgtcatggcacctctcagacaaggggctcagatcagaagagacagcaagcagagctgagtgcccatagaggtaacagcacggttcaaccccgtggtcaagccagagctttcccccttgctctactcacacagcgttgccccgtgcctttctctgagggtttgtcatcctgaaatcctcattgctattttctttctttcttttcttttttttttttttttttttttgagacagaatctcgctctgtcgcgcaggctggagtgcagtggcgcaatctccactcactgcaagctccgcctcctgggttcgagccattctcctgcctcagcctcctgagtagctgggactacaggtgcccgccaccacgcctagctaattgtttttgtatttttagtagagacggggtttcaccgtgttagccaggatggtctcgatctcccgacctcaggtgatcctcccgccttgtcctcccaaagtgctgggattacaggcatgagccaccgtgcccggcctgctgttttctgttaatgacatctccagttagtgagagtatgcacgtgtgtgttctttatgaagagtataaatccagagcttaatgatccagaaaatgtacatatgaaactccctagatgctgaccataatacatgagcccctaatatagagatttatttgaatcagatcctatgctggatacagagacactgtgtgtggcaatgctttacagtatgtaggaagctatgaaatgttagttattattgtcctaatatgctggaatttgctgctgaattagttcccttgggtttttttttttagttaactcctgatttttgcaactatatagccaggaaattgctgtacaccctttaccaacaatgcccaacccagggcaggcctggtgattgccctggcccctaccttgcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggtaggtgtctgcccagggaaggaccctggcctgggtgagaaggagcacacagcacggggctgccactccagacatggctactcacacaggctctcgccaccagaatcagtgtctttgttctgggaccatttgcagaagatttcgatgaacacattctgaagcctcctcctacagagatgctttagccaaaatgaaacaactagctttaaatggtctgcaagtattacatgccagattacacaccagtttggtgcggtttggtgcaacatagaagtgagtgtcttattctgtaaggttaggctgttttaagagcaattggttgagcttcatttcaacattaatattccctaattaaacctgaatttcagtggtaagtgaaaactaagaagaggcctccttgggtgctataacataaaaatgatgaaggcaaaaagtaccaaccagcagagaccacttcagcacatcaggagacccagttttatgtctgtgctgcgaagtgaacaaactgtgtcatcctaggcaaattatttaattcctccttttttttagtatttttttcttcttcacatggaacatgaagctaatgacctctgcttctatttcttagggatgtgaagataagtgagataaagtattataaatgtgctctgggcttcttaagaacaggcattgctcacattcaaatggtcatgattatgatatggcagcattatttatgcctctggtttaagtgtctggctgccgctggggtttcctatgtccatccacggggagggaggcacagaatgtctcccacaggcagaacctacagctgccacataattgatgacaagccaaagggacccttggaggttctgctcctctctgtgtgtgactcacacactctctaggataaaatcaagcgactacaccctcaaaatgctcagatgaattaacagattaaacagtgaagaaaaaaatgtgttgactacacttggcagtgagaaataaataaagcgggcggtgacagcagctggcatcagggagaggctgtcatggaagggatgtgcatcttgtcagtcatcccatccatctgttgcaggggacctgcagctgctcgtctaagggtttctccaccacgtgtccagcccacgtcgatgacctaactccagaacaagtcctggatggtaaggactggacgggccatacttgggttccgtctggcagccatctcccagtattgctgggtgtgtcctgttgtgatgcattttaatgggagcaaagagaacactgggtacttctgcaggtcacacagttgttcttttgctttgagcttctttctcctcttccttcttccttcattcccaaagggattttaaaagtcatgcacctaaaggccctctccctttaatgaggaatacactctgtgctcttacccttagtaagccatcattcctggggtccccctgccctggctccaggccacattccttagtgtctggggagagcttcttctacatgtgtgccgtggcgccctctagtggaagcatggtgatgcacggctcttccagtgaattcgtggagtcagagattgcacatgtggatggcaagtctggaaatagcatacacccctgttatactcctgattctcccctcagcttcccaatttcccagtgattctccctttaattaggatgcactgaagctctcaggggtgcccccatctccaaggagctgcagtggagaggctatcccctctctatgtgagagaatgtgtgagaagcgtattcccacacaggagcaaaactaaacttacgtactgatgcaggttaatgaatggggaaagtatctgcttatcaaagaaaaggcatatttttctatttagcacaaactttttcaaatgttaagaatttactaactgaaatctggtgaagcaagagaaccgggcaatatttgcgttgtctgatcattacaactggagggaacatgctcagagaggcatcatcactgttcatgcacctgccctctctttacactgagagaccctgtgatgaacagaaaacatctttttaggatgacatctctgggtctttctcctagcctgccttgctgtgggtacctatctccctgctctctgaaccttggtcaagaagtttatatttgttttaaattgatactaatatgttaagttactgtgatttgccaaaatcagattggaaacagggcctgcatggctgaatgattcttttttttaaattactttatttctaaataaaggttttctttgtatagaatcgggatgctgtgaatggtgggaaatgcactaaatagttatgccccaaataagaaagggaaaatcatttgaatccccagttagctccttgaaagtcttttcacttaaacacacccacataccacacacacactcacagacctccctcccagatgcccaaagccctgctgacctacagagctacttctggaaaggctgacacatgcctaagacacaattcctgggaatccagcagctttgggttcaatttccttcctaaaagaacaatgaatatgacccctggagagctattagggcagagctgcttccttaacgtaaaggactctccagcctccgtatgaagtcatctcagagctaaagacaatcaagtccaacttgcagatttgacataaagcaagacttccaatccggctaggcagaaggattttggttgaaaaccatgaaatcccttcatatggatcattttttaaacaacaaaaaaagaaaagaacctactgggtgtccacaactctgagagctgctttctgaagagtcatgttttgagtcctggaatccctctccctttgacctgcctctcaagacaatgtgcgagagaactctctcttcaagtgcatgcaagtgaggttttcacagttagatttttaattttaaagtaatacacatttgtacataaaattcaattctgactgtatacatgtgtcagataaacagttgatacctgacacttgttcacagtctatgatacgcaccgcatatcctaccctctcccccagcctctctccatggcttctcaaccccccctctgcatttcctgtgacctgaggattcagttttgtttgtggaggcaggtgcaatcccaagagaaactgtgcaatcttctgagaagttagagtaggcatgtgtgtgtgatttagggaaggtacttctcactcagcttggtcaccggttccaggtttgtgtcttgggcaagtcccccatagctggtgacagaccagaaaaatgaaaacaactttgacttagccctcaagttttcagtgaatgagaatgaaaaacaaccatgagtaagagatttcttaccgagatgatgtaaaggataataatagcagccagcactcacctatgtgccaggtatttctctaactgctttgtgtagtttgactcatccagtcctcaaaaacaacaatgaagtggataccagtattttccccttttcacagatgaggaaagtctaatgtgacccacccaacataacatagtttgaggggacagagcatttcgttgaacagaggaggaactggcacaggaaagttgcatgacccccccaccaacctccgcccccaggttgcacagctagctagtcgggaggactttgcttccgtttccctctgcctctcaatgatgatctcagggccaactaagctaaaagcagacttgatggagcatcagtcctctgaaagagtcactgccgagatacaaaatacctcttcttcaaaggggaagtggagagaagtaggaaatctgggtaacctcacagtcttccagtttctggaaaacagagctggcatcagtcttttttcttgtcctaggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagaggtaaagtagagattccagctggtttctgtcaagtgccagaagtggcggttctttgaaaaagtctaacattagagcaaagttttgtaaaagcaaaaagccatcgttccccacccaagcatagcaactatctttatttttggcatagttcccccatctctgcatgcatacaaattttatgtacttgtggttactgtgtgcttacgtttttgtatttatagaagatgatgttctcagatagagtcgtaatggattttcttcccattatgaagcaatacccaacaaaacagagcttgggttagatttttctgagaataagaatgactaaacaaaattctctctttttttcttcttgacagatttttctgaaggtcacggaggattctgattcaggacctctgtttgcgggtatggtgctggagccagtggcttgttcccttccttgcctccctcccaagttccatctcgaaagtctaaggggctgggcacagtggctcatgcctgtaatcccagcaatttgggaggccaaggcagatggaccacctgagttcgagaccagcctggccaacatggtgaaaccccatctgtactaaaaatacaaaaattagctaggtgtggtggcgcgcacctgtaattccagctactcgggaggctgaggcaggagaatcacttgaacctgggaggcagaggttgcagtgagcagagattgtgccactgcactgcagcctgagcgacaagagcaaaatccatctcaaaaaaaaaaaaaagtctaaggaaaaagtcatgaaacaacaaagcaggcaaatactcctccatagtatctgactccccagtagtaggcattttgcatcctagatggctttgagtgacaaaggaataacagactgagttaggtctagatggggacactttggatgaatgaggattcttacggaggtcaggttggtagcttcatccctcagctcctcatgctgtatccccagtctctcggcctgccatgtcatcatcctcatctcctcctgtcatctccaccaggcctctgatccatctctgtctgcatgagtgacagctggcagagtccttaatgtttatcaaatacaactcagacgtcagtctcctggcccctttgagatcaacataaaatcattttgaacccttatttagtggtctatgggctttgaaaacatggggaccaaaattcctgtggattctagaagtctctcttctacatgtgtcagcctgggcaccaactagctccttccatgaacttttatcaaacccacagccacacaaagcatgtgtgagtgtagcagagtttacagcagagggtggagggtggggagatagatgtgtggaagggttacctgccacacaaacagaaaccacttctgatagaacacgaggtgtccacccacactgtaaaatcctctcctggtacaggcaaagctttgcagcgattctcctttgctgcccctgggctcctaacacctcctaaaccaccagttacctccttctttccagtgtggcatatttcagtgttttcctgttggagtgtttcctttctatgtggattctggaatcagctcttaagataacttggttttcatctttcttcataatgatcccaaacatctatctactatgcctagaactaccaatggacacatataccagcccagatatgcttcagcccatcccagtacatcgcatggtgaccaaaagatgtagtcgtcctggcacagtgggtgtggggcaggaagcagtcctctccaggggacagcagcaattcaccacagaacccaagtttctttcaagctctgctgacacagaaattgaataatctcagctcacccaatgtcaaagactcatattaaccaagaccagaatgaaaatatgctaatttatatcagaagctttgctggattcaagagttagggccttttacctgtgcagaatattccttcttgataaataggccctctcaggagaataaattacacatcagaggactgtttagtcagcataggcatagaacaggatgttccaaagatacagtcaaggggagtgggtaagagtgtagcctctggagtgaggccgaccaaatatcaaacctgagcttcataatttgcaaactaactggctttgggtaagtacatagcctctttgtacctgtttccccatctgcaaaatggagataataatagcatctacctgtagcattgttgagagaattaagtgagttaatgcttgccgacttataacacagtatacgatcactgattaagacttagcaactctaaactaaatgtttacaaaccatctcttacctcaaagcacttaacatccattgtcttatttgattatcactgtaatcttatgaagcaggcagggcaggggtctgccccatctggggggaactgagctcacagaggttggagggtttgcctaaagtcacccaggccactgggtctcactctctggtcttagctctgtaatctaggatgctcaatgccacactctcagccacttttcagatggctaagtacatttgttttgagttagctcagtctcagaggatgacattttctgatcttgtctccagtgtttaaatgaacctgtagctgtgcattggggtcacacaatgcgtggcatggagagggtctgtggctgactgccacggttactacgtgaaaccatcattacagcagttactactgttactgcctgagaacatcattacaagactgaacgaagggatcaacatggaaatgataacaaaaaaaccaaagtaactgttttaaggaaaggctagcatcgggaagaagaagagagaagaagagaagaagaaaagggctccctgcttctaatgagtaaaggcagctccctaagcttctgcagcccttcattatttattgggtaacaggaggaaggagcaggaggtaatgattgggtcagctgcttaaatgatcacgggttcatgttgttactgacagatttcaattatgcctaatcataagaaacatttgtgcagcctccaacaagggtcaatgccacttctgaaggggtgactcatagtcagtaactagaaagcagcagatagctagggacaaactggcgattctgaataggcctggaacccttagctctggccaggtcagtgggctccagtcaggatggagccttcagggagagatcaaagctcagaggtttgagatgatatcagccagcaaagaggaggggcagtagggatcctcccagagggagggccagccatagaagacatcaaatctgagcccggatcaggagaaggagcctgcagaactggggctctggcaccgagaacctgcagaacttcgcccctctgagtgcaggtgccagggctggggctgccacccagccttcgcatcccaggcctggcacgtcataggtaaatgtagttgaaaggatgactgagctgatccaattccctttacaactgtccttgtcctgggggacttgaggagggttaagaaagcagctggggaccaaccaacagtcctctaggctctccatgtccagcaatagttgttcagcaaatgagcattaatcagtgactataaactgtagcttcaacataaccgacaacttgcaatggtttctagagcatgctcccatgtgttatctcatttaaatttccaaaccaatcctgtgaaatgttctttttttttttcttttttttttttttgagatagagttttgctctgtcacccaggctggaatacagcggctcgatcatagctcactgcagccttgacctcctgggcccaaggggtcctcccacctcagcctcccaagtagctgggactacaggcacacgccaccgtgcctggctaatttcttttctagttgtttgtagagacagggtctccctatgttgtacaggctgatctgaaactcctggggtcaatcaatcctcctggcttggcctcccaaagtgctgggattacaggcatgagccaccatgccttcattttacagataagaagtctgagaaaactcagatttaggcagattgagtcacttccccaaatttatgtatcttgtaagaatccatattcaaacctcagtcccctaactcttagttcattactttttctaccacttctcagtatcctctaagaattcagaaagaaccacatcgactctgatttttcatttgtttaagtacacaggtaataggtgaatgtattttgttgtttaaaaattcatataatacacaaaaggctaaagtctcgcttcccacttcctctcccctttctacccaactctgcctccccagggagagcttctgctgacagtcggtggacattctttcagagttttacaattatgtgtgtgtgtgtacataagatgtcagtttttctttgtgtaggatacatgaacatgaattttaaacataaatgtgagtgtattacacatattgaccagcaccttagtttttttgtttgtttgtttggttttctttgtgctgtttgagaaggagtcttgctctgtcacccaggctggagtgcagtcttgcaatctcggcttacgcaacctccacctcctgggttcaagtgattctcctgcctcagcctcccgagtagttgggattacaggtgcctgccaccatgcctggctaatttttgtatttttgtagagagggggtttcactatgtaggtcaagctggtctcaaactgctgacctcaaatgatccatccacctcagcctcccaaagtgctgagatgacaggcgtgagcctccgtgcccagccagttttgtttttttattaaccaagttacgtattttaaacttctccatgtcaatgcttttagagctattttgttctctttaatgttaatagagaattttaaggcaatttcaggtgaatctatacaatttctctgtataagtaatttacactagaaatagatttttataaagatgattaagctaccagcctggtatttcattgctgacttaaatgaagaggaaaatcaatgctgtaagggaaaaaaaaaatggcattagagatccagaccttataggcattttccaaattattaattcaatctctcaaaacaggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcaggtactattgtcggtcggtgtttagctgagctcagtggctcctctcccagccttcccctcctctcctgagtgttccttcaggcatgggttataactcagcaaggagcaccctctttagattctgctggttttgtttcctgctttccaaacccttatcttgattcttggtaacatgaatcttctttgtaagttggacctcccctagcaaagaaaatagaataatagtgaaaatgttaatattgtttttatttttacagtgagggataaagtcatgttttcattcatttttgcagtgaccctacatatcaaaatcattgccctcttttttcttttaatgttgtttaatttagaaaaagaagctctggtttaaagaacagtgagtcacgtgacttgctctttgaaatgccctttgaagtctggctgaacactgggctgcattcagattcttcagtggccaccagaacattctgttttcttctgcacatcttacctttgcacaccctgcttattatgttcccccagaagcccaaccctctccaccaggggctgattaggaggctgcaggataaatgtttaaaagaatgaagatgtgtgtgcacgcgcacgtgtgacatctccatgccacagtcatgtttattccacgtctattctcccacagatcgtgctcccggctacctttgtgtttttggctctgatgctttctattgttatccctccttttggcgaataccccgctttgacccttcacccctggatatatgggcagcagtacaccttcttcaggtgcgcggactcggggtcaccattctcctctgtgggtttggggcacctgggtcacatgctgcttagaagggccctgaccttcccacttcactgggaccttcaccaatgagagaggggaggggtctttgggctgcctgcagaaaggaacttaatgtatctgccactgcttggaaaggcgatcctagtggacaggcaggactgcttgggaaggccgaatggggaaaggaatgcaaagcttaggtgaatgggttgaagcgccatctttttgaggcataggtgacatgccatcagaccactgcgagtgttcaggcagcctaccgcactcccaggagagctagcgccatcccaaggcagcattcggtgcctccaatacatacctggcacacagcagctatccagtaaaggctctgagttgcatgatgttggcacgcgcctgctctgtcccagtcacatgtctcactctgtctagcatggatgaaccaggcagtgagcagttcacggtacttgcagacgtcctcctgaataagccaggctttggcaaccgctgcctgaaggaagggtggcttccgtaagtgcctacgcgcccctgtcctaagaagactagctcccctgggaggacccaacggtgggttcaagatggcaggcgttggggaggccccactcaatcctgctctgctggtcacttccatgtctctgaccagcactcccccaacctctccttccacacttgtgtgcagggacattcactacctcctaggaagcccccacaccactggacagctctatatttctcagcatagaagttctatgttgagttgacagatgattccccataacttatttgaaaggcctctgagcagggagggagggaaatagggttatgctattgtgtgattgggccttgaatggcgtgagtgacacagtggccagtactttgtgatagttgtgagtctggagaagggagttagcgaaggccattgacatccaccaggaatcctaaaagttcaatataattttaacttttctccctcagtctttttcaaagctgtcaataaggaccaaaacagactaatttcaaattcctcttctggttgctgtgtctctcaacagctagagctgctaggaataaaaagggagacaaaacgatccacaagctagagatggttattccccagccccacacctagtcagtcacaaaaccctagttttgatattgcttgagcagaaaccagcctccaagagaataagaagaaagggcctgggtctaaagaggaggaggaaagggttgggcacaatttcttatgcctagggatttgtcagcaactttgaggctgattatggaatattttcttgtcttccatgagggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccaggtacctgacctccaaacaacggggccccaggtctgcctgccacagagggactaggggagtccctggtatctcctgagtctctcacaaactaacatttcaaactggcagttgagtaggggactaaaccaaactccctgcaccctctgggaggggctccccacagggcgctgtggctgccaactggaggaagccactcaccaaaagcttcattttccaccagatacttcctatttgatctagtagaaaaaatgtgtttaagcactaaaaaaaattaagtcatatgtgctcattatagaaaaattagaaaacacaggtaagtcagaaggaaaaaaaatcatcgcttggatataaacacagataatgtttggtttgcagccacccaaacagattatattccaaatattgtcttaaaatctgatttactgcataatttactaggaacatgcatccatgtcaataaatagacatctgcatcacttttaatatctgtatattatcccattgtttgaatttcttttttttttttttttttttttttgagacagagtctctctctgtcacccaggttggagtgcagcggtgtgatctcggctcactgcaacctctgcctcccaggttcaattcttgtgcctcagcccccccgagtagtggggattacaggcatgcaccatcatgcccgcctaatttttttggtagttttagtacagatggggttttaccatgttggccaggctggtgttgaactcctggcctcaagtgatctacccacttctgcctaccagagtgctaggattacaagcgtcagccactgctcctggcctaaagttactttaaattaactgatctcccattattcgccacttaggttttttagttttcaccattataagcaatgctatgatgtacattcaaatggaaatgtgtttacacacttattaacagtcttaattaagaagctctccatgtgctgtgtctctaacatctgcaggtatgtacacaaatacatgcacagccagcatccatcttttgcagggacattaatgatcttggctctgagcagcaccctgtcctgggagttctaaagtccagaacagattacagtgagcatctcctgggggatttagagacatcaaagaaggctgtgtccgtggttgataatgggcctcccagctgacttgccagggctgggccttagacagccctgtccaatgatttgtcaatgaataaactgttcccaaacaggctatgcagttcagtgggaaagcacaggtatgggacacggagagccccaggtggactacttgacctctctgagccttaattttatcacctgtgaattgggaataactgcttatttcataatattattatgaggatttaatgaaatcatgtgggcaaggaattatttagaattagattcaactcaagtgatgacaaccccaaactaacagcagataaaacaagacacaacttgtttctcactcatctaaaagtctacgtgggtggtgcacgatgttctattctctttctcctccacactaaacaggcctcagcctcatcagccaataaggcaggagctgccttccaggcagcggaatggaagaaggatgaagcaaaacagagggcagagtgtgcacatgtgctatgtttagggaaggttttctgaagttcccacatagtacttccacttacaaacccaacaaaaaaggctatggctaaggcagcagggaggagcaaataatgggagcaactagattttgccacagcacctatcacagtctggtttataaatggttctaggccaagaacacccgatccctgctcttttttatattctaaagcatgtatctttatatttctcaagcaatattttctctctttgaatcacagctcatctgctgcatcatagggatcccaaaagaaggacccaaggaacttgtctcagtcctctgtgccccaagaggaagctttgcttgtttgctttgctgtcaatgctgagggctcctgtggctgcctccactcaaaaccctccagcatcaggacgtcaaggctgtgatactgtaccctgagctcttggccagggcgagggaggggaggccaagcctacctacatggtgtttcatttcctaaacgaacccttacttccacgcggtctgtccagcttagaaacttattttcagtagtgttggtccttggtccctggacaaaatgtaacagccaaagtcctagaaaaaggcaagccagttcctgccattttctttcacttctgcatttcctcactattatacgtgccttccattggagcaaaactgaatgccacgcatatgcacaggagctgtgcgcgctctgtctctctcactcactctttttctctctctctctttctctctcaatctctctgtctctatctatctcttactctttatctctcactctctcactctttctcactctttctctcaatctctttctcattctctctctatctttctctctctctctctttctcacacacacacactcacaaacccacactcttattcacatctgctcaccctagccactcaaacacaatccctcattcagcctggaataagtccagagggcgtgggcctgattcagagacaatcagttgttctcatctgggaaatggggcaatgtggtcatctctagggaccctccctgctctaacattctttgaatgtggtgggtcctgaggtggaagcactctgtccctgacttctagtatatgtggagatagggttacacaaatattttattgggcagaacttttataaaacaatttatcataagctatcgcagccagcagcaatttttccaacctggattccaccaggggagcttggccggtgtctgagtgccactttcagcttgagaagcaggtgactcagtgaaaagagcaaggaggagacagaggcagattcagttcctaggccctgggccacccacctgcaagtttgcagcccagtcagtgcaagtcagctaactgttctgaacctcagtttctctgtctgtaaattaagctaaaaattcttctttcaaagagtgtcaggatgaagtgagatcgtgtatgtagggcatttaacatagtgcccgacacacagggagcattcggtaggtgccagctctcctcctggcaggagagagagaaacaaggtgaaaagagtgaattaaagaagaggaaagtcaaatgggaaaacagggggaggagatagaaagtgtatgaaaaggaaagaatggtgcgcaataacggcggtgtaatgccaccaaaatcccctcaactacttctgggcagcacccttgacagagtgaatgcttttatgagaatgtaagcggaatgtgttcccagatttgcagtaatattgccacctggtggacaaacccatgcacctttgaattttccaaaatatttcgatgaactagcttccagtcctagatgtattttgaaagtgatttgtaaattgtaaggaactattcaaattctttcattaatgtcacaaatcaactgtgtcatctgtatgccacccactattctgggtgctggggacacaacagctcacaaatcaggcaaagtccctgctctcaccaaaatgatatcctacgggggattacagatacaaatacgtaaacagatccatcgggaggaaactctcagatggaaatgagagctatgaagataacacaacagtacatgacaatacagagtgactggaaccaggaacatttctccgaggaataaaatttgaagcgagccatgagagggtctacaggtagagttcccaggcagagtgaacagccaagcacaaagctgcaccaggagagagaggtgctcgccgagagacagggaggggagtgtggcaggtgagctcagagaggggcagggccacacacatcggccacatgggccttggtagtgagtcgagatttgatcccagggtttattggagtggataagtaagcaaggtgactgaggtgctcgggtttacatttttatagttcaagctggctgctgggtggaaaacggaagttggcagaccaaggacagaatcaggcagacccatgtggaagtttctctagtggtctaggtggtggcttgggtagcgtggcagtattggagctggagaaacgcagatggattggagatttgttttggagtgacgccattctgtcttgtcaatggattggcgaaaaaagaggcatcaaagatgagttacacatcattgaagtgagaactagggagatgccagtactttatttagtattttctcagcagctcaatccataaataatttttggaagacaacaagcagtttcacaaactacttataagtcctcaagttccaaggtaattaacgtgggtgtctcattgcctcagagaacacagcgcagcacggaaattctacaagacctgacggacaggaacatctccgacttcttggtaaaaacgtatcctgctcttataagaagcaggtaagaagaaatccttttatgctttttatcctggctccctgtagaagatattaactagggacagaagataattttctctctcaatttatgtatgatcagggcagtagatttttttcttttttatctgatttgagggccccattcaacataaaaagcaattgaggcacatacaagtaaaatgtaacttaagattaattctttttttgttgtttgtttgtttgtttttacatttagggcaagcagtcttaaattttaacccacgtattattaaaagttatatcagaagaccatagaagttattcaaaaatgcagccacatattttaactagttaaaagagagagtaaaaatttggagggaggtggaggagtataggggaaaaggtagaagaaaaagagaaaataagtaagtggcaaaaaagagaaaggaaaaagatagggtgggaaagaggcagcgggacagtgtctgagtccagcacacgccagggcgagccaggtcaactgcagctgtcatattctaactgtgaattatcatctttgatcactgccctttgagatgccaatgaacttttcaagaaatatctagttctcttggctctccagctgttcttatcagccccatccaggatggaacagctttggcagcccgtatcagaacaagcagcttgacaggggcatgccatgccaggagagaggatcctaaggaagcgtggtccagtccgcacaggctctggggctttaagataaaacctcctgtctaactttagtaggactttctgttgcttcacctgccagagccctgaacgagggataaattgacttaattaactagaacacactgcaaatggtgaaagcatttagcaaaacaaagaatgccatccaagccccaaaataaaagcagaataaatagaatgcaataaacagcaaccatcccaaactgagttctcagcagcaaatctccagtatgaaattttggattttgtgcgtgtgtgcttaaaggtggatgacaatgacagttcatgggattgagctctggggtccagagttggcatctgttcatttcccattttgtcattttacccttgattgactgaatgtcagtgccttaactttgggctgtggagtgagtcggaactcccccgaggtgtgcaggtggttgttagagtctcatttttgcagggtggaagacaggagggctgcagccttcattccacactgacatggtcattgccgtgtgttctgggtccagatcaggcatattgacctgacatatgacctgacaacaggaccactcagaaagtccagcatgcgggatatgatttggagagccagtgggggaaatcataggtcctttctctgcatgtgtattcaggcaatgtcccagggctgggcggcttccgcattgcttggatatcggaaaatgcaaaaatgcccctgaagactgagacttcagtcttcaaaatgaatgtttgggaaagaaagttaacggcactgctgtacttgtggtattcattgcattattttattttggctttcagcttaaagagcaaattctgggtcaatgaacagaggtaagaaactatttttatcagaattaaaatctcagattgattcattgttgaaataattgcacacttttaaaaggcacacctcacagccatgaggaggggctgttctgtaggtgctcaggaagtcacaagacacgtcctgaagaatatgtggctagggacatcccagactcagaagacactcagtggtgcctcttcttggaggacataagtgggggtggcattccctgatgtggcgtttcagagcattctcacccaaaaaaagcttctaaaacctccaagtatataacagtttataatactccaacaagagggccttgtagcctaaacccgggacactccttggcccattccttttaagcttcagggagtgtgggccagccccagactcaccccattcctgaggcatcctggaggttgaaatatttccagaggtttagaacctcaccaagtgggactctaggagcctgctgcctcccagcctccctcaggaactgcacctccagaacaggtgcggggctgacatgtatgtgctttcctgggcagattctagaccgtacacatgaaatctggctttcaggattgctctccagagggacctgtggggcctcggctgagacagagagtaggagtgaggcagtgattcaaggccctgagaaagagctcctcctctgcttggtataaccagctaattcattctgttctgttgactttggcttctgccctgcctttgaagggtttgaggccagggagtgatgcactcagactggtgtttccacacagtcacttcagacttccagggcagtacaggagatagatcccagggccagtgaagaagcagagcacaagtccaggcaggagaggctaagggcctccctgaacaggtgtgaggcacagaagccccgagaggtagggatgacaggatgaagatgggtcctgtgctgctagaagtacctgcaaagcacagaggtggcacagaaaaggagtccttggctgggatgggaggagatgacatgtgacatgtgaaagaggacctggagttggctcgatgctcccaaaagggaaaggtgccgaggggagctagcagccatgcaaaggcagagacatgcaggcagtctgggccatgaggagctctggaagtgactcgatatgtccagaataggccactccagggaagggctgaggaaggatgaagttggagaggggcacagaccagatgcagaagggcctcagaggccaggatgagggtttggactccttcctggaggcagcagcagtgggaaaagagttaaaagctggtttgtaaagtggagccatgttgctcgctggtccaggcaattcccccgaaagttcatgtttccctacaaaacccgagagagctactagtaggcgtgaagttcgtggccctggtctgaggatttcctgtttccttgtcaggtatggaggaatttccattggaggaaagctcccagtcgtccccatcacgggggaagcacttgttgggtttttaagcgaccttggccggatcatgaatgtgagcggggtatgtaaacagactggagatttgagtaggatttttgacttgcttaactaccatgaatgagaaactctcatgagtgataacaggaaaaaaaaattaaaaccgtcttgtttgtttgtttacatggtttttagggccctatcactagagaggcctctaaagaaatacctgatttccttaaacatctagaaactgaagacaacattaaggtacttgacctatgtataatctgctctggagctaaaaatttacctgagctggttattttatttttactttcctaccttcattaaattccatccctcctcctgctgaaatctagcaaggaatgtcttccagctaccaaacccttcctgcttctcaaatttcctttccttcactgatttctgctttaactagctgttagtgcagcgtctcagatgtcctctccaccctctaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgtaagccaccacagccccagcctcaccactttcttgtcaccttctccactctttgaacatcctgagaggattctcaccaccgcgaagtgctgatttggatggtaatgctgtttagtcaggcacatatgaacatccgactttcaaataagtgcctcacacttcacataccagacctcttggtcattctttctccccaacatttatgtggcaagtaagtttacatttggttccattcccttttggcttttgatagcaagttgctcctggagcttatacaattattatctttgctatgtgcaaagcagctgccaggaactggcaaagttcagtaaacctttcagctccctcggagtaattatcttagattccaggaatttcctcagaagagcatactttggagatgtcgacagagctttgctaccctcaagctgaggctcttcttgcacagtttcagccagtggagacagtggccttgtgcgttttgtagtatgttcactctatttgaggcctacatggaggaggggttggtaggagcacctttgttagtgcaaacttcagcaacgttgtggggtcctgattttactatcctagcacacgctgagtgccagtgaacatgcccagggtcatccactaaaacctgggccttggctccttggtgtcttcctctggacaccctagggccctagactgtcctctgttaattctcactcagccacactttcgtgtgtctccttccagtcatttgttctaagcttactacgtgtatggatgatatgatctgtagttttatcaaggtagtgactaccacataggatacctttgtggaaattagtaaaaatgctcttttctgcaggtggacactgtcccatgccaggggttatggcttgtacataaagttcaggctggctttagccccaacttacccctcagccagatgccttctatttgtccgaggaaagaataaatagagccaagtccctgtacaacttgcctgccctcttttcacttaaatttacatcatgaacatttccttgtgttacgatgtacttcttgaaaatgtgatttaacaagatgattattaacaaaagataaatctcacagaccgtatgtctgtcaacatagaaaattcaagagactctatagacagattattagagctaatgagagcattgcagtacataagattaatataaacatctatttctatacaccataaaaataattagagaatataataaaaagaaaggttgtctagaaatattcacatgaaatagaaaggcaacccgcaaatacccatttaaccttggtccatatggattaagacagtttagtggagtgacagcttcaaggtagagaagaggaacctggaggccacacctgggcgggtgtaaggccttcccaaagcctgactttgtatcttctcctccttctgctcttccctcttcatcgccctctccctgtgtctctggccctgctgcaggctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcgtaagtgtcagtttacagcgcctccctcccctccgtgggcccaaggtggagcttgtgtgtgctctgaaggaccagaccaagaggggaggggttctcacggtgccagggctgctgaaaggcactgggccaagggccttgtgtatctgctgtcccttgacatcttctcagaaaggcacagaactaggagcccgaagctaggaaaggctgtggggtgcagcttaacaactggtgaacgggggctctctatgtcctgcactgaggggtcttctgacccatcaaataatcactgcaccgcaggcatgagtctggccttcctggcatcagtctggcgctgagaaggtaatatgaaggggtctttcaccccaagtccccttctcaaatcctgccccaccttcaaaagggtaaaggtaaaactttccctgtggtagggtcaccagataaatacaggacacccagttaaatttaatttcagatgatgaataatttttagtataagcatatgctacttcaaatattgcacaggacatatctacactaaaaaaaaaaaaaaaaaaaaaaaaaacctggttgtttatctgaaactcaaatttcactaggcatcctagatttttatttgccaaatctggcaaccccagccagtggccaaaataataagaccttcacttattagattaaccaccgctacagggaaaaatgaagaaaaaatatttattaaatcaatagcacactaccaccttcctgacaaccaaggttggtgggggtagggaggggtcaggatagcgtaccctattacaggctgcagggtcaaaggaattggtagtaaaggcctagttataatgtaacagggatcattatgacatcaaccccaatttattctaggtgtcttgagtagtaaaatctcaacattttaagaccaacatgagcctccatttcatgtgatgataagatataccaactgatggagaccaacacaaatgaccttctcatccatggttttttaaaatgatggtgaatattggaattcctgaagatatgatttctatcttactcagcttagtaagcagctatcacttaacaatacaaaaccagagattatcagtagcaactaaattatttcctctctcttctgtctacacgaggaaacactcataaatgcacggggaggaggtcagaacctgaaagcctttctttggataagagcatcaactgcaggtaccacattggccctgtgatgctaatataaaaggagctaggcccaccggtaccgaaaagttacttagaaaagtgcggaggcttttaattttactttttttaaaagataagaaatagaatttacacacttggggctggcccacgtgtttctgtgtgtgtgtatgtgtgcacgcacgcgcgtgtgcgcttacagggatctctgagcctatggagagagatgtagctaggatagagtggacatctgaggtgggaggtgatactagctggcagtccaatgaaggggtagaagatggtaggcatcatgttagcaggctttctgatgctccagaattttaaagctggcctggaatctcacctccgcgatccatcattttggaacttaggaccaccattagccagtggcaaaaaaaaagttgaatgaaggaacaaacaattattgcttatgtaattcacttagcacatatatgatgttttaaattcttatatgtgtcatctatttttctttactttaaaattttgcaacagttacagacttatggaaaagtcacaagtacagttgaaacctttttttcttagtcatttgaaagtaacttctcagcaagatgccccttctcatttatttctctcttcctgtctctctctctcacacccctcagcacgtccgatgtatacttcctacaaacgaggatacaccccatacaaccacaacacaaactgtcaacatgaggaaaccagcactgatgtgtcatcaccacctaatcctcacaccccactcctctttcgcccattgccccagtgatgtctttcagaaaaaaggatctagctcagaatcatgcatgacatttgattgtgctgtttctttagtctcgttcagcctggaagagttccacagtcttttgttaacactcatggtcttgacactttgaggactgcaggctggttattttgcagaatgtcccttggtctgagcttgtctgaggtttcctcttgcccaggttgagggtgtgcatcttggcagcagtatcagcaaacagatgctgtgttctcactgcatcctatcaggtggcttctgatttcaatttgctctgttactgatgatgttcaattcggtcacttaagaaggtgtctgctgagcttcttcactgtaaaattactcttttcccctttataataaatacaaatttcaggtagaggcacttcaaagatatataaatatcctattcattatacaattttccatttattcatccatttatttatctctgtatgcagtcatggttcatgtgttaatcaatggactatgatccaagactatcattatttattttgatattcacattatccccactgtggtcagtggggggccgttgaagctggcttctgtatcgtcttgacttgggtcctcatgcccctggacctcctccatgctcaatggcacagcaagatattccaggctcatccttccattatccccattcctaccctctccccaagaagccctggttcctgccagtgggaagtggccctcagaagccaaggtctgagtgctagatatgttcattgcctctggagcaccattggtcccaggccttctcagtgatagaactagggaagatatggatgtacacacacaggtatgcacacacctctatctatagttctctatctacctatacagtgaacactatgagctctccaaaaccaactccacagggctcattctagttttttttctttccacatctgtaactcccttctccaacagtgagacgctggcttctctcactcccaactcatttatctaccggacctatacacctgaacagtgcccaactctgccaccatcccctccccatgtggatgccgtcctctccctgctccagctgcctctgctgcatgcaggtcctcctcgttctgctctggctctgataccctgcaccagatcagcctcctgtaaggatatctttctcatcccgttgaggcctccacaccccacggcaggttgccccctgaggaagcccgtctctggttcttgccctgctcctgatcaccatggctcctcccctaaccccactgttgccgtcccctttctgtgcccagtatagtggctgtaggactaaattgtttaaaaagggtatcattatttatttgagctttgtgaagccaagaactaggctttaagtttttctgaattctgaagacatgcttagaaagaagaatcaacaaaactttatgaccaaatagaaagagtgagagaccaggcagaattttgtaattgatcctttcaaaagatacaaactaaaggttcccttggcagggaggtagggcatggggtggggtaggaggactagtgacagcttaacatatgtttgccaaccaagaactgtttaaaaagcaagtcgaatcagaatcccagaccctacgagctggaggagcctggccccacccctcattttgcagagctggcagcaggtctgagaggttaagtgacttgctctcctcttctctttccgagatgaattattccgtgagtgctgggctggtggtgggcatcttcatcgggtttcagaagaaagcctacacttctccagaaaaccttcctgcccttgtggcactgctcctgctgtatgggtaagccgtttgggccattagctaatgcctctgaagagaagcctggtggtgggggtgggggatcatctcctgacagaaaacctgggctgtcctgtggtggtagcacccacaagtttagcttccggccccaggtagggtctgaagctgataaccagggatctgtctggcttctgattctgactccactgacagaggtatctctgaggcctggtcctgtcagtgacaatgagagaagtcccacatgatctgaatctcctactcaaactgaggccttgaccaaagcctgggggcagccattccccaacccctcacccagctctgactctcactcatctgtggccaatctgtccacctcagtgtccccatgtgaactggccaagagttaccgcccacagtagaagactccggccaaaaagctcctcctgagtcagggacagaggatgacacaggggttacatcagcagagttacagggcccagcatgcaactttctttcccacgtgtgtaaatttgaatgagtaattcatccatctcggcctcagtttcctcatctgtaaaagaaaatagtgatcctggtccttcctctgtgggccagtagagccttgccaaagcattgttctccacatctttctcttggaaatagagaatttgggaaccaacctgactataagctgtgaagatgagctcactgggctcatctgagatgacctcagctgggctttgctgacccaggctagagtgggaggtgttgcaggctggagaaccctcctatgaattgtacagggctttgtagtttacagagtatatacacagctagcagcccatttgctcctcacaaaaccccatgaagtggtcaaggcaggcatcattatctccatttaaagttgaggcacagagaccaacaaatggagtatctctctggtcccctgggactctggccagttcacacacatcacctcaggtgtaaggggagtgcattatatccagacgtattgtaggtggaatggaatgtggaactccatcactctgagttgtctcatttcacacagatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccgggtgagcataactttcttggcttttttgtttgattagtaggatagtagagtatgtgttggtcgagcagagccaggggcaagcatcgtacatgtagcagctgtatgcggatgagtgccactttcttcctccctacccccgaccctgcctcctttccttccttccttcctcccatccttccttcctctttccttcttctcctccctcctccctccttcccccgtccctccttccttcctttttcattgcttccttccttccttcgtccctccttcccttcctctttccttctgccctctctccctttttcctttcatcctccctccatccctccctccatccttccttctttcttccttctttccttcctataagcacctttttcatttctgtgctctgaatgaaatggttttctgtgtttattctgcaagcaaaacttgattcttgcaataaactttaagctttgcttactctttcagaaaggttttctcagggactttgggtgttgggttttacacacacacacatcaatacatttgggtaatttcaaaatctaaaaggaacaaaaaggcatacaatgaaaaaatctccttcctacccctgtttcccactcatgcagttctcttctccagaggcaaactcttacttgagtttcctgtgtgctctggagacacatcagcagatccctatacggtctttctcccgctttcttatggaaattgtaacactctgacatatactattccttgggcaagttaatcttgatgaagagactgggtgttctccatgctgaatgcctcacttttatgagctgccaagcccagttgtcccttccacctgacctccccctgtccagagacagatggccaaactgaatcataaaaagagggggaaaaaaagaaggcagtcgctgcagggctgtctttactccacactccacactcccagtccccaccgctgtgtctgagtcctggctgtggctgtccttggaacatttgcctcaccacgtgcctgtgtccccaggcgcctcaacctttcctctcctcattagctcttcccagttcagagggtgggaccggccagcacatctgcactgctgccctgccacacccacctccacctgcctctgggccccactggggaacacaggacaaatctgtgcggaggccccaccatgaaccgcccagacccgtggacccctgagactgactctttccagatcttgttagggtttcgtggctgctaggcaagtaacgaagcctcatctgtcccatgaatgataagaaattcagcatgtcagagtcagactctggaaaggcggggggataagaacacagccccagcagatggccagagcacccaggtgactgaaagtgctgctttgcagagctgtgtttgccacaggctcacagcccactaagtcttaagacagttttccttcagaataattaaatagccagcttaaagcaactcagaacattttcccctctgaggctgcacccatttagccaacatttgctaagcacccgccttcaaaaacctggtattttcatgtaaattatccgatacacagctgctatggaaacccccagtatcccacaggaagctccccagctcccagcagctgccggcccgtgtgagatcaggaggtctttaccagctgaacaccacgtgccgggtgtgtgctgatataaacaagcgtggcccactcgtcctgccctccagaggctcccgttccagtcggaaaaggacctgcccacgaagtttgcaacgatataagccacagtgtatgatcctccataatacagcgtgtgacagagcagcagaggagcgaggcagataacatgctgcaggccagaggcagcgggaagagccaggctgcaggggctgggggagccgtggtggaggaagttcaatttcagcctgtagatttctattagcccatttaataaataatgaagtgcctactctgagctaatcattgtgcaggtatttaggaaggacaaaaaaataattaggactcagtgcccaccctccaggggcccactgactagtagagaaagtaggcagatttttaaaaaattaatcatgggaatgtgataagtgctgggagagaggaatggatactttctcatgggaatcttggaaggcttgtaagggaaggcactctctgagccagctgtctaaagaagaacaggaatctttaagaaagcagaagggaaaagagcattctttcctgcttggagcaataggtaacagcctgcacatgcccaggcctagaggccaaagagcacagtgattccagaaagagtggggagaaagggtaggcagggaaggatgaggtaatgtgggcgcaggtgtggaggctggagagggaggaggttgtgggactgggaggagccagatggaatggacagcagtggcccagccaggagctatgctggcctcgtacgcctcgatgtcccttctattttctcaggggaggctctgcccaacatgccaagtccgaccacttgaaaacaagtccctggcttaacacagaccccagagagagtctccaaccctcctctccctagacaatggtagttgccctgtgaggggctgaaaagcagagctggagatggctcagggcctggtgttaacaaatgccttgagggctcctgttgtttcaaagtgagtctgcagggagagctccctaagtggacagcaggagggctgcagcttctctgcacattcctgctgtcacccccagagtcacctaggggaggggtaaggacagtaatgcaggttcctcacagttagcctcggtgcccacatggtactgagcatagtaaatgtttagaagatgctgcctggctagacaaaggggaagctcccgcccactagaaacttgcagggagccccagtccttgattggtcatttaattgattagctccttggcctggccttgaggcactgcttgtaagtacttcatgacctccattgcaaacccatgatgctctgctggacaaatccctccagtggccagtctggctgcaaggactctctgtctgcaggccttgccctgtgctgtcctgtgagagcatctgggccccacctgctgaagagagggggggtggggtttgccccgtttccaacagtcctacttctctgtttcagacgctgctcaggttcaacgccgtgctgaggaagctgctcattgtcttcccccacttctgcctgggccggggcctcattgaccttgcactgagccaggctgtgacagatgtctatgcccggtttggtgggtggtagccgaggcccatggagcatgggccctgggtccaaagctgggagggttaccgggggggctcctgcatcagactgtggcaggggctggtgctaggaggggaccttgttgggctggaggtgtcctgccagctggagaggattagggtgcctctgtttccatggctggggagccacaggagggatggagggcagcccttatgaggcgggtgtttggctcttgctcagttcccacataaggcctggtctagtgggccctgtgctgtggccaggtctgtggggtgagctggggcggctgaagtggactcaattcctgttgatgcccaggtgaggagcactctgcaaatccgttccactgggacctgattgggaagaacctgtttgccatggtggtggaaggggtggtgtacttcctcctgaccctgctggtccagcgccacttcttcctctcccaatggtacgtccatgccacaccctgggccagtgggcagctcagggcatccagaactggaccttatacccacatggtcatttctttcctcaggagccccactccacaatgttttttctacattctcaaagcctggcttttctccaataatacaagtagaggatcgggttaaaataggcacattcaaatatgtgaagagcatccactttaaaatatttaaaatgcagtgctattaatttcaattgctgatatttaatccttctcatttaattaccaaatgtgtattttgattagatgatagtattgcaaataacaatggttacagggtatccaaagtactaggaaatagactaatgtatttatgagagaaaggacacagcaggcccctttgctaattagagatttgggagcatgggagtaatatgggagccatgtggaggggtgcgggcagtgatcacgaccccccactcctggaggaaggtgggtagctgccaaccctgacttttgaccagggcttctcaaatgccaggttagctggcaattgccattcttccgcaggctcttcctgaagctgggtgggcccctgcctcactcccctctgcaatccagtcctacctttattgtcctcacccaggggcctgaattgccaagcagcagcccttcctagcaagctttccccaatagtgttttgtttcttaacttttcctcctctcaggctgagtgtggtcacctgtaaatagattccaaggacttggttttatgttttgatccacagggaattgatttattggaaatgaatctgcctttctactcacaggactgtgagaggtgaatgagatcacaggtgtcaacacacgcctgatgaaacaggatacacaagcagttctagttatgggagacagtgtcaggaattgttgtccttggcaccctcagcccctgcagaccctttctgcagccttggccataccttttagaggcttttgtgtgggagagagcaggtcaggaggttgactacccaaattgactcattagcttcaaactctgatgtcaacacatttgaatgagtcctgcctgctttagggcctaaagaggaccagagaagtacaccatagtccctggcttccagaaggtcagggagggtttcaaagaagaggctgtgtctttaagaatggggaagattccatttggtggggcaggaggaggagaacattgagggactggaaacacatgcggaggctgggagacgggaatgaccaataggactgggaaccagggggagatgccaattgctgacagaggagttagtgcaagaggtaagtgagaagggtaggtggggctggattgcagggctgtaactacagctgcagagggagggcttcaacctacagctgatggggaacaacagaaggttttgaggcatgaggtggcctgatgacaactctgttttggaaaggtggagttggcagggcagactggaggaagtgggaggctcggaggttagtaactaccccttactgagtgcttgctgtagaggaagcattttagtcctgacggtgatcccaggccctgagtctttactctgtgccaggcactgtgctgagttcatcttcagcacaatcctatgagacaggtattgttaccctcctcctcatcacatggttgaagtaggcaaggttcagagaggtccaatgcccaagatcacacatgaggaggccaggactggaacccaaggctgactctggacatgagcacctgacctctctacctaatgcctaatgcctctcctgctgggagccctttttagaatttaagtcttaaaggatggaagcccagaaggaagcagaagcaaggaagtggaagagaggtcccatggaaaggacagtgccaaggacactgtacagccagcccaatcctgaccccttttcttcatctaggattgccgagcccactaaggagcccattgttgatgaagatgatgatgtggctgaagaaagacaaagaattattactggtggaaataaaactgacatcttaaggctacatgaactaaccaaggtaagggaatgggtatgagtttggaggtgctggttagatccacagttggcatgatgttgccattttccttctatagaacaattgatatgcttatgcaagcaatttggttcccagttttatgtagggtcatcatccctgtgttataactcgtcttccaagagcatctaattccaatgtgtgttccctgctattcatctcgggcactgacacagggcctcagtgagaatcactccagctgagcatcattcccttttctgtgttctgtttctgcagagcatgggtcagcctcgagatgtctcagtactcaccacacctctgtgcctgcccatgtcaatatgtaacctcctagtgctggtagttttctcctaaaccatcctttgctctttgttccctcttcccctccttgctctcaccctgtctcagttctcagtccggtttcttcgtatcttgcagatttatccaggcacctccagcccagcagtggacaggctgtgtgtcggagttcgccctggagaggtgggtactctgcagaccacgtgtgaaaggcttccgaacatcagctcttgtgcctgcctctcctccccataaggcagagctattcaataggaacataatgccataatgcaagtcacatatgtaattttaaatcttccactagccacatgagaaaagtaaaaagaaaataggtaaaattaatttcattagtattttttattttactcaatataaccaaaatattatttcaaaatgtaattaatagaaaaccttattaatgaaatatttgacaatttctcgttgtttttaagtctttgaatctttacactcagggcccgtgtcaactgggacttagatgtgtttcaagtgcttagtagccacatatggctcgtggcctctgatggcagcccaggtctaaaattcctcccccagctcacacacacacttaccctggggcctgacattttagaccttcttgatctctagggccaggctagctctgtgttttctcctagtgctttggcctcctgggagtgaatggtgccggcaaaacaaccacattcaagatgctcactggggacaccacagtgacctcaggggatgccaccgtagcaggcaagaggtgagtatcctgctcctcctgtctcagggagtctctcacaggtcctgtgagaagaataggaagggtgatcatcagaccctatagtagggtggctctgaggccctgaaagatctgtacagagaaggaggcctcccagagagcatggcccaaaaagcccaacacatagacccaatggaaaagtgaactgaattgtgatagttaagagattcctctgttgggatggattcttggaaagacctgggaagcactaagtgtgtggttcttaatctcttagaggtcacggaaccttttaagcatctgatgaatatttgtagcctattcctataaaaatgcaccattgcttcccattacctccctccacacatttttacaaaacgtttcagggagtttactgagccccaggtcacatttatgatcctgcaggagctcttgaatcccaggttaagaacccctgtgatgaatgaagaatccttcctctgggttgagtttctagataggggctcatgcatgggcctttggggtagcctaacctgcattggctatttgtaggctgatatttggctttgccagaccaaggagcatagagggaaaactggcgtgtgcccttggattctggagggtgactgctgctctctgtaataaaatgtgtttaaacagactggtcccctatgggcaggacagagaggatgagctctcactcatctgcctctttcctggctgcaggaaaagcttgaacagtaaaacttcagcacacacaatagaggtgcccagaggaagcctctgccctggtttataagtggagttaggtgctgctgacatctgtccagcatctgcttgactggggcctcttcctctctcctgaaagccatcctcagcatggcccaatgcccagtgggcaggacgagtcctgagcacgcttcactggctcagacaggatgaatttgattctttggcctccatagccagccctactgggtttacagaaaagggacaggcaggggtgaagccaggtcatggctgagtccatctcaacagatccagcttcacctgcaagtgaccacgcaggtgacttcctcatggtgacaaaaggagtcatggcagggtagagatatcataccatggcaggggaaagatatcatagaattttccatgagcacatttatgagacatcaagttacaactgtgtccaagtgaggcacagtctgacatccagaaggtaaaactgagctggacgctagaaagaaactataggcttaagacacagaattgggattatatggtagggtagctcccactaatttggaaacgtaccctacttgcttccctgagtagttttaattggcccagccatgcctttggtggcttttgtcattgtggggaactgtaatggtctctctgtaccatcctatatcatccatcctttattcatagaccctaagctataagaagaaaaggatgagattagactaaatgtctatgtatagtttattttccatcttggcaatatattttttagtgggggtgaatatattagccaaagggagttggtggaacccaactcactctacccctgctccctgcaggcctctcgctgtgggtagttatctgactggctcctctttcattgctatctttgccaataaatacagatagagaagtttacttccatcgggacacatgcatcttttctagttacttcccaaatgtctgaaaattattgataaatcatgaatcattttcttaaacctgatcttccctctgtttttaaactcacatgtgaggtgatctgatccaaaatgaaagctgacttttggcgtaacagggattcaattaatcctagacatggaaacatggaagaatctgacaggattcagtttctaaccgaagggcccctgttttgattcccaaatatcccatgcatttctgaagccaaataggagaagagaagaagcagcttccttttcccgttggcagaagcttctccagccctagctctatggtcatccctccactccttgaaggatactcagtaattgctttttttcttgcagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggtgaaaaatgttttgttgtggccacataggagtctggttaattacaagcctgtttcatgagagtgcattctcttggagatgagaaactgaagcgtgctattcattcattcattccaacaaatgtttactatgtgtctactgtgtgccaagtactgttctagaaaccaggagtatagcagtgaacaagacagacaaaaaaaaatccccactctcatatctaacaaaatgttgtatgcatttatcctctgactcagcaatcacacgtctaagagtttatcctgaagatgcatctcccacagtgcaaaatgaatatgtataaggtgatccattgcatttgtaattgcaaaatgctggaagttacctaaatgtttagtcattgtagattggctgaataatttatggtacagacacacaataaagtcttacgcaactataaaaaagaagaagaaaagtctcagtaaactgatatggagatatttccagtaaatactgttaaatgataaaaagcaaagtggaaaacagaacatagagaacgctactttgtatgtaagaaagaaggaaaaacaagaaagtaaacgtatgtctgcttacctttgcaaatagaacgtagaaaggataaaccagaaaacaatgaatttggtgatcaacaagaagaaaatgggaagaaagaaaaatgggaggaaacagtacttctggggatatatttttgtatagttttaatttttggaagcatgttaatgttccacatattcaaaaaaaatcagtaagaatgggaagtaggcaaaaatgaaaacaaaaagaaaacctaacactgacagcaaactaaataaagtaacccaattttatttcaaataaatatcataatcttgcaaaagggggatagagctaacacaaacaactgctgaacacagtgtttgactctatatcctcattcttgggcagggtggagcgggggagaagaactacaaataatttctgagttctttttagtttgttttttatagtggtataggcaaagtgattctgaaaattttagatgtgttacaggattaaataaattaataaatgttttgatgttattgggacccagaattctcaccgtggaagaagggacttacaaatatggaaaagggaaaagcaagaaagaactgtgaggtcatggataggaaccggaggtagcactgggaattcaggaatatttatatgcttgtgtttgtgggtgcatgcagatgtgttcatgtttcatgcacataggcatgtatatatagacatatatttgcatgtgtgtatctgtcttccgaaaggctcaagaagcaaaaacaccccagtagccatgagcacacttagcactcaggcttttgtcttaataacattccccactaaaagtaaccctgattcctccaataaatgataagttccagggctggaatggcataggtataaaatgaacctggaatatcttatgccagaaagtaaggaagtgcttttaaaaaaaaaataaggggctgggcatggtggctcacacctgtaatcgcagcactttgggaggccaaggtaggaagatcgcttgagcccaggagttccagattagcctgtgcaacatagggagaccctgtctctacaaaaaattagcaaacaaattagctgggcctggtggtgcacgcctatagtcccagctactcaggtggctgaggtgggaggaatgcttgagcccaggaggttgaggctgcagtgagctgtgatcaagccactgctctccagcctgggaaacagagcaagactctgtctcttaaaataataataatataattttaaagaaataaaagtaactctgtacagattgcttattggttacatgggagaaacataataattttacaatggagaaattagacagcaccttaactgggtgatcaaaattaaccataaggggcagatggacatctcatgccccgagatgtgataccctgtgaaggacacaatttcacttatgtagaatccagattggagatatgtaacctgaatcttatcatgaggaaacatctgacaagctccaaagaaggaatattccttaaaaaaaaaaaaaggagactgtattcttcaaaaacataagagtcataaaagacaaagaaagagctatggaaatatctctgatcgcaggaggctaaacaggcataatgactgaatagcagacaatagactacatcttgtgcagaagagaaaaaaaatgatagaaggatattattggaccaactgacaaaactgaactatgaacagtagattaggtaaatgtatcataacattaagtttactgacattgataatgtactgtggttatgtaagagaagatctctattcttaggaaatatgccctgaagtatttaggagtgaagggctgtgatgagtaatttaccctcaaatgggtcacaaaaaattgtgtgtgagagagagaagggttttattagttaataattctatgaactatttttattcctatatgtttgtgtgagtttgaaactatttccaaataaaaagttaaaaatggagattacattctagtgggagggatagacgatctgtagataaataggtaaaatatccagtacattagagagtgaaaagtcctcagggaaaagtaacgcagggaggaactgctggggcagggtttgcattttgaggtagggtggcccagggagagcctgcagaggagagaacctgaatgaagaactagaggtgagagaaggagccacgtgcacacctagggaggaacattccaggcacgggggactagtatagaaggcagaagcatggtgagcttgtctccagtggcttccctagatcccctcctgcgcatgtgcacacacacctggtgtctctgtcatcgttccctcacagcactgtcacgatctgccagtattctgtttattttgactgccacctccccgcagtctgaggatagcagcaatggctgtgttcacattgttctccagtgcctggttcagtgcctggcgtatggtcagtgctccataggtatgtgtcggatgcacaaggctttgggtgtaaccctcttgacgggtgggatcaacaggtctgggactcaccatcttctcaaacagagccttcctcctccactgctagccatggtccaggacgctgggcgagacccactgtcttgctctttgtaaggctgaagtccatttcccaggcggctacacccaacagatgctgagcaggctgggccaccctgggatccaagacacagagagaaagagcccctgtctggcgcctgaagcacatgccagaggacaggagccagcaggagcctgtttcagcctagctggggatttcattctggaggcgtgagatctgggagcccaaggctttgaactgggggaggtttggggtgtttgcttgtcttctccaaatggcatttctttctcttccctaggttgcaaactggagtattaagagcctgggcctgactgtctacgccgactgcctggctggcacgtacagtgggggcaacaagcggaaactctccacagccatcgcactcattggctgcccaccgctggtgctgctggtaactgcgggcttgggccgcaccaagggcttaaaccaagtgctgggtctcttgggttggggaaataggttctgggtcggcagatttagaaactgcagcagtttggctttagtctggactgtttcctgtgttgctcattttgagcgatcagcccagtgtttggttcacacagctccggagaaaaacaagtcacggcacagccttgacttgggactgcgcacatcctgcgttcccaggatgtctcctgtggggccatcggctcacagccgggaagttcagcccactctgcggcctgtcggtgtctggtccccatacaggagcactgagctgggtcaaaggctcctgagctgagccaggccaggcctgaggccatgcccacgcagcccaaggatcatgagggcacaggacatagcgggaaccaaggaagtgacctgagtgacctccctgccttctgacaaatgtatttgcaggattttctttttttgaggagaattctgtcattgccttaatccactttaatcccctcgtgggctgaaatgggcccaggatggacgccacgcttctttactcttggatccacctcctgccttccctaccctacaccagggtacccctgtcttgctcaagtgaggggagtgactgtgtgcgccttctgtcagctcatcctccacaggggagccagcccagggggaagcagtaatcagaagggccagctcccagcctgtgcccccaaccttctctccaccccccaggatgagcccaccacagggatggacccccaggcacgccgcatgctgtggaacgtcatcgtgagcatcatcagagaagggagggctgtggtcctcacatcccacaggcaagagattcccagggctggggaaggtgggtgggaatcctctcctgctcacctcctctctcctgccccacagcatggaagaatgtgaggcactgtgtacccggctggccatcatggtaaagggcgcctttcgatgtatgggcaccattcagcatctcaagtccaagtaagcagatggtggggcgtgccccttgttgccttctgtggatccacctggatcctgtgttctccattgacacttggaagagtcctgctgctccgtcatcccctggggcagaggcaggtggtggctgggcctcattctccagcagcagatggagaaggccatcatgctgataagaaactcctctatattggcctaatttcctgtggtcgaagactcgcccaagtctctggatggggcatctgatcaggatgcatgcagagcctggctgggatgagggagggctgctaccactgcctcaatatttcaccacttatctcaacagatccgggacctgtggcctatttactaagagtccactccaatgtaggaatggttaggagaccaactgacttgaggacccatctttgtttttagaatattgtatgcttttgagtttgaaaaaagaccatatgttatatgacaaaccaacaatggcagtaatcttgaataggattatccttatcctgtacccacacattgtaaactattgtagataattccttattattaagagtttgcatgccaaagctaacagtttaagattatcagcatattgccgtgctcattcacgttctgatatgctttataacctagaaaagagcagagttacaattactcatttatttaacaaacacttattaagagctcagaatataagtcactaagctggttggtgggaggaacagcacataacccaccttatctatgctgaggtgcataatcctgatgcacccacaggagggtgttacacagaagatgtcatcctttcatatgtgtcagagcagataaataattgagagaaaggtctaatagattagctgcttgtggcaagtggacgtttgacccatgatttattgagcaactacaacttggacactgcatagatatctatagaaatagcagcatgtcaggtcaccagacctgtgtcagcaacttcctgtgtccaactgctggagaaagggaagtctcctattcctttccctccagctccttaatatctccatgatagagggggtgagaggggagtgttccctgtgtggagggatggtgagttttctggagctgaaaggtaaacagcctttctcctctgcatcttactgcagaggagaacagccctagactgtggaggaagctttggagtcagttatgactgacacaggataccagggcatagggtactgacacccgctagccgtgcacacactctctggtggaccatcactcatccaagagagggtaaccagccatcctgctgaaggagaaagaaagcaccaatggcccaagccctagcagctccattgtttcaggaagcttcctcagggaagtgctgccttcccgagcctttgctcccacctggcccatcagcccttaccaccactcagtatgcactggtccacgtgtctttatgggcagtcttgggatccccacactgggctaaaactacctttgacggccaggtgcagtggcttacacctgtaatcctatcactttgggaagctgaggcaggtggatcacttgaggtcaggagttcgagaccagcctggccaacacggtgaaaccctgtctctactaaaaatacaaaaattagatgggcatggtggtatgcacctgtaatcccacctactcgggaaactgaggcacaagaattgcttgaactcagaaggcagaggttgcagtgaatcgagatcacaccactgcactccagcctgggtgaaacagcaagactctgtctcaaaaaataaaataggctgggcgtggtggctcatgcctgtaatcccagcactttgggaggccaaggcgggcggatcacttgaggtcaggagtttaagaccagcctggccaacatagtgaaaccctgtctctactaaaaatacaaaaaaaaaaaaaaaaattagccgagtgtggtggcaggtgcctgtagttccagcctctcaggagactgaggcaggagaattgcttgaacccaggaggcggaggttgcagtgagccaagatcatgccactgtactccagcctgggcaacggtgagactgtctcaaataaaataaaataaaataaaataaaataaaataaaataaaataaataaaataaaataaataaaactacctttgacttcagcaagtacgattatcccacattaccatgcagacatttgatctctaaaaactggtatcaaatgatttctccagggactaccatggtttttctctcctagttttcagtatgtacacaggtctatggtatgggcctttaatccccagtatttctttttttgttgttcttgtttgggtttgtttcttgtttttcggtttttttgagacagggtctcactctgtcacccaggctggagtgcagtggcatgatcatggctcactgtagccttgacctcctatgctcaagtgatcctcccgcctcagcctcccaagtagctgggaccacaggcatgtgccaccatgccctgctaattttcgtagagacagggtctttcttgttgcccaggcttatcttacattcctgagctcaagtgatcctcccacctctacctcccaaattgctgggatttcaggtgtgagccaccaagctgagcttaatccccaaaatttctgatgagtctactccttattttgggattaccttaggcccaaccactaacagaggcctgtcctgcactgtgtgcatcccctagatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggcaagttggccctggggcaccgagagctgagcaaagactggtccagaacacccagtgtgggttggaattgccataagagggaggcataacattcccgatttttaacaaactcttgccctctgtttattggggtaaaagctgatatatcagaaattgttttctaacaatattttttagtcatcaggaaacttcattgattcttttttttacattttccttccctgtgatgctatggtgtgttatttcattcttgctcgtttgtggtggtggtttttccttcaaatcagctttattgatgtgtaattaacatacgatgaaacacaggttctttgggaggccaaggcaggaggatcacttgagcccaggagtttaagacaggcccatgtaacaaagtgagactttgtctctacagaaaaaaaaaaaaaaaatcagaaaattagccaggcgtggtggtgcatgcctgtggtcccatctacatgggaggttgaggaaggaagattgctggagcccaggaggtcaaggctgcaatgagctgtgttcataccactgcactctagtctgggtgacagagcaagcccctgtctcaaaaaagcaaaacaaaacaaaaacacctattttaaatgtacagtttagtgagttttgataaacgtgcattccatgtgtggtttttaaaaatgtaatcacattttttattgcggtaaaatataataacataaaattgaccatgccaaccatgtttaagtgcacagtgcagtggcactaagtacatttacattgttgtgcaaccgttaccaccatccccgatagaactctttcatcttgcttcagtgaaaatctgtgcccattaaacactaactcaccacttactgcccccctcgcccttggcaactactgttctactttctgtctctaaggctctgactactatagatacctcatataagtggaatcatacagtgtttgtccttttgtgtctggcttattatgcgaggacttagcataatgtcctcaaggttcatccgtgttgtatcatgtgccagaatttccttcctttttcaggccgaataatattcctttgtacgtatatgtgctacattttgttcatccatctattcattcattgatagacatttgggttgtttctgggttttgtgtttttatatatgtttttttaaaaataaacatctttagagacagttcagtaaagcagtggaaacagggaagtctccatttaacccctgaggatctggctcacctgcaccttctcatcagcattaagcagagggaggcacgagcaggagccacctgcacactcaatgaggagctgaacagggatcaattacctttttttttagttattaggatgctgctagctgagaatctgccttgccttgattaccccaatgtctggtgcccaagtcccttgagtcctccagcaggaactcctgtggcatcactcaggagtctagtctaagaagctagctctgaccagggcagtggtggccaggcttctgtgagtgggccagcctcccccgggtaggacacaagccataccagcagggctgtatgtgaactgtggaaaatagagagcaaagtgggtaggtgggtgtagggtgctgttttcctggaaatatctacctaatctcgctcttctcttacctctaggtgtttgtaaattttgctaaacagcagactgaaagtcatgacctccctctgcaccctcgagctgctggagccagtcgacaagcccaggtacccctgctgcttatgcagtccacagcttgaggcagttccttggctcagagcccagctggttcactgggcttgagttgctccaaggctcagatatgcctcctacagagagccccacccacaccacggtccctaccaagtccccaccacatcctcatcacatccttgctaagtccctgccactgtgtgttctgtgctgaagaacttttcattcagtagttgtaggggttcctattgtaatcaggaaaccatctggatagcatgggagagcatttttgaaaagaactttcccatgtttttgcttacagcaaaaaagcttggatttggggaataaggagcagagaaggtaatagagaatattagaatgttttgggtgcttgacatctatgtctggacatgtgtttgagtttcaagggaagggacttaactggcacatcatttcagtgtcagacacatttggttagatcaaggaatagcatctgttgtaggaagagggctctttgttctttataaaaattacaagaagatggagaaagaagcaataggaggtatgtctcctggcttgtgataactcttggaataggtgcttgtaggttcctgccctggcacagtgccccatgtaaggagcacaccacccaagaaggagagagctagagcaagtactggaggaggcaccagcatcccaatgccttggcttaagcctgggattgtagagggatgaattagccactctcttctgacttacctggagagtaaatcaaatcaaatcaagaagcaaggatatgcaaaaaccttatttccccataaagtttttattctgcccagtttctggattgcaagaaaaaccaaatacagctaatgattgaaacactgctgtctaaagcagtgcttgtgatgaattttttcccttcctcttgaccagcagagacctaatggctacttggcaaaactgactttgtcttcccaccccttacctgccagagggcccagaaatgcctaaggctcctttagttacagaaagtttgcttttactgagatcttccagccactgattcccatttatagatctggtgattgctgttgacatcagttgaaaattatttttaaaaaccacttgcagttgcaaatcctttttataactctgtaactcagaatatagaattgggtagcaaaattgtttcccagaattaccaatggtctccccacccctgcctggcatgttccctcttaaaggactaatcccaccacatcacctctgggccaggcagaacatcaggggtgctgatgttctgtgatctacagcagttaattccaaacttttctcccttattggatgagatcatttttctattgtgttttttacatttttgttcacaaagattagaaaacctgcaacacacttattggcatatttttctgataattttcatccaaaacctaattctgactttacaacatactatctttacaaaggtttgcaaaaattctttcatatagcattgtatatgtctgtcatgaaataatagtaagtatattattgtttacattataccacttcaaaataatttcctttaaagtattcttcaaacaagaaaaaggcaatttctctcaagaagttttagagagaatttacaacttgctcctaagcaaatgtgagaacttcaggaggttcatctggccattggctttacaactccaaattgtgagccaggaccacacagatatttctctagaaatcagcgtttgcttaccaagaacatttttactctccaaaggactccatcctggaaaacatgttttgggataaggtcttatgcaatcttatactctgttattaaaaccagtgagggtcaaggtgttaatagattaagtagtgacagatgatcagacaacttagaaacatcctaaataggttaataattatgtgaccatcgcatgtgcattcccaaattaggaacaactcagatcaatttctaatccttattcttacactgttccagttcccccatataactcgtatctttgtgttagtttcagaagtttctgaagtaccctcagccttgatggggatcctcgcaccacctcaaatcctgttctcagccctaagaactgtgttagtcatcctcttaagaggatgtgtgattttaaatcagataatgggataaaccacatttcgtctagactggtcaggcctttgtccagtcccctcctcgcccacactaccccagctccacagcgggcattggttcaggaattcaacccacactttataactggagacagtatctctccagttaaaaaggtcaccttggtgtccgcttctcaaggaacatggacatctttattaatcaaagcccaagctttgatctggagcctaatatcctgcactccagctctcatctctcccctcccccagtcacactttcatgcttcccagagccacccctacaggaagtggtcaagggaattctatacctcagggctgacctaaattaggatttcttggcttttaagataatggtaactttcttaagctaaaaaagccccaaaagaccctgtaagagcccttggaaacagcaccatgggtgtagcttccccccaggatgtaagcatgtatgcacacatctcgtatgtgtgtctttgtaacaaatgcctggatcttagtaccagggagacctgattcatagatttcatagagaaggagagaaagatggcccataacctgggtgatctgacagaatcacagtgccctcagctgagtgcccttcagaaattgattgacaactgtttagcttttgaaatctaaaagtagtacagcatctcagaaaaccaagatgacgcgagtccatgtgatctccttccacaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaa

SEQ ID NO: 34791 - DNA, 21136 bp, Homo sapiens
tccttcttcattctgcagttggtgccagaactctggatcctgaactggaagaaaatgtctatccagtaagtatctctgggagacttttttaaaacaccttcatggattcatgataaatgtgctatttcaagggctcctgaagagaaggcattgattaatgacctgtttaggaaagacccttgaattttggtggggaaattttttcctgcttatgtattaaagcaactagctagaattcaggtccaaattatggggggtttgtgtgacttagcccggggtttggaagcagtcttgagtatggggatttcagacagacttgggctccactccttgcccagtcatttcctagtgtgtgactttggacaaattacctaactttttaagtctagcttttcctgtatatagaaagatgtcacaatagcttttactccattatgttactgtgagatttaaaagagataataccatgcaaagttctttttatggtatgtaggacatagtaattgtttagtaaaaggtaattattataattgagtctggtcagagattccactctttgaagttacaacatgaaactgaacagaggatgtagaaagtaaacaaaaatatagaacctgaatctcctggtctgactatgatgaaaaagtactgtaggtcttggggattggtagagaaatgagatgatggggaaaaaattatggtataatatgagtgaataatgaaagatgaggtacctgacccaaaaagctgtcatctctcaacccctaggaaggagataaatgggtctctccttgaggcaagaaaatcaatgatgctgtgagctgagcatgttgatagggtgggagaatactgtgggaaggaccctgtttaggaacaaatttcaggaagtgaactgatggcagtaggattgattgatttgtcttccgaagtaaggaaaaactgcagaggacaggattaagttcactgtaaccattgacattaaaagagaggtcatgtctcttgacatcagagcagtgatctgggacccccttccatacctgagtagtcttccccacccccagcctcacgtgctcctcccgccctcaccttcgcttctccccccacccccacccccacccagctgagactagaccggcaggagtgaacaggctttgagccagccctagagtgccttctctcctgcagctctgcctctatctctgcggactttgagcatcaacatgggcttcttccttattcttccaccatttcagggttgagcatcctgctggtggttacaagaaactgtttgaaactgtggaggaactgtcctcgccgctcacagctcatgtaacaggttggtctcgcccatcttgaagccatcctcttttatgtcagtctctcttctctggcttcctattccttggcgtctctcagtgcagactccccctgtgggtcacagggagagggatcaggtggtttgggctttttatagcaagaacccattttctttcattcgcctttactttatttctctaatgcagaaaaacgctacctaattggaattccctaaggatcaggattacacctttgtcatcttcaaactgtcagtgcctagctcagtgcctggcacatagtaaatgtcctataaatgtctgttccattggtgtctgaataaatgaaggcccagtgacaagcacctgggagtattaaagggtggtgggtttcatgcccattttattagaggaatgttggttctgctgggaggcagatgtagatgctaacctagctctatcatttcactgtctgtgaatcctctaagttacttaaacgttctgagcctcaattcccttacctacaaaaacccaaaatttacgtcatgaggatgttgtgaaaattaagtggagtaatgtaaatagaatgattcacccactatccaacacaaagtgatcaatagacagtaattattactatcagtatcattattagttataggaaataatccatttgcttgaaaaacttcactggtaggaatcaaggaagcactgtcaatcactgcccttctcaaaggataaacctacctggggttttttttgtttgtttttttgtttgtttgtttgttttgttttttgagacagagtctcgctcagtcgcccaggctggagtgcagtgggatgatctcagctcactgcaagctccgcctcatgggtttatgccattctcctgcctcagcctttccaagtagctgggactacaggcgcccgccatcacgcccggctaatttttcgtatttttagtagagacggggtttcgccgtggtctcgatctcctgacctcgtgatccgcccgcctaggcctcccaaagtgctgggattacaagcgcgagccaccgcgcccggccctacctgggtttttagggacaaacctaactgtgaaagctgagaggccttaaggactatcttgggtaccccacattttgcagatgagaacactgaggtccagagatgacatgtgagctgatcctaaaccagaagtcatgtccctgacatccaaccctgtggactttctgctacagcagattgactttcatccaagcagtagctcacactcacagagggatatagctctagattttaaagagccaggattcctgttttttcatttaaatagtcttttttctatagacacatctttttaaaatacatttattctcactcttaatccatacttctactcctcactccactaaaatatatcaagaaatttgaaaatcttcttaaaaatgagatggcaaaaggcaaatggattggtgtttggggaaatctattaggtggagagtcccaatcctctcaagatgcttctccctcactccttccaaccctttatccacactctggggcatctccacatttcccaaggtgtgatctcctagtgaaggtgagtcaagtcagcagacattttctaagtgctgtccagcgcgagggctggaaatgaaaatcactgccagctctatgaggaagaagctgcccaatcaggctgctgatatactctgccttaccaaggacaagcctagcccaaggcagggataagaagcaatgttctgtctccccttcatcacaggcaggatccccctctggctcaccggcagtctccttcgatgtgggccaggactctttgaagttggatctgagccattttaccacctgtttgatgggcaagccctcctgcacaagtttgactttaaagaaggacatgtcacataccacagaaggtaaagcagcactccatgccactcctcctcctcaaagtagggcctagcttggctcctcctcccatgtgagttttcacctctgaactcaggaggcaacctatatacccactttcttctcacaatgtacctgggccagtgtgtctgcatggatacgagggaacattatcatggaataaaggagaagctaaagcctagggctttggggtccaacatgagtggctttaaaccctgtattcaacagacatgacttgcctaggagggtaaccttggcaagatgttgacctccaattcttggttttataattagtaaaatgggagaaataatagaatctaccttatatattcattacaagcattaaatgagagcgcagtgtctagcacacacaaagcacttcataataatagctattgtgatgcttgttattattattaaaccattggccatcttgattcctttttctttttataaaattggaaaggccactgggaaaggggtcgggggctgccacaaagtagtgaaggatgaaacatgtcatagtgctaccagaaagagaagttttctgaaaacaagagattattgctaaaaagccttgaagccctaaatcatcattccaggaaacccccattaatgaagtattaacaaatactttgtcttctgctttcgtgttcaagcctattagtggctttgttgatcaccacagatttcaggcattttgaaaagacctgtaaagaaaaagtgaaaggggacttgaagcaggacaacttgcatgataatagaagagaaacggatgatgtcaagcagaaatgtagccataagagcttactgtggagttcagataaagcttcctataccttcgacagagcagggtactctttcttcttcataaaagtgcgaccgggtgtgggtggctcacatctgtaatcccagcactttgggaggccaaggcggccagatcacttgaggtcaggagtttgagaccagcctggctagcatggtgaaaccccgtctctactaaaaatacagaaaaattagccgggcgtggtggtacacgcctgtagtcccagctacctgggaggctgaggcaagagtatagcttgaacccaggaggcggaggttgcagtgagccaagattgcgccactgcactccagcctgggcaacagagcaagactccatctcaaattaattaattaattaattaattaaaagtacaaaatcagattttaactggctctccatatcagaaatcctgggcaaagtatgctgtctactctaagatatggtttagcagacctgtctaggcaagagatggaattcaagaatacttaatttttaaaacaaaataaatgttaaaattgaagaaaaacataaaagtaacagagggagattgagaagaatataattcagcacaccatgtccggaattttcccagtaagtttaggttgataggttataggtgatgggggtgggggtcctatgtgaacttcccccagggctgcatggtgtgatatagaaagttcatgttgtcctgctctggccaactaggattctaacccagcttggccacatatgccaatcacttaactcctctgaacctcaatttcctcatctgtgaggtttaaaagataaaaacgtaaactcaagggacattgtgtctgccctgcttggtcaccccaagaaagtgagctaataaaaccctttattcttcatgttgtgcatttatgattgtgacttgatgaggacacatagaatggccattctaagctccacatgggctgtacggattgctcctgtctatactcttccctatgtttcaatgtccttcaggttcatccgcactgatgcttacgtacgggcaatgactgagaaaaggatcgtcataacagaatttggcacctgtgctttcccagatccctgcaagaatatattttccaggttactgaacccaaactgaatgttactcaagacattttatattagccctttttctctcatggcttgaaaattactggactgaaaaattcatttgtttctacaggtttttttcttactttcgaggagtagaggttactgacaatgcccttgttaatgtctacccagtgggggaagattactacgcttgcacagagaccaactttattacaaagattaatccagagaccttggagacaattaagcaggtgggacacagtgctaggtgatgttcaggaatttagaatttggaacttaaaattaattcaacataaattattcatgctgcgaatgtatgattctaacttgatgaggacacacagaatgaccattccaagctccaaatggactgcactgattgcctctgtctatgatgctttcctgcaattggtgtaatttggtgaaaagaacatgagagccacattaagtttcaaatcctagcattgtcaacaatgactagctatttgacataggacaaacattgtttcttcatctctaaaattttaaacacttacatggattggagagaacccatataaaatgcctaacatattcattcattcattcatgacacaaatacttatcaagtgctttccatattcagaatttatgctagatgcaagggatagatcaatgagtagggtaacatggtccctgcctttcatagcttttataagctagcatgaacctggtaaatactgggtgctcaaaaaattatagctactgatactgaaaatcatgctatttatggttctaggcaagtatgttgcactaatttgccccttcttatagatacttcttattagaaataaagctatatcttgaatgaaatagcatagaacaaaatttcagcaatatttggaagtgacaaattttatggagaacttagggaatctcaatgcagcagtccttagatacacattttgaaccaatatttactaagatacacctatttacaaggcattgttcttgtcttcaggtgacttaatgtctaggtggagaaatcaaatatgtaactgtaataggacaaagaatatgacgagtcttttaagaaggaaaatcttttaagaaagcataaatacgaaaggaattacttctggaagtagttggcaatgcaaggtgggacaggtgaaagaaggcttaaagggaaaggctttgggctggaagttaaaagagagggatgatttcagtgaatttagagaaaggatatgctagatggagggggtaaagcgatcaaaagcatggaggtagaaggtgttcatgaaaactggagaataatctccttggactagacttgcagcatttctcagtggaggtattagtatgacattaggcagggggtgactcatcatcatggagacgtcccacacatgggagaggtttggcatccctggcctcatccactaaacaccagtcatgttttcaatcattatacaaacccaaaacgctcctgacatttccgtatcttcccctagggggcaataacactcccagttgagaactagttgcctagagtagttaatgtcaaggggaatattgagacacagggtaggatgaaattaaaagcttgaataattggctatacatttggaatatgttgtttagctaatgggaagctactgaaagtttttgctcaaagaagtagtatgagtagggctatattttcagatgtttatttggggagccatgtgtgggctgtacgggaaggcaaaagagatacagtatagctgggagaccaagaggtgaaactaaaagccagaaccacaaatgcagtactggtaaaaataagaagaaaaaaaatagtctcaacattgagtctcaatagcacaagctgatctataattctcaacagactatttactatgtcttaacatacactccccatagctctttcttgtttatgttgtgtgtgtgtaaccatatacaagtgtgtgtgtagctcctttagagaagaacaaaagctgagtttctaaatcattcatttgactttgatagggaatctgtattacaattacatgatattttaattagaaatatagaagctatggtatggctgcagaatagactttattaggagtcaggttccactgttactagcactgtaaaatgtaattttaaaaatgtgaaatttttgattgtttactgttattaaccagtgcctttgcctccagcctgattcccttaaatacaatttatttaaggcagcagtagcaattttttaaaatataaatatgaaagtattactccacctagggaatccataacttcccaaataaagtccaagcgaaggtctttgtggctggcccactcttatttcgcctcctctacgcatgcccttcatggcagccaggttaaatgactagtaatggccaaacagcacacattatttcacaagtctatgcatttacattaggattcccactccctggaatacactgtcatcctgctccacttggctaactccacgcacctttcaaacattagttggagtcatgtttctcaggaaaactgcctcatccctcagtctgggctagatggcgcttctctacgatgccattgcacactcacagtgctttacaccggcttattggtctaatgcagggctgtccaatagaactttctgcaataatggaaatgctctataactgtgctatcctggtgttattaagcacttgaaatgtggctaatgtgactgaggagctgaatttgaagttctatctaaaaattagtggtcctgtattaatagaacagcacgggtctagaatgaagttcttgaaagcaaagatcttctctctcctgagccctgatacagtgcctggcacatagtgaaagctcagagtatttgataaatgattgactgaataaatgaatatcttgcctattatttaaataaggttgctaaaatgtcctatgctttaaaaaaatctccctaattaattggaaataattttggttagataaatatatattccagtaattattcattcaataactctttaccaagtaggtcccaggtggaaatctagtgctgatttatctagctctttatccttaaacaagacacttgatctctctggaaccccaatttatccttctgcaaacagagatttgtgttacatttgtagttctaaacttcttatgagacataaaattgaattaaatgctgtatgcttttgccagaaatgtttatatttaattaaaagagatccatggttctcctaaagtctatttaaattaagactttctatactagatgaagcttgaagtccctttcagttccaaactcatacagtaccatgtgcaagacatatagttggtatttacatagtaccatacgaaattgacatttttggaaatcagcaattattaaatgttagcaatcttatacaattaaatctaatacaataataagagtataaagaagtctgaggactcaaacttatggtttcaggtcaatctgcatatgctaaaagaaaagtaactaaccagagcactgtatggtatacatcaaataaagagatgtcacaggtaactccagattcagacacatgagggggcattatgttctgcatgaaggtgggaactcaaggtgaaagagggtagaatccagagagatgggaagaaagagaagtgcacttaggatgagagttcaaggggtagtgatgacctcagacctagggacaaaggtataatgtatcttccttctctcaactggaggacattcactttacttccgtaggttgatctttgcaactatgtctctgtcaatggggccactgctcacccccacattgaaaatgatggaaccgtttacaatattggtaattgctttggaaaaaatttttcaattgcctacaacattgtaaagatcccaccactgcaagcaggtgagtttaccaatctgtcctcttctgaaaataagtgtctatattgtgagaaagttactgtattgtgagaaagataagaatgtcagaatagcattttgtgcatagttaaattactctcagacttcagaagtactgccctcatccctaccctataaggggcctaatgcccaagggcatcatatcaaaggatgacgacttgaaaatatagaaagcaagtgtccaagttctcttctagaatattaaaaatgtagtacatatatatatatggatttgatcatatacaattaggattcaaacttagcaaacatttattgagcacttattcatgtgctaggcaaaattaaattaaataagcatgtatgtgtgcataatagcatacatacatatatgagagtgtactaaatatgttgcgcttaattcccaaaactacaaacaaatctgttatctcatagaagtactatagaaaaagaactacagcaaaaagagtgtaccctagaattctccattcattcttcatttattgccaggttcattgttcaccaccttgatgatggaattatttgaatgtatacagatttttgtttagtattatttagtacagttctcaaagtgtagtccttggaccaagaccatcacctaggaaactgttagaaatacaaatcttgagccttgtcctgggcagactgaatgagaaattttgggagtggagcctgcaatcagtattttaagaaactctttatgtgattctgatgcacactaaagtttgaggaccattcacttactagtgagtaaattttaatgtgcataagaattactgtacagggctattgacacaaacccatctaaactatatcctttgggcatcttaagatgttgcaaaaggcattttgaccattctgaggtttcttccctactcccctgacttaaaacccacctccagctattgcaagatgtgactccactacactccacttgccacaaccctatttgagtgcacgtttccaaatctgctgctatttggattttcctgggtgattttgcagcttcacatgaaatttcactaagaagtgcaaatgatggagaaaatgaaaataacccctctaaaacaatcaaaatgtgtttctttgcctgtataagctgttctaaatgctttgtattaaaaaaaaaataagaggctcttccaaagccttttaaaaccactttatttcagacaaggaagatccaataagcaagtcagagatcgttgtacaattcccctgcagtgaccgattcaagccatcttacgttcataggtaacttgaaggcctgctatgaatcttcaggaaaactcaagtttaaagatttgctttgcctacctttgataccaatcctgatcacaatatttttttgcagaaaactaaatttaaacataattaatttcatgtaggcactgttgattcttgtaactgagcataccacatatatacaaatttgtctgtggcttgagaatcagccctttcattcacaagcccatttgtgtttctgaacagttttggtctgactcccaactatatcgtttttgtggagacaccagtcaaaattaacctgttcaagttcctttcttcatggagtctttggggagccaactacatggattgttttgagtccaatgaaaccatgggggtaagtcttagatatatttgtcaagtttgtgattctgaagaagatgtgtttaataatgtacacttttttcctttttaaatgcatcaaaatattttcctcatttttcaaggtttggcttcatattgctgacaaaaaaaggaaaaagtacctcaataataaatacagaacttctcctttcaacctcttccatcacatcaacacctatgaagacaatgggtttctgattgtggatctctgctgctggaaagggtaagaaaggacactggacaaatgggacacctcccattgttcctggaaattacggggtttttacagagctgctgcactcaatctgaatcacatctaaaacagcaagagttatgtgagagtcaaaaatgtaattggaaaagcagtaggaagtttaggtaatctgaacatcaaaactatgattaatgattgaaaactaatcgggtccatgaaccccacctgaaaacaaaagattctgtgacctgagaggtgaacttaaagttgacaaaatccctggggaaacttgagccccatcttctctgcgaagggagaaaaagacatgcgtttttcagactagccaaatcactaagaagacaacagcacctaaggacacaaacagaatggtgacaggaagacagaacagaaagtatctcaaggctgctgttacttaaacaaatccattaagcaggttgctttattttcatcctgtgtgggcgggaggaaatggctctgatacacctggctcaatagcagtttctgggttgtggaataaagaacaggcaggcacttgtgcttaaaaaggcaagaatcatctctctaaaattatttgtcattgcctgtgctcatgtttgactttttatttttgcagatttgagtttgtttataattacttatatttagccaatttacgtgagaactgggaagaggtgaaaaaaaatgccagaaaggctccccaacctgaagttaggagatatgtacttcctttgaatattgacaaggtaacctgcttctctgtagatttcagatttaaccagaatgtttcatctctctcaggaattgtcctcctgcctcatgtttatacataaagtcttgaaatttgagagctagaaggagctttaaaaataggctaattaaacttccttcattttacaaatgaaactaaagctcagaagagtactgtgacttagcaaaagcaactgcagcagagccaggataagaaccaggtttttaaattctaaatctgccgttcttgtatttacaaaattgtctttaaaatatacttcctcggtgaatagtgcagatccactgattcctatgatactttatcaataatataaatagtttaaataatttgaagttctggagagatgaagcatcaaaaagtactcttgtagggaaaccagttcattattttggttttctataaatcttctgaaaaatatcactagaggttaaaaatcattactaacaatagacagtcatctctttatttctactttttcttccctgtatttagagactgtctttttagaataaccagagtaacatctagaatttgtagtgtgatggaaataccagtcaaaatcaataaaatataattctcacatataggtatgtgaatatatgctttcttttatatctatttgctccctggttgcacaaaaggggttattaaaacagctacatggaatgtaaaactttgcaccaaaggcttagatatggtgtagtagaaaataaactcaatttagaaccaaacaccactgctcttaagcaagtttgtaagctctatgaagaatgagaaagagggagaaggttgaggttgagtgttacagacaggcaaaggggcgtctataaaggcaaggaggagttaaaaatgcaagatttcatctataaatatgaagtagttgctgagtttggtttatttaggggtgtaggggagatgggttttgggcagagagactggaaagataggttggagcaatattgtaatgggctatataagcctttgagtgttatataaatatagggagccatttaagtattttaaatgtgtattttaagtgtattttaggacatgattagatctgtgattcagaaagttactctggcagcatcatggaagacagactggaaagtggagagtctagagcagaggctagaagccctattacaggattaatgcaatgaggcaaataaaagggaataagtagttgagttaagaaaatggtgactgagagatgaagatgcaaagctgagaaatatttaggcagcaaaatcaacagcagttggtatctaattacatgtgaggggtaagggagaggaaggagttcaggatgacttcaagatttccatcctgagcagttgagtgaatgatggtataattcactgaactgaaaacatagaagtaagaggagctgggccaggcgcagtggctcacacctgtaatcccagcagtttgggaggccgaggcgggtgcatcacccgaggttgggagttcaagaccagccttaccaacatggagaaacctcatctttactaaaaacacaaaattagctgggcatggtggtgcatgcctgtaatcccagctactcaggaggctgaagcaagagaatcgcttgaacccaggaggcagaggttgcagtgagccgagatcatgccattgcactccagcctgggcaacaagagtgaaattccatcataaataaataaataaataaataaataaataaataaataaatagaagtaacaggagctagcttgtagaaaaaagaataaattttactttatagatgtaatttgaaagtacccactagcaatcttagcaaagcattccataggcagctgctgtacatggatctggagctccaaagaaagatcatggagagagatcaatctgggtaccttaaggatttttgctttccccttaagaagcatatcactgacatgtagttgagcattcccaaaatactcaccaaatggatgagtcagttaatttcagtaaactcttacttcgctaataatggtaaaaatcacaatcatctttaaggaaataaaagaggatcacttaacttaaatattcacattgcaaaataaagaaaaaagaaggatttttctaactgtatggttatcacggcctgaagaaatattacccaattatagaatagggaactgtaataatcataaaaaatgtctaacatcatcaaatccgtctcctctttcttctaatagttattgagtagccactaaaacaggcatcatactatttgttgcagtgggtacataaaatacacttctagttctcatggagcccgttacctagtgtatcagagagaaagaagccgaatcaggaatagccatgcatgtcagcacaggagtagtactctcaggagggataaattgatttgttaatagctagtcagatgataatgtaggggagattaatggaacatagttatttgcaatgggcagtaatatggcaggtggagatgggattgaggcagaacaactgaagacagaaagaacagtttgaggaaagacagataggtggagagggagatacgcagagagaattggctattataattggttgaaacataggcaaaagtagtaaagtaaatgggataaaaagttataaaagtacgttgtactcttagaaggctttaaggccaggctaagaaatttgcactttattgaactggtaatggaaagacagtgaaggtttttacacaaaagaaaagcccataattaatggtattgaaatgataatgaaatatgtaagaatagagagataagactgcaggcagggggggaaatcatattttagattaggttttccaaaagaaacatttaaaatttgcttatttaaaaaataaagaatttgagagccagagaatacagagagagaagacagccaagcacagtagctccagaaaataaacatgtgtagaaaatggtagaaacaagagaagccagaaaaagaaacaagagaagccagaaaaagaaacaagagccaccagaaagccctagttcctactaagagagagtaacgtcacaaagatgagtgcaggtgagggttatacggtgcccattgccatagacaagttgaaaagggtgaagactaagaataaagcactaggtttggtgatctctaagggaatagagtgagagagacagaagtcaggcttcagggctcttaaggtaagcagttgagtatctggaaagcagttactgcgtgcacactcttaaaagtttggcaatgaagagaaaaatagaaagggcttaggtcccagttacttggaagactgaggcaggaggattgcttgagtccaggagttcaaagttacagtgagctacatgccattgcagtccagcctgaggaaaagaacaagaccccatctcaacaaacaaacaaacaaaacagaacaagactccatctcaagaaacaaacaaacaaacaaacaaacaggaaatctaatttaacaatgaaaataagcaaaatagaacaaagtaaaaaattcaacttgaaaccacataaataatatattaaacatagacatagacatttgtacttattgtatgcatgtacataaatatgcatacatgtgcacacccctcgcttcttcccagcatcaccactaagtacctcgagtcccttatttcacaaaatcttgcagaatcttctcctctattggctcccacctcccatcctttccctattctgaaaatcttccactatttacttttaattcttagtccaccaccagaaaaaatctcctgtcttctcttcttagaatgttgccttcaacctccttttttaaccaaaatctggctctctcccctaaggacactggtctccccaacagtaatttccaggggaatcagtttctcctctgtacagggtacagcccttttaccacttggcctggagttggggtagaggtccttcttctttgctgctttcagatcattgttccctctattcacccttaaaattccctaagttttcatctcattttatctaatcatatagccaagtgatgtatatgtgtgtgtgtgtgtgtgtgtgtgtatatatatatatatatatatatatccctcatgccctcgactttgccactacttaagactatactccttccataatctgtttcatgcatgacccactctgaccttttatctttcaacatcacttgccctactgcaatttccaccaggaacttccaatccattgaacacagtactttctcactctctctcactacgttgaggatttaccttctctcctcactcaatttaagctttacagtcaataattacaaacactttctcatgtagaccttcctttcccttgcctctttcttaccttatcaaagtcatttgtcaaaatcacaaccctagttaaattcagctctccaccccctccatgcttatacctctgaggctgaactaagtgcagacaacacacaatcatgttaattggttccattttagatgcatgaccacaaatctttctgctacatttcccggcttcacttactctctcactttgctagttaaatattccacaccctcctctctttaaacttttaccacctcccacttcccgcctccacactcagatgcagctgatggctatgttttctttttctctgaaacaaatgaaagaaatcagaaaggaaccatagacttgccagcacatctacccacccaccagcatctgtactcatatactgaattatccatcttcctatccagagctgatctctttcatcctccttcacattctcagggaaatcactctcccaattctccccatctttcctagatcaccactctcctacccttttcgatggatcatttttgtcaggctcttacaaaatccttctcttgacatttttgccccaaccagctaccttctcattcctcgtcttgttggagggccttggttcccctatcttccatttatacactcactcgttgttaaatattcatgccttattcatttacatttttagctttctcttaaactcaaggttcttacctgctagcgccagctccacatctgcatttggatgcccaatagacatctcaagtctaataagacaagacttgaacttctcatcttcccccaccaaaaatttactccacctgtagttcctatctttgttgtgacatcaacattgtacaggtcaaacaccttggtgttatgcttgatgcctctcttactttcatgcctcttcctcgtcccatatcctatttaacaggaaatcttcttgactctgtcctccacttcttccacttctcactgactgcaatgctactggcctagtgtgaaccattgttttctttcaactagactactacaagacaaactggtttccctgattccactcttggatcctccctactaacaaggctaccctaaaaataaatcatagcatctcactcctgtgctgaaaaccctccaatggcttcccatcactcactcacagagaaagatcaagtcctcataatgacctacgaggctttgtacagcctggctcgtgacctccccaccttcctttcttattctctcccctagctcagttgatagaatccacactggactctttgatgctcctcaaacacactcagcatcctcctccctcaggcctttgcacaatttgttctcttagcgtgaacactcttccccagatatctgcattgctaattctctcatcttctaagagttttgtctcctctgccacctgttcaaagagacctacccgaaccatctattcaaattttaaccgcttacccttcacgtttctgatcttttttcctctattctatttttcccccacatttgtggtatattataaaatttattaattatatttattgtatatctccttgaactagaatgtaggcttcatgaggacagggacttcactctccaaaacatcctgaatgccaagaatagagtctagaataaaatatgtaatcaagtatttgatgaaattattaataagtagatatgttagaaaaatctcatggtatttcataaaataatcagaaaaatcatgtgtgtgtgacaagagatcttaggaaacatatggtccagcgttttttttttttctttttgtcaacataactgtaaggattttttttttcaagcaaaatcaaaacatattctacgtgtgaacgaaatatacattctttcatccctcaggcagtcgaagtctttgttgttctgcagaaaaacattaattattattattattggttttgagatttttgtttggtttttgtttttttgtttttcagaggcctttctttggagccctaaattttcttcaaggatggtctcattttactgaagagaaaattgatggcctaagaggttatgtgactttcccagtgatacatagccagtgactgacacaggcacagatagcttgcccagtcgcgtcccagggtccctcatctatagcttcctgcagttcctccctgcatgttgacctaaaaaagaacttaggagccaagacttaagaactctgcatttctggctgtttgaattctttcctgctcactgaggtttctgttatcttctctcctaggctgacacaggcaagaatttagtcacgctccccaatacaactgccactgcaattctgtgcagtgacgagactatctggctggagcctgaagttctcttttcagggcctcgtcaaggtgagatgatctagagaaaacttcacacgggagtgaacaaatgtttctttcaaagagattaagagttttcctaagcatgtgctctatttcgtagcatttgagtttcctcaaatcaattaccagaagtattgtgggaaaccttacacatatgcgtatggacttggcttgaatcactttgttccagatagggtaattaatccttcttactaatatttgaacagtgctttgagtatatgctagtcaagtaaagcatattgactgattgcttgattgatttttctttctcacaaacagctctgtaagctgaatgtcaaaactaaagaaacttgggtttggcaagagcctgattcatacccatcagaacccatctttgtttctcacccagatgccttggaagaagatgatggtaatgaaagcaattgttgtgtctgaatactcttcttactgcagttctgtatgttagttcgttaggaaaggagtaaggttgattattccgtaatactcaaaaacgatccttaatactataaatagagcagtactgaagaattaaaactatttgaaaagaattttcatcttttgatcaggtcttgttgattaccagtagaaaaaaatgtcaaagcaccatttggtgtcacgatggagcatcaatgtctgctctagatgagggagagaaggaagaaaaaatggcaacatgaattccaggtttttgccttccctgacgaagacatatttctaaaaaaatagcaattctaagaagggaagctaagtattatagcagatacaagagaatgagaaggcaggtctgtgaatagttttcatttgttctttcggtaagctagggcttgaaaaaagacccagagccacaccagcaactcagatacagcaactcaaattacaaatcagcagtgttagttaactgcttctcagctgggacagggagatagattacactctatgggattaaaatatggaaaactaagagaaatgagataaagaattgtggagccatttcacactaaatgattttatatatccagtcgaagctgtaaaagatttgttctcattttgttcgaaggaagtcagcttccagatcgatcttagaaaccatacatatgatatatcttactgctttcaaagtcttttaatacacacttttcatgtgatcatcacagtttttacagtatgtacagcaggtgctatatttgtatgttacagataagaacagatccatttattcagtgagtatttaatgagtacctactacgctgtagtcattgtcatagaatattgagatatagcagtgagcaagacagacaagactctcccttcttagagcttacagtgtaggtagggtacataaagagtttaaaagacctctttaggtggtctcatgccaggtggtacaagagtcagaaaaagaagtcaggtcatatggttttctatatttgtcaatgtaatacctcctatattatttcaatgacattcaatctatagcttgggcttttaaaaactcaatattgcctaatttacttctgataaacaggtgtagttctgagtgtggtggtgagcccaggagcaggacaaaagcctgcttatctcctgattctgaatgccaaggacttaagtgaagttgcccgggctgaagtggagattaacatccctgtcacctttcatggactgttcaaaaaatcttgagcatactccagcaagatatgtttttggtagcaaaactgagaaaatcagcttcaggtctgcaatcaaattctgttcaattttagcctgctatatgtcatggttttaacttgcagatgcgcacaattttgcaatgttttacagaaagcactgagttgagcaagcaattcctttatttaaaaaaaaaagtacgtatttagataatcatacttcctctgtgagacaggccataactgaaaaactcttaaatatttagcaatcaaataggaaatgaatgtggacttactaaatggcttttaattcctattataagagcatattttaggtacctatctgctccaattatatttttaacatttaaaaaccaaagtcctctacacttgatttatattatatgtggctttgctgagtcaaggaagtatcatgcaataaggcttaattactaaatgtcaaaccaaactttttctcaaaccagggactatcatctaagattaattacagtaattattttgcgtatacgtaactgctcaaagattatgaatcttatgaatgttaacctttccgtttattacaagcaagtactattatttctgattttataataagaaaatctgtgtttaatcaactgaggcctctcaaccaaataacatctcagagattaagttatatattaaaagcttatgtaacataaaagcaagtacatatagtagtgactatatttaaaaaaacagcataaaatgcttaaaaatgtaatatttactaaaatcagattatgggataatgttgcaggattatactttattgcatcttttttgtttaattgtatttaagcattgtgcaatcacttgggaaaaatattaaattattaacattgaggtattaatacattttaagccttttgtttttaaatttcttttcttccagagattgtttaaaaataaatattgacaaaaat

SEQ ID NO: 34792 - DNA, 17217 bp, Homo sapiens
gaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaaggtaagaatgcagagtggggggactctgagttcagcaggtgatatggctcgtagtgacctgctacaggcgctccaggcctccctgcctgccctttctcctagagactgcacagctagcacaagacagatgaattaaggaaagcacagcgatcaccttcaagtattactagtaatttagctcctgagagcttcatttagattagtggttcagagttcttgtgcccctccatgtcagttttcacagtccatagcaaaaggagaaataaaaggaccgggtgagatgtgtctgcatatgagcagtagaaagttgtcaattgtcccttttgaaaaactatccttttttgaacctttgctcagattgttatttgtaccttttgatgttaaaatgacctttatttatgaaattacaatagatttgggaaatgataataagtggtaagtttttgtttatttttaaatgttcttccctggcaaaataaagagatggcacctctctgtcagttttcttaatatgttgttctgaaagttttcttactcagtccaatctgagaacctctgcttttaagtcatcagacaaattcttgagatggctttttctgagaggctcttctgttcatcctggtcccttcttgcctaaaggtgagtctgtgtgtgtgtggggggggtgcgggggtgaggtgttgggggaggtcttcttattagctgggaagatggtatttgtgtcactttttgtgaaagtgggctcccaaatattccctgttgaggaagtgttctaatcatgaggaaataagcaagcaaatccagttgttggacaattagtttggactggtcaaagatgtcagtgccaaggaagaaagaaaaaaggggtggggaagggcttgttctatattaaagagactaaagaaatgtgttaaccaaatgtagtgcatgagtcttgattggtgtcttcatccaagggggaaaaaggctatgaggaacaggtttgggataactgaggcaatttgactgctcattattatgttactgtattaatgttcagtttcttggtgagataatgatactgtggttgcgaaggataaaatctttgttctatggagatacatgcttaagtacccagggtgaggcgtcaggatgtctgcaatttgctctcaaatggttgaagaaagactgcaaatatatagataatgagagaaagaaaggtaaaacaactgtggcaaaatattaataactggtgaattacaaactggtgaatctaagtatatggggagcttattgtactattctttcagtttttctataggcttgaaaagctttaaaattatgagaaaatatttcctaaaaagagccttctacgtgaaaggcaagctcttcatagctatggggttagaaaacctaagagccagagcctggggatgaccttgggcaagttattgaaccctctgcatcttcatttcttgtccataacataacaaagaaaattcctgctgtgaataatttttgtggggttcacatgaaatacctataagatgtaaaggatttttaaaaaatgtttagattgttagaattagaagagatccaattctgaattttacaaccaaggaaagtgaagtcctaagatgctaaggggccaaggttgcccagctggtcagtggtagagcttgagacttgaatctgtggagacaattgaaagaatcatcattaccagaagtgtgatgaggcattacttatttcagactgttgaatgaagttacattctcaataaaaactcctgcatgtgtgtatgtgggtgtgggtggtgtgtgtgtgtgtgtacaaaaatagtggcaatgttttgcctttttttttcttttgtggtcatttaacaagtctttggggatttattagatgtgtttcctaattttatattttttcttgatctttccagctactccacttttgaaataagggcaacatcccattatattgaacaccaaacatggaagttcttttctagtagtagatgtttttcatgagcaggaaattacattagtacaagaatgtggaactggaaagggacctaatgagcatccggtaccgctggctgatttttgcagatatggaaactgaggcccagagaggttattcagcttgtccatggccatctaccagttagtggcaaagctcgaattctggcctcttcctctgaagttcagtgactttctttctttttttttgagacagagtttcactcttgttgcccaggctagagtgtaatggcacgatcttggctcactgaaacctctgcctcccgggttcaagcaattctcctacctcagcctcctgagtagctgggattataggcatgtgccaccatgcccggctaattttgtatttttagtagagacagggtttcaccatgttggtcaggctagtctcgaactcctgacctcaggtgatctgccgacctcggccttccaaagcactgggattacaggtgtgagccctccctgtacatggccatgaggttcattgactttcaagaccttcagctgacctctggtttatagaccctaaaggtaaaagacagaaaggtacaggaatgcttggaacaaaagatctgtttcaaggccagatctagggaaaagggggcattctggaggctggaatataagtctaggtatgcttttttgcaggagtggcaagaactaggtgtgaaggtttgggtagagaagcttagtgaggctgagtggacaaaggtaaggcctgagaaggcagcctttctgtattccacctgcaactcaaattgttaccaccactttcttgatcatgtattaatagttgttatgtagaaaaaaattccttataatcatagaaatcacttgtttatacatacacataatatgacatattttactacataactattactacaaagttatatataactttttcttctctgggcttatataaattttcatatatatacatatataaattttatgtatatataatagtttttgaaaagtagaaaaaaaatacaattagccaagtgtggtggctcacacctgtaaccttagcactttgggaggccgaggtggacagatcacttgaggtcaggagtttaagaccagcctggccactgtggtgaaaacttgtctctactaaaaatacaaaaattagccgggtgtggtggcgggcacctgtaatccagttactccagaggctgaggcaggagaatcgcttgaacctgggaggcagacgttgcagtgagccaagatcacgctactgcactccagcctgggtgacagagcgagactccatctcaaaaaaatatatatattacatataatacatataaatatatataattatatatataaatttattatatatataataaaatacatatataatttactagaagataaattagagttggttattactgtcacaagagaaggactgctttgtttgttatttagcccctgctttggactggtctcctgttgaacagagcctggaagagggcttgtgtgcagttggtttatatggaccatgatcctagagaagagaagttgagacaggggaaagtgagacagggaaggcaggaaagccacaaaatgggggccttctccagctagtcaccacagtgggcaatggaggctcaatcccatcaagcccttcagaggggctgtgtagactgcaacagaagaggggaggtttacgcatggatctgataccctcttggccaagggctatcccatggagtatattgcgcttccctgatactcagatgtggggacgaggtttgttcttgcagactgattttttttttttttttaagatggagtctttctctgtcccccaggctggagtgcggtggcacgatcttggctcactgcaacctccgcctcctgggttcaagcaattctcctgcctcagcctcccgagtagctgggattacaggtgcacactaccacgcccagctaacttttgtatttttttttttttccagtacagacagggtttcaccatgttggccaggctggtcttgaactcctgacctcaagtatccacccatcttgacctcccaaagtgctgggattacaggcatgagccacggcgcctggcctgttcttgtagactttctatgcagaaagtcagagaagctgggccacggtggctgaggcgaggtccccgcaggtgataactgcaagaggcaggttgcctcagcaatgactgcaaaaaagtgggcaggatgtgaggggagggtgaggggagaaacctgaggtgttcaacacaagtgctgcagattccctttcctcacctagaataggatggggatgagaatccctcatgggagtcatcatgcaaattagcagtcacacagggaagcacccagtgcagcgctgagcagtggccacccagtgaataaaatataactagaaaggcttattttacttgagttccactattgtttttgttttttgttttgttttgttttttgaagatggagtctcgctctatcaccaggctggagtgcagtggcgtggtcttggctcactgcaacctccacctcctggattcaagcaattctcctgcctcagcctcccaagtagctgggattacaggcacacgccaccatgcccggctaatttttgtatttttagtggagatggggtttcaccatgttggccaggctggtcttgaactcccgacctcgtgatccacccgcctcagcctcccaaagtgctgggattacaggcatgagccactgcacctggccagggttccactattgttttaaagcatcattcaataatcaatatgtcaacatgtgcataacattttaataacatgcgttgattctagagacagtacaagttagagcagtactcaggacaatagtctattagctagtcttcactttcctaagatgtttctgacaacctgtagataattaggcatagcttgttttacttcattcctttcatttatgtaatatggactgaactttccagtgatagaaaatatctatgaaaattattacaatgcctatgtctacaggcaaacgagttaataaattcagtttccgggttgaggtctctaaaatgccaagtctataaagaagcgacggcagagaacacagaacatttccagaattttgtaatagacatgaacctttaaaccacagaaggactgaatttaacattttaaaaaacctagaaaaaaaacagctgggcgtggtggctcacgcctgtaatcccagcactttgggaggctgaggcaggcggatcacgaggtcaggagttcgtgaccagcctggccaatatggtaaaaccctgtctctactaaaaatacaaaaattagccaggcgtggtggcaggcacctgtagtcccagctactcaggaggctgaggcagaagaatcacttgaacccaggaggcagaggttgcaatgagctgagatcatgccactgtactccagcctgggtgacagagcgagaccctgtctcaaaaaaaaaaaaacaaaaaaaaaaaccttaaaaaataaaagccccaaaaatgctaactatctgacacagtacagcccttaatattttcacagtctctttttggttttcctccacattcacaatgaaatgttagtgattttaaaacattccagagaaattttagtgttgacacatctttattgagggccatttcatttatagttacttatgtaatcatccaaacaattcagctcagcatactggggctcagagaggtggagtcatttacccaaagtcacacagctgggacatggcagagctgaactaggagctatgacttccggcttaggtccaggcccctttacgagattgtttccctgcctttgggttttgcatcctctattctgggcttccacccgcatgccagatggctctattcctggagtctgaccattgccagatgctcctggctgacatgacctagaagaagccagcaggctcataacttaaccatcgcccctgccaaatgggaactggccttgccgtcatcctggaagccattccctgacattttgttttattgcagttcatgtttattccagctaatgcacataaggagtggttcctgcaaggcacaatctgaagggctccttgctcagagccgtaagggccatggtgggattcagcagggaacttggcaccagccaggcacttttgctgcctcttctttgccagtgagggtagaagaactgataagaggattgagtgcacagcccaggagctgagagtttacaaggcaacccactgggacctgagctcagccccaggagtgggtcaccccacaaagtgctgagcagcatctttgagactcttctgaagcctccagtagccatctgggtccagtcgggagatagaaatcacacagtgggttaagctggggaagtttactttaaagaattactaaccgtgatgaaagagcaactatagatagacgtgaactccataggcacctagggctgagggagggtgccggacaagcttggaaggggaaggtgaggttcagcacatcagcttgcagagaaggtggctaaggtgtgcaggcctcagctggtctgcagctgcaataggccgcctcccagtgcaggtgaggagggcaacctgcaacgtgtggcaagggcatggtgggagtcagggcaggcacaggcaggaggcctccagagcactgaggtccgtgtgcagggactctgggttccttgttgggagggctgtggaaaggttatggccaggctgtggctgtgaggtcacagaagaacttcgctctgggtccgtggctggggtaggactccaacaaatgtcctcacagtcataccacctatggacgcaggacaggaaaactgcagacctttttcctcccacgatgtccctccagcgccctctactgagatagttcaacatcgcgctcacttcaaagctcttgttcttcagacagcatacatgggagggtgcattcagctctgagaggcaatgcgtttataactgacacacctcctcagcacaggatggaagagttcgcagctgccatggcctcggaagacatgggttcaagtcccagcgataccacttagctgtgtgaccttgggcatgttacttaacctctctgaacctcggtttcctcatttgcaaaaggggatattaatgttcactttcaggaccattatttgaaagtagtgagtagcaagcacccagcacagtactggctcataagagacacttaataagtagtagcgatagttcaactttatcaggcgctatctgcagtcctaaagcctttctctatttctctgaaactttgaaggcaccagatcacatttaaaaattacataaaaattacttgaaatgggcaaagagctataaatgccgacaaaccatcttgtttcacaaaaaaaaaaaaaaaaaaagctgttttttagagttgcaaagccagtacatactttagctatccacaaggaagtcatctgtgaaaatgcctgacttttttgggtttcactttcttccttccctctatagcaaaaggggcatttctttcttaattttctccccactgactggtaggtaggtacccctacttttcttagtatacatcttttctcggtaagttgttaaattaaataaccagcataaaatacatcattttgtatgtgtaaaggggccagatgcaggggagggatggctcgcctgaatttaatatttttttaaaaacctaaaaaaaaaagccctaaaaatgttaacgatctgtcacaatatagcccttaatattttcataatctctttttggttttcttccacattcagaatgaaatgttagtgattttgaaacattccagagaaattttagtattgacacatttattaagggaccctcccatggcaactgtggatggcatagctgaagtgtagggacaaggttggggcagtcctccagactttgtgtacagatggcatgcagtatttctctctcctcacattgcctgaaaccaactcctttttttttttttttttttttttttgagacagagtctctctgtcacccaggctggagtccaatggcacaatctcagctcactgcaacctttgcctcccaggttcaaacgattctcctgacttagcctccctagttgctgagattacaggcatgtgccactatgcccggctaatttttgtatttttagtagagacagggtttcagcatgttggtcaggctggtctcgaactcctgacctcatgatccacccacctcagcctcccaaagtgctggaattacaggcgtgagccaccatgcccagcaactcttatattctgagagttgagacaatgaaagaaaagaaatttgagttgtcctgaggcagagtctgcagtgatccaagaagaggtacagatgaaaggaaaccagctcaattcaaggaacttgcttaatgccctgattttgaaaaattgtcctggcaagactttgccacatcgaatgagcctctgcacattgcaggaggctggcagggccagggagcggtgggctgctcctaacagcctgggtgtgtgttctgggcctaagagagaaggcatggcaatcggcgaggcagcatcagagaggaaggttacagatggttctgccacctgtgtacaggaaggcggtcactctctcttacctctccctggcagcacagaagaacagggaacctcgggcaccctgtccctctcccccataggcagcaccaagtccctgccggaggtgtgtgttgcctgcacagggggagaagggaagcagctggtactggtctcaggtcgatctaaggaaactccatttgacctagtgaatcagtccctgccctggataccctcctaggccaatgcaacctttagaatgaagaacaaaggggtttcctcacccctgcacaacctcagatagggagaaggagacgcagggaatgaaataaaagtttccaggactctccaggagccattcagattgtccaagaaactggtttccgcagcagcctggaataaacccattttccttctcgggtatgaggactttgccagattatgatttccttaagggcatggactgattgtgtctttttttttttttttttaaacatagactagcctattagacaaacttgtgtcttagacacctttttttcttgagcacctagcacagccttgcactcaataggtgctccaatgatgtgactaaaaggatggataaatagctctgtggatttgaggctaggaataatgaaggcctgccatgtcccggggggtactcccaattgcccctggagtttggaatgcacattgaggatgtcctcagttacatatacattttggcttatgagtctttctttttttaattttttttttttttaagacagggtctcactctgtcacccagactggagtgcagtggcatgatcatggctcactgcagccttgccctcttggactcaagagtcatcttcctgcctcagcctcccgagtagctgagaccacagactgcaccaccacacccagctaactctttaattttttgtaaagatggggtctcgctatgttgcccagcctggtcccaaactcttggcctcatgcaatcctgccacctcggcctcccaaagtgctgggtttacaggcatgagccactgcgcctggccagcttatgggttttaactacttacatggtgcactctagactgagggatatcccagggatggaggacccacccacctccagggcattaacacttttagggaggctaacaactgcagccacacagaggcaggggtggagaggagagaagggtagctgggatcaggggcaggcagctgcagcagctactgagctggctcactgtgggcagcatggctgtctggcccagcctgcacctgagagctagctgaatgttttcttcacctccttccagggagaaattttttccagtactataatttgttgaagctgaaccccagcaactcaaacaaggtaccctgactctggagatgtgaaaatgtaaaataatgtgtggctttgatgaaatgtggtagaaccagaggattaagacttctgtggtgatcctctctgcctgaaatctaaatttaggagagctgagcaaacaaatgatcaaaggcagaacatgtcttcccgaccctctcggctgtgtaggcgctccggcctcaggggatgcactgactttcctcccactgtcctgaacacctgagaatcctgagcggggaacaagttgctcaaagggcagagaagtgactcagaggttcagcaagagaaaagcccagtgtattaagcatgtctttttattctgatgctttgctgtctgggccttgcaaacgtgagagggactgcccctcccaggggtagccagttcctacggttagcaaaggactcacctgggaggacagctttcatatgcaaaccaaccaatccagagcccacaccctgtgaccacctccatctggctcaaactcaaggccactgtccccctgacctaatcacccagggcctggtaccagacaattagagataactcctgtgaccccagatcctgctgaaattattcaaactccccaatcctaaacctgcttaccctgcctcccctttctttccttcccatggaaagaataaaggcgctttcccacattttcccctggtgccctcttctggagcaaccctggtgcttccccaggtggcctcctgggcttagtgtgcccccttcctcttgggctctgtgagtacaacaacttgtaaagataatttttttttagagcagttttatgttcacagccaaattgagagaaaagtacaaacagttcccagatactactggcccccacacatgcacagcctccccgattatcatcatctcccgccacagcagttgttacaactgatgaacctgcatcagcacgcacaacacccaaggtccacggtttaaattagggttcatttttggtgttgcgccttctatgggtttagacaaatgcatagtgacatgtgtccaccattatagtatcatacacagtattcattgccctaaaaatcgtctgtgcctcacctagtcatcccttcctcacccaacaactgctgatctttttactgtctccataattttgctttaacttgcttttcagtgacaattgcctcctgggatgttggccttgccacacctgaataatcatcaaacctgcattttatttgtttttatgtgtatgtgatgggttttttgggaggttggaggggaggacagggtctcactctacgccagggctggagtgcagaggtacgatcactgctcaccacagccttgacctcccggtctcaagtgatcctcccacctcagcctcccaagtagctgggactgcaggtacacatcaccacccaggctaactttttgtagtttttgtagagatgggatttcaccatgttgcccaggtttgtcttgaactcctgggctccagtgatctgtctaccttggcttcccaaagtgctgggattacaggtatgagccactgggcctggccaaactgcattttaaaatagccaagcctgttccttgtgactattgcctcatccttgtattcaagactgctgtaagatcataatcctaagcaagagtagagacatgtagcacaccatgatcacttactgtctaaccaatgctgcccacccgcttcccttctgtatggctcaccacccccaccccaaactcctataggaactctgcacacactccctctccattatgcaaaactggtctcagaaaggaatcagacagaatatttctactgaaagtataaagcttaatatgttacttcttacaagaatatttgcatataacaagggaaaaaaccttaagtcatgcagtaaacttttatcttttttttttttttaacaggagtctccctatgttgcccaagctggtcttgaacacctgggctcaagtactcctcctgtcttggcctcccaaagtgctgggattacagacatgagccacacttctttttttttttttttttttttttttttcttgagacagagtcttgctctgttgcccagactggagtacagttgcacaatcccggctccctgcaacctttgcctcctgggttcaagtgatcctcaacctcctgagtatctggaactacaggcatgtgccaccacaccctgctaattcttgtatttctagtaaagatggaatttcaccacgctggccaggctagtcttgaactcctggccttaagtgatccgcctgcctcggcctcccaaagtgctgggatttcagtgtgagccactgtgcccggtctctttttttttttttttgagaccttgagaccgggccttgctctgttacccaagctggagtgcagtggcaggatcatagctcactgcagccttgaacttctgggctcaagcaatcctcccacatcagcctcccaagtacctaggactgcagatgcttaccaccatgcccagctaatttttcatgaatttttaattattgaaattcagacatctaagaagatgctgaggactgtctccatattcctgaaattacgactcacctattcacaaaccagcccttctagtggaattaaaatattatttgattttgaataccctactctaaggtaggcacattgccctgcaatttattatttatgaggtttttaattatggaattgttcaaatattcacaaaagtagagagactacaatgaactccaatgtagccatcactcaggcccaactgttatcagcacagtccaatcatgttttatcttcccttctctgacccccaacccatccccagtccttatctaaaatcaaatctcaaacaccatatctttgggagcctatttatttagttagttagttttcagacagagtttctttcttgttgcccaagctggagtacaatagtgtagtctcggctcacagcaatctccccctccttggttcaagcaattctcctgcctcagtctcccaagaagctgggattataggcacctgccaccacatccagctaattcttttgtgtttttagcaaagacagggtttcaccatgttggccaggctggtctcgaactcctgacctcaggtgatccgcctgcctcggcctcccaaagtgctgggattacaggcatgagccaccacgcctggccggcagcctatttaaatgtcatcctcaacatagtcaatccttgggccattttttcttacagtaaaattttgtctctttcttttaatgcagtttctacgtggaatttggacactttggccttccaggaactgaagtccgagctaactgaagttcctgcttcccgaattttgaaggagagcccatctggctatctcaggagtggagagggagacaccggtatgaagttaagtttcttcccttttgtgcccacgtggtctttattcatgtctagtgctgtgttcagagaatcagtatagggtaaatgcccacccaagggggaaattaacttccctgggagcagagggaggggaggagaagaggaacagaactctctctctctctctgttcccttgtcagagcaggtctgcaggagtcagcctttccctaacaaagccctctatcctatcacccacacttgggaggctgggctgggctgcacagggcaagatgagagatgtgttgatttcatccacttgattgtcatgtagaattagatatacttgagaagttacatttttcagtagcgccttcatatctttattttagggacaggtatacaccaagcaccatctcagccacaatctgttactaacagtatgttttctgaactttggccacttaggaaaagtacagtttggctctctccaaagtgttccctgaaagtccaactttatgactaatactgtgatttccagaaactttgactatccatgttattgacaatgattactagcactgaagggcatgcatgcaagtaggggttatgaaatatttaaaacacggttctctaagatatgagcagcaaagtgtttctaccttctatgagggaaccgaaggtgccattaaaagtagagaaatctggaccaggcatggtggctcatgcctgtaatcccagcactttgggaggctgaggcgggcggatcacttgaggtcaggagttcaagaccagcctggccaacatggtgaaacactgtctctactaaaaatacaaaaattagccaggcatggtggcagtcatctgtaatcccagctacttgggaggctgaggcaggaaaattgcttgaacccaggaggcagaggttgcagtgagccgagatcacaccactgccctccagcctgggcgacagagtgagactctgtctcaaaaaaaaaaaaaatacagacatctgttgtgattctggtaactctaaattttcaaccgtctcttcactacatttaaaaaattattttctaaaccaaattagccaggtgtggtagcaggcacctgtagtcccagcaactcaggaggctgagatgggaggggtgcttgagcctggaaggtcgaggctgcagtgcactgtgattgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaa

SEQ ID NO: 34793 - DNA, 52447 bp, Homo sapiens
gcttactcatccagtgtggattacactaccagcaaaacatcccaggaaggagtccagggtggccgcccacagttaggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcagggtaaggatttttaggggctcttgagctggaattttttggggggcgccgggaggtgtgctggggccgcagaccccatacaggaggtaagttagagaaccacacgcaggggagggatgctgctgcttccaggggcgggcgcggcgctgtccgcagcccccggtgctgaaacgggccgcgggctggagagaaagtgaaaaaggatcggctacggcctcggctcccactccccggctcccatacccctccagtccagttcaaaggacaggaagccctccccgtgctccccaagccgatcgcacccccttttactcacgtcccacagccgcgctgggccgagcccgctgagccgtcggggcgggaggcagaaggagcagggctggctcccgctggggacgggtagggcttgcagccgcgaccccaccccatacatttcctcctgtcacgctgtccccggaccgccagtccgggaaggacccacttccccggctccaagtcgggagcgggcgccgcgtcttctcgagtccgcgccgcgccgggggaggttgagtcagtggcctggagggagcagggccgggggaaggcagcggcgaaggactgccccccaacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagccgtcaggcttttctctttagctcagcccgcggcccctcccgacgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacatcttccaaaggggcgaggctgggatcagcaggaatggcacccacccgggttcagactccatcccggagtggacagctcggtgcccctaacattatgcactgtccgccaccccctccccccaacacatacacactttcattcatgaaaaccagcaagaatagtgctgtctgggcacggagtccaatgtacagcgtgcgttcacgctgagaattcatgggggacgcgggtggttgggccgggagaggagagatggtcacttgtgtgtggtatccaccaactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttggggtgactggctggtggaggcaggatcttaatcactttagctgggactttggccgtgactacgtgtgcacttgcctttgatgctcctgtttctatgtcttttctgtcctcattcaccatctgctagtggtggctgcctctgattaatattgaggttgccatggcgaccagtctccagtcgccatggtacccagaaggtaaacagttggaagctactcaggctctttccagctctggccgctagtttccctagggagtggggcggggacggcagtgaccaggttccagaacccttctccgtcccgccctccccttcctccctcattcccacagcgtcctgctcacctgaaacccctgctaatcccccaccaaccactgtggcctcaaggttgagatgggccatgcttttttctctactgaggctgggggtaaacagttttctctctgacctaatgcattttggtaacaccctgaatatttctgagtacaaaggacaaggctcagtctggtgggagaaacaaaattttaaacagacacagtccctgccctctgggacctcacagtgtagtgtggcagacaaacccttgtgcaacctaccaggtggcctgcattccgggtgtaaatggaggtgataacagagccctgagagttgagagaggtgggagtgactgactcctggtcagggtaggcctccccagcaaggttatgttgcaactgaaacttgaaatcaactggccagcaagagaggaaaatctctctaggcagaagcaaggatgtgtggattagtcaggagagagtaaggccctgctgtggtgacgtatagacttggaatatcttggtggcttctccctttgcttatgcaatgtctgattttttggggagtcctgcatcatggggggagtccacttgccagaacccgtcactcagccttcacctggcctgaaagggaggctggaaaatgcaggaggcacaagatgggctttggtgagcactgtctctgccagtaggtgggggcaaaaaaaaaaccaaatgtacaatacacataagggaagggtgagtaatttggcttagatgagcatccagtttaggctcacttgatccaaattatgaaaagtcttgaccatcaggctaagaaatggagactgcgtgctggagaaaataggcacctctaaaagcttctgagaagagtgacataattagaactacctttcataaagattctggggtcactatggaaggttcattcatttacacatttattcattctatactcattgagcacctccttagtgccagagaatggatggattgtaggagtgacagcctgaagatgggagatgagcaaagataactatttcagccatcctggggagagagaaaggcctggatcaaggcaggaacagagctcaaagagaccagaagcaacctctgttctgattccacacttatacacctgtctagtctatacactagactagcacagggtgagtgctcagtacatttctgaattagtaaataaaagagttggaggggatggaggagagagatagctgttgctgtgactgatgctggatctggggcagtaagggagagggaggagtgaaagctcacacagtcttagctgggtagtcagttggctctgggtgttgctcatggcattaaccaagacagtactgcagggaggaagagcatgcttgacagtagctgggggagacagtgatgccattcagaatagttttgctccaaggaaaactctttcctgaactcggcctgcacccgagaactcatctaatccccagagtgcttcttttgtcctcctttgcaggattcatacatttcacctagaattatactaatacagtgtaggggttaaagttaaaccggcttctgcccccaggctctgccactgggtgactttgaaccaaggtatttaatcattctgagtctcagcttcttggtgtataccttggcagtagtaataattataatgccttcctcatcgagttgttgtggggattaaatgaagtaattgaaatgaaatcctcagctcagtgcctgacatatcgtaagtgctcaaagttagatatggacatcttattacctccttataaaataaaagcaatgtgttacttttataatcacaccacaaaagttaattaagaaaaaaaacactttgccttccatgcttgcaattaggtttggagcatctatagagttggctatggagagctctgtttccccagctctggtaaggtccgaaaagcattttcatcctcttgcaatctcaacctgaacagctgaatctttttacaaagcagcaattccaaaactgagcacactcagagctgaggaactcagagtcccattaattctgaatcatctctgcagagaccaggacactttctaggcatgagacaagcccctgcctcttggttaagaaacataattgatcatcttgatccaatttcagtgcattttcttttactccaaatttcttcctgttcttaagaacaatcttaactttcttctcagacaggaattgaaactttgcagctgacatttggaagcttccatttgctcttgttataaaaatgctggagttcagagagagataactctaccttcctgtcatgagaaagtttctttgggaaacaagactcaactctcccaactcagactcgttatctccatcatggtggagggaccttgatgggtttgggacagccaccatagagaggaggaattggattctgaccttcatctcccttcatcacctcacagctcaaccctgagcacaacaggatacacccttgttgtctaagacttgaactgtctttttgggacctttcttgggcagatggaggaagctttaatacttattggtcccagaagttactttgtttcttgagaggcaagagcttaaaagcttgcaggctctacaattagattgcctgttgaagtcctggctgtgtgaactgtgtacctcggtttgctcctctgtaaaatggggatgatatggtttcgctctgtcaccacccaaatctcatcttgaattcccacgtgttgtgggagggacccagtgggaggtaattgaatcatcggggcaggcctttcccatgctgttctcatgatagtgaataagtctcatgagatctgatggctttataagggggagcgtccctgcacaagctctctctctgcctgctgccatccatgtaagatgtgactggctcctccttccaccatgattgtgaggcctccccagccatgtggaactgtaaatccattaaacctctttcttttgtaaattacccattctcgggtatgtctttatcagcagcatgaaaatggactaatacaggggataagaataatatttacctcataaggttattgaaaagataaaatgagttgatacacgtaaaaagttatagagcagtgactggtataatgtaagccctcaaaaatgtgatggtcattattattaatgtcatattttggcatttctcccctttattatgtttcatgagtttcttgtagctgatattgtgagttttgcattttaaaaagtgttttgattttagatttaaaattatttctttttagatataattttcatgccacaaatgtcacccatttaaaatgcacatttcactggtttttagtatatttatagttgtgcaaccatcaccacattataatcttagaacttttcaacactgtcaaaagggaccccgtatccattagcagtcattcctctttctccttctctccactcctgctccaggcaacctctactctactttctgccttaatggatttgcctattctggacatttcatgtacatgaaattatatattatgtgactctttttgtctggcttcttccacttagcataatattttcagggttcacccatgttgtagcatgtatcactgttttattctttcctatcgccaaataagattccatctgaataacattccattatgtggacatactacattttgtttatccatttatcggtggataggccctaataaatgattgtcgtttccacttagggctactgtaaataatgctgctatgaacattcatgtacaagttgttgtgtggacatgtttttatttctcttaggtataagcttagcagtggaattcctggatcacatggtaactcatgtttaacattttgaggaactgcccagctgttctccaaagtggctacatcatttacattcccaccagcaatgaatgaggcttccagtttttccacatcacattgtggaaaatggttaattgtatgtatcatcttgcctgggatacagggtgcccagataaaacattatttctgggggtgtctgtgagcgagtttccagatgagattagtatttgaatccatggactgggtaaagcagattgccctccccagtgttggtggccactattcaatccattgcgagcccgggtaggataaaatgtagaagaaaggggaattcattctttgagctgggacatcatcagtttcctgccctctattggccctctggttctcagaactgcaccactggcttttctggtctccaacttacagacagcagctcatgggcttctcagcctctaattctttataataaatcatatgtatatacagttgacccttgagcaatgcagggattggggtgctgatcccctatgcagtcaaaaatccacatataactcttttggcttcttcaaaactgatttactaataggcttctgttgaccacaagcctcacctataacataaatggccaattaacacatattttgtaagttctatgtattacaggctgtattcttacaatagattaagcaagaaaaaatggggtttttccatttgtcacatatctccaaaattttttccaatatatttattgaaagaaaaacatatagaagtggacgtgtacagttcaaacccatgctgtttaaggatcaatggtatatatatcctattggttctgtttccatggagaaccctaacacactcactaacacttgttatggtaatattaacattttatagttctttttctttctgtttttgaagctctgtaataatttttatttcctccacctaggttcatattcacacacaaaatatgagaggacactcaagtataatatttgcattgtagggttttattatatcatggaacttctggaatggaaggaccttttatagccatcctagtcagtgttgagtacagtcatctctcagtatctgaggagcatttgttccaggacctacccacaaataccaaaatttaacagaagctgaagtcacttatgcaaaatggcatagtatttgcattaggttagtacaaaagtaattgtggtttttgccattaccaatctaataaataacctactgtattagtccagtcttatattgctataaagaaatacctgagaacttggtaatttataaagaaaagaggtttactcagctcatagttctgcagatggtacaggaagcattatgctggcatctgctcagcttcttgggaagcctcaggaaacttacaatcatggtggaagcctgagggggagcatgcacatcatggcaggagtaggggcaagtgggggaggtgtcacacacttgtaaatgaccagaactcatgagaactcactcactgtcatcagaacagcaccaaggcagtggtgctaaataattcatgagaaatccaccactatgagccaattactcccacaaggctccacctccaacattggggattacaacagaacatgagatttgggaggggacatagatccaaaccatatcacctacgtacaacctcctgtgtactgtactttaagtcatctctagattacttatagtagtacctaatacagtgtaaatgctatgtaaatagtttgcactgtattgtttttatttgttttatttttattgttgtattgttattctttattgttttggtttttttcaaatattttcaatctgtgattggttgaatctgcagatgcagaacctgcagatgagagggccaactgtagtaagtcattgtgcttttgatttgtatttcctcatgactaaatacgtggagaatgttagcatgtgcttcttagccattctgtatcttcttcagataaatgtctattcaaatcctttgcctgctttttaattgagttatttgacttttgttattgagttataagagttctttatatcttgtggatatatgccaatatatgtcttaaaaatatattctgcaatcccagcactttgggaggctgaagcagaaggatcgcttgagcctaggagtttgagaccagcctgggaaacatagagagacaccatctctacaaaaaatttaaaatatagctaggcatggtggtgtgcacctgtggtcccagctacttaggaggctaaagttggaggctggcttgagcccaggaggtcaaggctgcagtgagcggtaatcaaaccactgtgctgtagcctgggtgacacagtgagactctgtctctaaagaaataaaaaatgaaaatagtttctcccattctttagattgcttttttactttgttgatggcatactttgatacacaaaggcatttttattttgatgcagtccaatctattttttcttttatcactttcaccattcaccgtgctgttaactgtggttgtgtcatggataccctttgttaggttgaggaagtttccttatactcctagtttttaaattattttcaccatgaaagcatgttggatttttgccaaatgcattttctgtgttcatgagatgattatgaggtctttgccctttattctattaggagggagtattacattgattgagtttgggtaagtctattttgcatttctgggataaacatcacttggtttccctgtgaaatccttttgtatgttgctggatatagtttactagtattttgttgagaacttttgcatattaatctgagtttcgaagtgtcctttcatgtaaattctgatattcaaattgttttcacttttcttatacagtttccaaaaatattaacattatatagttttcctttctgtttttgaagctctggaatgtttttattttttccacataggttcacattcacacataaaatataagaggaccctcaggtgtaatatttgcatatagtgttttgctccatcatggaacttctagaattgaaggacttttaataatcaactgggcctatgattttcaactctgttccacagtttcttaagatgttctgcacatattttaagttttttaaaaggtatatttaaatatttttaaaactcttatataaagatagcactgacatgtcttctgtaccaaactttaatatattgactatcatggccaaaattaacttgtgtcccactaattgtctttatcaaagttatcaaatacttttaaataaaatacaataagtaaatgctttatgcatcagggttttgtggattatttcattttaaataaggccatttctattattagatgaaaaaattaaagtgctggtcacttacccacattggaggctaagctgggaagagaagccatctctccttcctctcaggccagtgcccttaaccacttatactgcctttcaaatgtgatttgagtcaaacaaaagatatttcactcagggttttctctctccataagcctaggactctgcttcaaatcaccaggcctctttgccggctgtaggaatgtcagtgtggtgcccacgtcagctctgtggggtggttcacaggtctcagggtaattaagtgcttcagcactggagaatttcccttctaccctgcagttctcaagcaggatgggggcataagggaaaggcaattggaagagtattttggaaaagtgttttagaaaagtttcaaagtatgtagaccctgggggagttcttgacttatctttggagtttaatttgatgaagcgagcctgcccagcctcacatttactgataacttgctgagtgcatttgtccagggtgatgctgagaaggttgagttttggaggactgaaatgaatcagactcagacagagtctgagaagattacttctgagaagtaagatagaagaccccagtgatcagtctctgctggagaaaacagtggcctgggctaagtatgcctgtccatcaagactctgtactctgtcctgattgagatttcggcttgtttgccatggcttgtgtccagactcggcacctcactaattggacccgccaaaccctggctgaatagagtctcctccccaaggatgatgatcattcagaacgacttccagtggacttacagtgcatccatacagggctatggacacctctgtgttgtctctccattgtcagctgcattcagacttggaaaatggtaatgtttcaaaccacacaaattgcaccaggattagttttgatgttcaggtcacaataaaaaagaagacagagaacaaacaaactgagtgtaaatggtcagttagtcatcatgaatggggagcaaggttttctttcggaagcacgttcagtctagagcaaggggctcgaaatgtttggccctcctttgtagtatgtttgctctctcataaattcccacttataaattccaagtggaatggaaattttcagtgtgactcattcacacaatcattgtgaggatcaaatgagtaaatatgcacttaaagttattagaacagtaacaggcaaagattaaacaataaatacgtggctgttattatcagtgtcgtcatgatgattcctcaccagttcctccatttatcacacgctctactacctactaaatgtatgtgccgggtgtttgaagaataaaatgttttttaggtaaaaggaggcagttcttgcctttaaggcttttggagtcagtaaaggaacaagaaaagtacaagaataactggaatacagtgagctgcgttaaatgcctgactactcaggcgtccgggccaatgacagtggagagagcccaggatgagcactggagtgcaaaagtcacagctgaatccttgaaggtacacagcaaaatgtgattgtaagtggtacatgtaacactgtaatggtaaatgttgaatagtgctaagtaaatgtgatggcttctcacctgggaagcctccttaatggtccctaaggcagaattaaggatttcctccccatcctgcattgcacccatcgtgcctctacctgtatttcaacaccatttgcactaccttaccctcactgtttaacacgcctgttttccccatgcaaatgttgtgctctcaatggcagagatctgtcttcctcatcttcacaattctcaggaccaggtatagtgcctgggacatcattggcaaggagtcagtaagggggctggtggcagggggacatgctagatttagtcatgttgtaaagaaaatggaaattgcctgaaatggcatgttcttagctctccagttaagtcctagaaaatacacattcatttgggagatgctcaaaaaccactcctagactcacgcctgggatccacttcaaggtcaccttcacagttgcagaatgcatcttcttgctagttttgaaaattaaaattccatttgtacatttccaatctcctgcagtgcctgtgataaacagaacaagccataatgtggatttcagagtgagacaggcccaggggtccatttccttatctgcaagatgagcatcactattccctcttggggttactgaggattcacgcgtgatggatatggaagtgcctcgcacccagggggccctggctagatggcagctttcattgtccacagagcctcaggatcactgattgtggtttcattatctcattggtgagttctactcacaaagagtttatcaaggcagggccagatgtgaaaacacatgcagtggttgggtaatctcttaagatgtcatgactcaaaaactgataaatacagggaaataattgtttattcggcctttcctataggaattgaccaatcaaataattaagagtaaaattttttcttttaaaaatatttcagctaattgaggaaggaatggtagaataccaccaacttgcaacctctaatgaattgatggatctagcaaatgaacatcaacagctgctaatgtcccccagagaaatataagatcttatgtaccttctgatggaagaacaaagaatcccctatgaaattgtcatgcaaaaaaaaattaataaattgaccaagcttctgggtacagctaccagtagtagataacattttaaagttggaattagcaaaaattcatactgtagtaaactccattggacaaataatgaaatttctacacaaagagaaaaactttagaggtaaaaataccaagaagatataacaaccaatcaacaagattggttccttatttggttcctcctgattttttaatgtattttttcaaagacaaccatttatgacacttatgagacaatagggaaaaaagatcttctgagttatcttaaacttacatttccctttagtgatgtacattttgccctgtcctactccaaccattgttttcctggataaagaacatagaattaaaagggaaacttggctcactcctaaaccttgagggacttgggtcaagagtacaaatgacccacttactgtagcccaaatatctaaaagttaaagattctcttagcagtgatacccactcccctccaaaacagagccttgaacagggaatgcaggcaggcagtttatttggggagtgattccaaggaacaggagtaggggtcttggagagggcaaaagggaaagaggacaagccaacccagatgtccattatcaaactgatcgccactctgggcaaccaggggttctccaaggagccaggtagaaagtgtctcagagccaccttcctgagggatggaagagtatattccctcaggctcctgcttctattggtccagggttgccccaaggatgttaccccttcagcttttgcacatgtatcagaacggtgatgtggtctcagcaagtgtttcctgggggaagtaaggaagcccccaaggcagaaggccctagaatctgcagtgtcactgaggcaaagtacatgggttacccagcatgcagctggttgccatagcaatggctggactgaaaggtgggcaggaaggatgcgaggtagaggaccagaaatgaccattacatggaccaagatagcacactgttaaatcaaatgtgcccaccctcctaaactggcaaatacactgcattaccacctggaggccaggttcaaaccgagagtactcaggccccttggagttgagcctgagagcaggaagtcatgaggagagctgatctctggttccctgcccacaacctgcccccttctgtccccagccctaggtccacaccacgtcaaaggggccttgcacaggaggccctgcacacctgtctgtggacgccctggccacatctccaggctctgtctcccccaccccccacaaacagctgctccttggccatccttgggcctaggggagtgcaagctggtgcactcagggagatggaccagggaagagtcccaggcaggctctagaaccagttgaaagcctcttggacagagaatctgggggtttggggcattcagaccatagctggagcaggggcagggttcccggtgggcatggccccttgattctatgggcttctcgaccctttgggagggatgtggctggaggagggccagcatggggtcctttaaagcagagacccctcctgcccaggcctaaaggcaataccagttccctcaatgactttgcactctcaggttttggagtcagacagatttttagtcaatcctggctccggccttcagcagcaaccttaaggaaatgactcacctgtccagtttcttcatttgtaagagagggaggggggctgctgtgaggattaagtaaggaagtgttgcacagcactcacctgtggctggcacctagtggccctcaacaggaggcaggtctatgggaggacagaggtactgcctccatgcaatggcagtgggaccagagtttgtgcccaggatagagaaagcagctgagggggctgaaggaaggggcacaggctggagacaatgcactttatttggtgtaatttgcctggaaatgtacaaagaagagtaattcgatagtttttccacagagtcccaaacttctttgagacttgctctgcaccccacttgactgtcagctcctggaggacagagctgcatatagctctctaataaagccccagcttctagcatattgcctggcacatagtaagtgctcaattaaaaagtgttgaatggacaattttgaattggatttattgcttttttatctaaaaacatataaacattccattttaaagtattgaaaataatgaggccggggggaggtgggagacaaggatttggccaaagtctgcatatactaagtcaaatagggttgagtcctaatgtggcttctggacctcacacgttctttggaaagttacataacctgttataagcctccatttcctcatctatgcaatgaagacactaatagcatccacctcagagactctcatgttagaataaacaatgatgtaaaaagcttagcacattgactggaataaaatcagatttcaatatattataactactactatttggataacacacatgaatatgtgtgttatttttatttttattttattttattttattttatttattttattttatttttagttctggggtacatgcgcaggacgtgcaggtttgttacataggtaaatgtgtgccatggtggtttgctgcatctatcaacccatctctaggtattaaggccagcatgcattagctatttatccagttactctccctccctgccacccctggagaggccccagtgtgtgttgttattcccctcactgtgtccacctgttctcattgttcaactcccacttataagtgagaacatgcagtgtttggttttctgcttccgagttagtttgctgaggataatggcttccagctccatccatgtccctgcaaaggacatgatctcattcctttttatggctgcatagtattccatggtgtatatgtaccacattttctttatctagtctatcattgatgggcatttgggttgattccatgtctttgctattgtgaatagtgccacaatgaacatatgcatgcctgtatctttataatagaataatttatattcttttgggtatataaccagtaatgggattactgggtcaaatggtatttctggttctgggtctttgaggaattgccacactgtcttccacatggttgaactaacttacactcccaccaacagtgtaaaagcgttcctgtttctccacagccccacaagcaactgtccttttcttgactttttttttttttttttttttgagacagagtcttgctctgtcgcccaggctggagtgcagtggcgcgatctcggctctctgcaagctccacctcccgagctcacaccattctcctgcctcagcctccagagtagctgggactacaggcgcccgccaccacccccagagaattttttgtatttttagtagagacagggtttcaccgtgttagccaggatggtctcgatttcctggcctcgtgatccacctgcctcggcctcccaaagtgctgggattacaggcgtgagccaccgcgcccggccttcttggctttttaataatcaccattatgactggcatgagatggtatgtcatcgtggttttgatttgcatttccctaatgatcagtgacgttaagctttttttcatatgtttattagccacataaatgtcttcttttgagaagtgtcttttcatgtcctttgcccactttttttttttttttttttttttgaggcagagttttgctcttgttgcccaggctggagtgcaatggcactatctcggctcactgcaacctctgcctcccgggttcaagtgattctcctacctcagcctcccgagtagctaggattacaggcgcctgccaccacgcccagctaattatttgtatttttagtagagatggggtttcaccatattggccaggctggtatcgaactcctgacctcaggtgatccacctgcctcggcctcccaaagtgctgggattacagatgtgaaccactacacccggcctgcccactttttaatgttgttttttttttcttgcaaattcatttaagttccttatagatgctggatgttagacctttgccagatgggtagattgcaaaaattttctcccattctgtaggttgtctgttcactctgatgatagtttcttttgctgtgcagaagcacacctgaaattaattagatcctgtttgtcaatttttgcttttgttgcaattgcttttgatgtttttgtcatgaagcctttgcccgtgcctgtcttgaatggtattgcgtatattttcttctagggtttttacagtttggggttttacatttaagtctctaatccatcttgagttaatttttgtaaaaggtgtaaggaaggggtccagtttcaattttctgcatatggctagccagttctcccagcaccatttattaaatagggaatcctttccccattacttgctttggtcagatttgttaaagatcagatggttgtagatgtgtggtcttatttctgagttttctagtctgttccattggtctatatccctatttttgtatcagtaccatgctgttttggttactatagtcttatagcatagtttgaagttgggtaccatgatgcctccagctttgttctttttgtttaggattgtcttggctatacaagctctttttggtttccatatgaattttaaagtagttttttctaattctgtgaagaatgtcaatggtagtttaatgggaatagcattgaatctataaattacttcgggaagtatggccattttcatgataatgatttttttccatccatgagcatggaatgcttttccatttgtgtcctctctgatttctttgagcagtggtttgtagttctccttgataaggtccttcacttgccttactagctatattcctaagtatctgactctctttgtagaaattttgagtggaaattcattcatgatttagctctttgcttgtctgttgatgtataggaatgcttgtgacttttgtatcctgacactttgctgaggttgcttatcagcttaagaagcttttgggccaagatgatggggttttctagatataggatctagaagacatccttatcttgtgtcagttttcaaggggaatgcttccagattttgcccattcagtatgatattggatatgggtttgtcataaatggcttttattattttgttatttcttattattttattattttgaggtatgttccatcaatacctagtacattcctatgtacattcctagtacaatacctatgtacattctgttgttttcgggtagagagttctgtagatatctatcagatccacttgatccagagctgacttcaagtcctgaatatccttgttaattttctgtctcgatgatctgtctaatattgacagtggggtgttaaagtctcccgctgttattgtgtgggagtctgcatctctttgtaggtctccaagaacttgttttatgaatctaggtgctcctttattgggtgcatatatatttaaaatagttagctctttatgttgaattgatacttttaccattatgtaatgcccttctgtgttttttgatctttgttgctttaaagtctgttttgtcaggctgggtgtggtggctcatgcctgtaatcccagcactttggaaggccaaggtgggcagatcacttgagatcagaagttcaagactagcctggccaacatggtgaaacctcatctctactaaaaatacaaaaattagccaggcatggtggcatgggcgtgttatcccagctactagggagactgagctaggagaatcacttgaacccaggaggtagaggttgcagtgacccgagattgcaccactgcactccagcctgggcaacagagcaagactccatctcaaaaataaataaataaataaataaataaagtctgttttgtcagatactaggattgcaacccctgcttttttctcctttccatttgctttgtaaattttcctccatcgctttatgttgagcccatttgtgtctttgcacctgagatgggtttcttgaatacagcacactgatgggtcttgactccttatcgagcttgccattctgtgtcttttaatcaggacatttagcccatttacatttaaggttaatatagttgtgtatgaatttgaccctgtcatcatgatgtcaggtggttattttgcaggcttgttgaggttgctgcttcataatatcgttggtctttgtatttcagtctgtttttgtagtggctgataacagtttttcctttccatagttagtgtttccttcaggagctcctgcaagtcctggtgctgatgaatcccctcagcatttacttgtctgaaaaggattttatttctcctttgcttatgaagtttagtttggccagataggaaattctgggttgcaaattcttttctttaagagtattgaatattggcctccaatctcttctggcttgtagggtttctggggagaggtccactgttagtctgatgggctttcctttgtaggtgacctggcctttctctctggctgcccttaacattttttttttttcagttggggtcctgctctgtcacccaggctgaagtgcagtggtgcaatctcagctcactgcaacctccgcctccccggttcaagcgattctcctgcctcagcctactgaggtccagtggctcgctcctataatcccaacactttgggaagccgaggcaggcaaatcacttgaagttaggagtttgagaccagcctggccaacatggtgaaaccctgtctctactaaaaatacaaaaattagctgggcatggtggcataagcctgtaatccctgcccttaacattttttccttcatttcaaccttggagaatctgatgattatgtgtcttgaggttgatcttctcatggagtaccttattggagttctctggatttcctgaatttgaatgttggcttgtcttgctaggttggggaggttctcctggatgataccctgaagtgtgttttccaacttggttccattctacccatctctttcaggtaccccaatcagtcataggttcagtctttttacataatcctgtagttctcagaggttttgttcattctttttcatttttttttcctctaatcttgtctgcctgtcttatttcagcaagatagtcttcaagctctgaaattctttcctctgcttggtctatttggccattgatacttgtgaagttctcgtgttgtgtttttcagaaccatcaggtcatttatgtggctctctaaactggttactctggttaacagctcctgtaatgttttatcatggttcttagcttctttgcattgggttagaacgtgctcctttagctcagcaaagtttgttattacccactttctgaagcctacttctgtcagttaatccatctcggcctcagcccagttctgtgcccttggtggagatgtgttgtgatcatttggaggagaagaggcactctggttttttgagttttcagcatttttggcagattctttctcatcttcatgggtttatcttgttttggtctttgaggctgctgacatttggatgggatttttgtggaaactttttagttgatgctgttgctgttgttgctttgtttatttctcaatagtcagacccttcttttgtagggctgctgcagtttgctggggatcctctccagaccccattcacctggatccctcctgcccctggaggtgttaccagtggaggctgcagaacagcaaagatggctgcctgctccttcatccgggagatccgtctcaaaggggcgctgacctgatgccggcaagaacgtgcctgtttaagatttctgctgacccctgttgaggggtctcacccagtcaggaagcacaggatcagggacccacttaacaaagcactctggctgactcttagcagagggcatgcgctgcacttgcgggggatcccactcatccagactgcccgattccttaaagccagccaggggagagaccaagtccactattcagtggataccacagcagcccctccccgcaaggggctccatcccagggacatccagcccctggctggggttgctgaaattccagcggggaggccctgcctggtgaggagggatgggtctgggtttagcctaaagaggcagtctggccacgatctgccacagccgctatggtgcactgtggggaattcctcctgggcccaaactgcccagtctccacgactccagcaggggaaaatggcagactggaactccagtgatggcggccacccctttccccaggagctcggtagtcttaggcagtctccagtgtagaggccgccaagaatctgcacagctctgtgcttgagacccaaggccctggtggtgtgggctcacgagggaatcgcctgatctgtggatagcacagatccatggaaaaagcgtggtttcctgggtagggtagcacaatcactcaccgcctcttttggctgagaatgagaggtccccttgccctgtgccgctcccaggtgggcaggcgctccaccctgcttgtcctcactctccttgggactgcctagtcagtcccactgagagaacctggacacctcagttgctggtgcaggattcactcaccattttcattctccttggtgagaacctctgacatcagctgttttttttcttttttttcttttttttttttttttattgagacagagtctcactgtgtcccccaggctggagggcaggagtgcagtggcgcgatctcggctcaccgcaagctccgcctcccgggttcacaccattctcctgcctcagcctcccgagtagctgggactacaggcacccaccaccacgcccggctaattttttgtgtttttagtagagacagagtttcaccatgttagccaggatggtctcaatctcctaaccttgtgatccagccgcttcggcctcccaaagtgcggggattacgggcgtgagctaccccgcccggctgacctcagctgtttctagtcagccatcttggtccctccccggatttattacttttaatgagtacaatttcttatgttggtcctaaagttttgcaggcatctcaaactggaatcattctctttctctaacgtgcttcccccctagttccctgtctcaatgggcaggcaacaccccccatcaccccagctgttggggcactgtgttcagcacctcttcctccccaccccttatacctaaattgccatgtcctggcaactctacccacttgctatcactaccacaaagctagttcaggcagttgttctctctcccctaagaaactgtggcaattttttagctgctcacctcacagggaactcatgttccctgaatacatcctccctggtctagccagagtggcctgtacacacctgaccacattcctactgggctttagggtaaggcccaagctcctgggcacaacctgcaaagcctgttgtagcacctgccccactgcactgtcagatccttgagaacaggcttcgttttatttctctttatagctcctatgatcagccagaaactcactcattgttacataagtgaataaagtgtttaaaaatcaaaacaatgtttgatctattgagaaaaccagaatatttaaactcatagacttaaactatcaaacatcagagacaagtcaggaccctgctgagccgatggctgcccttttgtaactggcagagggttggccaaatgtgcatggccacaccaatggctcctgtctctgaccttcctttggatttggaattaactgagtcctggagtgagtccctgggctatttctagaaattgccatctttctccggagtggtctccactgacatctgacacacttaaacgatgtggctgctcaagagagcctgtgctaatctattttagagaaaccatcctcagaaatgcatcttccagtgaaagacttatccaaaaatcatggaactggccaatcacaccagccctgctctcacataggctttcttttcaatcacaggggcaccttccaatgtttgccaaagagaaaatgttcatgacctgatttctggcacaagtgtaactgcccaaggggttcaccttccccactgcctagacagagccaacttatcaagacaggggaattgcaacagagaaaaagtaattcacacagagctggctgtgcaggagaccagagttttattattactcaaatcactcttcccaaaactcagggatcagggtttttaaggataatttgttgggtagggggccagtgaatcggaagtgctgattggctggcttagggatgaaatcacagggagttgactctgttctcttatgctgagtcagttactgggtggaggccacagaactggttggtaggtcaaggtgtggccatccggttgttagaaatgtgaaaacctgaaaagacatctcaaaaggccgatcttaggctcacaatagtgacgttgcctttaacagtaactggggaagttgcgaatcttacgacctctggaataatggctgataatatttagaattccagcccctctcattctaacttggtggctgttgggcttttagttgttttacaaaaacagtttagctttgggaaagggctttaatttaaattataaattaaattccttcccaaggctagttcggcctacgcccaggaatgaataaggacaatttagaggttagaagcaagatggaattggttaggtcttatgtcgttcactgacataattttcttagttacaatttttcaagacgatttcacaaggattgtgccacattgacaggtggatctatctttcattggacaagctacttaacatctctgacgctcagtttattcatctttaaatgggaataaaaataataagtacctcacaaagttactgtaaggattaatgagatgaatcgtgtattgggtttagcattatattgtaaaggttttctgaatgtcacatatggtcctttttttacatgttgtcttaaagcaagatttgagggagcagtggaaataggtgccaaattataagataaaaataaggaaacaagaaaaccagggtcaagagggacactgcatcatctcaaagaatcatgagggcttcaccttccttatatcacataccaacttggcccttcatttatttattcattcactcattcagtacttaactctgagcatctcttcagcatggtagcataaacaaatgagtaaaagactttgtgccttatgctagaaagaagagcctggagatgtccaactaaaactcactgcagcaggaactacaagagacagcagagggtgtgcctgccagggcttgcaggggggccgcgtgcggtagcccttgcccttgatgagctgggtttgcagttactttcctgtcctgatgacgtgtctgctttgtgttcacattttagcaatcatctggggggctaaatgtgacaaaccgagaagatggccaagatcaacacccaatactcccacccctccaggacccacctcaaggtaaagacctcagaccgagatctcaatcgcgctgaaaatggcctcagcaggtaagatgggctaagatgggcttttcattttatgcctggctctggtcatttccacagctgatctagactgtgggggaagaatgccttcacgttggccagccacaggtcagagggcaggggaggtattcacagcactgccaacttcatttttcatctcacttaatcctcacaacccccagaaagtagtctgtattcttgttttagagatgtggaaaagcaggcttaaatagtcacttaattgctataaggtaagaaaatgaagactcaaatgcagcagactaaattttactgtaagaacttcctcaaactgacacactctcccatgtattcatcaaaaatgtgttggactcttgctgtgcaccagccactgaactgggtttgcagtctgagctgggcaccaaagatgtagcatgaatcagatgccctgccctcgcttccaggggaagatctggaggcaggccatgcccagggcctgtatagggagtgggcagtgccccttgtcagccaagccatcaaccccatcaatgacatcctgacacaggtaggaaatggaaatctggagccttaagctctacttctaaccctcttcctaacttactagtagacctgggaaaacgcatttaaccactccatgcctcaatttcttcacaatgaaacagcattttttccaagctcctggtataatagtgaggacacccgaagggacctatttactgtacatagagctaaacccttatgtttctttgtttttagttttttcctttttgtttttcgtgacagagtcccaccctgtcacccagactggagtgcagtagtgcaattagtgcaatctcggctcactgggttcaagtgattctcctgcctcagcctctctagtagctggaattacaggcacccaccatcacaccctgctaatttttgtatttttagtagagacagggttttgccatgttggccatgttggtctcgaactcctgacctcaggtgatccacctgcctcagcctcccaaagtgctgggattacaggtgtgagccactgcacccagccatgtttgttaaatgattaatgagatgattgagttgaagcatgagcaactttctttccaatgtttctgttatttttgccctatatatatagaattgaaaacttctccccactatgcagcttaaatgcacactgtctgatggccccaaaatgcagtaacatccctcagtccccacctccctgcactgggccctcgtgcctcatttcttctcattcatttgtgttcatcacttcctctcccaaaggcacatttggttgtttctctgtctacactcttggtcccagctcctcagcaaactctgctaataagtgatggtcaataattttcaaagagattgagtccccattatggcaaacccacacagcccttgaaccccaccttctgagatttcggcaatggaaggaagatcccagagcatcccaacagatatttatttcctccaaccattttaactcggtgctggggccccaggaagtgtgatatggcttcagaggcatcagaaagttccatcctactcaaatacctttctcctaactagccctttgtcaatgcctgcgtcgcaccactggagacttagtcctctaagttaaggcattgctccttatttaaaagaacaaagaacactattaggaccttgaaacgtctgtatgttttaatagtttatttcccatgtgtgagctaataaagccccttgaagggggtttcaaagagagggtcgggcatcagggagaaggagcccaagaatgaggcacagcataacatcacgatcctgggatcctgggcccaagaccttgggagaaggaccagaggctgtcaggatcaggaagattttgaagcagaatggaacttttcctctttgcacccaacttgcctggagtggggcatgacccaagcatgtcatggagcttccagattccctaaaggcagagaaggcagtagtgggatctcagtccggctccttccggtgagatacccactggagtaggcacccagaagaaggcagtcctggtctgcaggctgctgcggctcctgcccacaatgtctgcctgacttgacagcaccgtggtcctgctgactcaccctggttctgctttggccagtgacctccaagcccagcttgacctgtatcctgttgaagcttgcaaggcctcttagaagatgaccatttgcaaaatgaattgctagcttgttaagccatgctaatagcagccactggcctctggcttctggcagactctctgcaggctcactctggaatgcacactgacaagggtcacagcacctctagggatcagccacatggtcaggggctctgaactgacgtcttgagataatgctatttgtcgtctgcatgggtgagaaaaggtcctcccttctccttcctttgcactttctgtgaccagaatgatggtttaacagcacaagcttggggtcagactgcctgggattggacactggctctgcaactgacctgctatgaaaagttgctcagtggctccaagcctcagttttctcatctgcaaaatgaatcagtactaatattgccctcctagggttgtggtgaggttactgcagatgtgaatgcagaggtcctggcacagtccctgctatgtggttaagtgctcaattgactcccactcccggtcttggaaatgattacttcttcctgtggcccttctctggtctcttctccttgacctcagatagccgcatttcctgcctgtgtccaagccctgctgtttcagcctgaccaccagccgaggcttactgaactccactcaggtctcggccccacccttcacatggtaaattgacagattaatacagtatcccgtggaaacaccactgagatttcaaaatgagagacagaaagagtgcttcctttatgaaagagctatgctttatcttacagaggcgagactggctttaacagccagaaattttcagaatgttccttggagtcaccaaggaatgacagtgtgtactcaggatggggtacagcagcctcagggatggaggctgggcccagcccctcccctgcttcccagcccagcccagcatctgtctatccaccgatgaggtctctatgtgagactgatttgaacaaaggactcaggcacataccacgcaaaaatttttaagtttcaaatcactattttggagccaggagaaatagtgtttggacaagtcacacctctttgtcttgaaattccagtccttttagaaagctttatgagacaaatgattgagaattggggtacacgaacgttaatcgctctttatcttcagtgatatcaagaagcctgcactggaaacctgcgtgtgggtatggcccctcgctgagtgcccccaagaggaaggcatagccaagtctctgtcccctgagacttccctgccccaaggtcttttcaccaaattggagggccagtttttaagttattggaattatttttatagtggaaagtcatagggaagaatgaaaacatttcatttgaatgaaaacattttacaccctgaaaataccaaaaataagtctgagttttcatttctacttagatctttttagttggctcaattatttaagaactgtctggcatatctgtgaggataaggcaatagaaacaggctattctctgctgcagagaattgcagctaggactgagggcaacttaaatcccagatccatctcctggcgtagcaattttgaatgagctttggggcacgggggtttgtgtctgacagaagagtggtcttcttgtgttactccctgagcagagcccaaagcaattaccaccaaagaaaaccattttcatcccacttctccaggaccaaaggcttaaaaatgcattggcttcagtcccccaccacatgtggccaatagcagtgggttccaatcattcaagttcctcagggcttaagaagaggaaattaaagtgtcgtattccccagccttgtgctgaaaggtcacctctgtttactctcatgtccccaaaactatcttgctggaaaacatcagatgcttcaccaagtgcaaagttaatttccagttccagttctcatgggagcccctgtcctcgcccagtcacaagaaaccttcaccttaccaacgttaattcctctgtgcaaataaacgtagaacttgagcattacaaggtgaaaattatgttgtctttcaaagcagtctctccattctactagttgttcttgttcttgccaactaccaacatcaggggggcctcttccttggaaggcatcgaccccacatgggatcttagaatagcagcccacacgtgggagggaagctccagggttgtcctggcctggtctgttcattttacagagactgaggtcctgtaaagccattgccccaggcccttccaccagccacaggcagaacagagcctggccccacgactctcattttccattcctgcattagtcgccaaaagcatctcctttttttcggtacctgtgtgtccttggggactccaaatgtcacctcagacatcagttcctctcctctcttcccacctcccctccatctgcctggtaaaatcagtttctgggagaagtaattaatgaagtttactatgtaaacacccccaggcatttaatatgggtaaagctctggagctaaaagaaagacattgatctaatggaatttcaggcattgagaaggaagtggggcaacgcatagggaaaaaatgggcccccccatcaggcccctggaacttgcatcatgtaaggatctccctgttcttcacggccagttgtgcctttctggtaactgaaatccacatgaaattgccaacttttgctttatttgctttgtgaagatcaggaaacttaagcccagagagggtaagtgaccagcccacagaatactcagcctgcaggtgctggagcagggactcaaaccaggacctgccacctttccactctgcctcctccccctgagtgggcatcatagatcccgcccatatgcaacagctctcgctgctgctggttgcaggcctgctttgcaatcctgggtgggttttgccttcctcacccactcaccagctctgatgttatctaattcatttgccgcgaatgcaaataaatctggtctcaggatgtgccctcatgcaattagcaggaaccagactacgctaaaacgctgggccgactgcttggtgcctagagctccctgaggagctgctggtggcggcagaacacctccatccttgggattgcctccagatcttccaggcacacaggctgtgacagggcccccgcccagctgtcagctgccatcaccaccacccccatgccagcttctcgaatccaaggacctctgccacctcctcctgcaaccaacctaggtgcattggaacatgcatcctgcctttatagtatacagaatatgaagcgggcaagggaattgtagcttctggactgcagcagggtctctgacagggtcttttatgtgtacacaaatgagatgagagtgggtttcttatgagtataaggggagaattcaatcaggtggtttgaaaataaagagccatgcctatggtacagccatatggattacagcaatgtctctagtggcatgccacagggctcagtcctcagccatcctattaatttccttttcatctgtgccatatatgaaaatacagggcagcttcatggagtggatgacagcaagttttgaaatgggatggaataacattggaatctcggctgtaccacctggctatgggatctcggtgaagttgcttaacctttctgaactcccatttcctctcttacagggttgttgtgtggatgaaatgataaaatgtatgtggctggcatacagaaaagagccactgaatggcatgtggtttgtgtattttgtttgtgagtaggatggtgttgggaggaaaggtgagtgtgttctctgcataccaatgcttccaaaacatcgagttactcagatcagtgggaaggtccaatacttaattccaaaaaaaatcaattgcgcatacacaagccggggtcctctggctggcagcagcctgtgttacaggactgctttgggttttcgctgactgtagctggtgaccatcaaaaaccaccagaaacacacaaagcaataaagtcttcccagagtctgcccagtcaagcaagaccccaggaacttgctcacaggagaaggaccatgacaaggaagagacttgaccccaaggaggaattgctgggtgagctgggggttctggcctggaaacccagaagtcacacaggtcctggtcatggaaggtagaagacgaagctacctgactcccggtggttccagcagaaaacagcctcaatgtggggaggctgagagagggaagaatctgtgggcaggtggcgcagtcaagagacagcccaggcagaccggggcatgggagtgagctccctgttgctggaaaaggcagggaggaatctgtagaagaggagaagcaagcagcagcctggccaccgtgatgcaaggactctgacttctaatcaatcaccagggagagactgaagcttttccctggtattaattcttgcctccttgttaagaaggctaattgggttggaacaggtcatgtgatagaattaatttgtcttgcctgggctcctcaagactcatagactgaagtgcaaatccctagaggctaatgcctggctggcttttaatcaggctgatcaaacttcagccccaggaggtttaaaagaaaggaaaatattcccagacgcattcctagtcttattccaggcaattcaaccagactctgctggtgtgactggtggttgtatggagttacgggcacctgtcctttctggggtcacactttccacaatgggttgcacaaggggagtcaccacaccttacctctgccttgcaggagagagagcctagagtttggcaaaagggacgaggggaagtggagtctcatttgaaagcactgtacaaattatttgaactgcatgtggagagctaggccagttctgtgcaatattccagggcctccgtgttaaccagcgggttcccaggaagcctgccagacaagcccacaaacagctgcccaggcagtgtggctgcagcacacgcagtgggaagggaggctcagaaagacccctaaggagcgggtattcaatctagcctcagaagatgaaattcagtaggcgagaagtgttggaaccaaaatcctcgttctggagtcattttatggaagcagctgctttggcttgaaatggcaagccccgggacctctccccacccagtgctttgatgagggccaggccagcatgtactgccaccttcccgtcctttcacctagccctggacagtagctaccttccttgctgtaaaggaaaggccacgtttataccaaaatccagaatctatctgcaggaggcaaagggaagtggggagcccctgggatgaggatctgtgagggtggctttccctgctaagcagaacatctgactgtctcactcctggctgtgtccaggaggtagatgggcttgaaatcaattctgcttgctgcatatctgatttcctagagcccactcgtcaagtgaggagacatcgtcagtgctgcagccggggatcgccatggagaccagaggactggctgactccgggcagggctccttcaccggccaggggatcgccaggtaactgaccagcctcagtccctaccttggcctgggggacactgttgcagaaagaaggtagtgacctctcaggaaaaagtgctagatgggggtggagttgaagatttggaaaagaaagggtcaggagcagagcagcctgaaaactatcagtgagtaatttcctcttgggtcagatgttctgagctcagaaaagtctaaggaaaactgcctttatctgaaattgcttaataaaagctgacattgaggtacttgctcaggtttggaagaattcagaaaaaaagccaaccggagaaggtggtaagagcagccagccgtgggagacctttgattgggtggacacagtggtgtgctgaggatggtggtgatgagtctgaaatggctctggcagggtctcccgggtgctcgtctggaccccagggcaggtaggtgtccttgcaaaagcatttgtttgcaagattagtgagactccaagctctgcttccccctgatgacatccgtactccagcttcaacagctgctccatcctgaggaagtcatttcaccttttcaaatctcatctagaaatgcatctaacagtgcctaccccacaggtggcttgaaagctgcttcagagccaagcaccgactcacggcaggtgctcaacaaacaccaggctcattatttccttccaccacgtggttttttccaatgccagagtcttacatagtcacatgttctaaactttttacttaagattatcacaaaagaaattcacatatctatttattcttcatgcttttcattatgaaggatgctactccaccattgtttatttaactagtccattgtagctgggcatgtaagtgatgttcagtgtttgcattttactaataaagagctgtcttaaggttctttgatgataaaggaagaaagagaacacctttaaatcagctctgtagggctgatacagggtgtgttgtaagcttgcaacacaagctatctcagggaaacagagccagtggggctcgcaggaggggacctggggaggtagtcaccttccccctcccattttctcatggagtttcatggtctttgtgcttctttctgcatgtcccctccattctggctctctctgttccaatatcagctggcacaaggctgaaaacagcctttgccatgtgaccatgagttgaaacacccaaccctgtcttcgagtggctctcagttcagaggcctgagtggctctctgtgcgtcagttgtctgtcctagtcccattgtctgaggctggaggagggagtatgaccttggttccaccctcttggcagaggaagtgtgtggttacaggaattgtctgcggcagagagactgggcttggcagatacctccaaatatgtctgcggcagcagctgtaagcatctgcctacagagatattttcttagtcaatgtattgccttaggctaaggtcataagtgtgtgattagggtcaaggtatgtgacaattcatagcttagttccaggttgttcagtactgactctggctcgggacaccccgtccaggggagggcactgcagatgccaaatcagggaaaccagaagccaagaaacagaatggagtctctgggcctgttccccactgttcccctctggcagagacaccagcaacagcaggcagggtggagggaaggcccctctcaggcccgtgtgtctcagatgagctctagggactggcactgtggtcgcaggtgttggagctcacggcaagctccaggcagggccgggctccgggagagggcccagggcaagttgcaaaggaacctcccaggcctggggagaaaactctagtttgtacaagaacacaccaataagataaaagctgggaaaagactccaggttgtgcctggacgcctgttcctttaagccttgctgtatcagatctcaagaacttctaaataaataaataaataaccttgctctcaatgttgtcatcctttgaaacccacattgctttactcttcctgcacttggcagtcataacaaagagctctccattgggcaaaaggagtgagctaatcccccatttgaaggatcatgccttaggcagagtccaagtgctgcaaggacaaatggtaataaagagagtgtccctttccggggaagcctgcccctgactgcagggtggagggagaaggggataaacggtccccatggggcagagatgcaaacttagaccacagggcccccagcacccgtaccctgctggtcatcattgcttctgccccatcccttgagacagacagagagggagggagaaagagagagagggaaagactggggtttgggggtgtggggggcttttcctctccctctggctcagtgcttgtgtcaccttccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaaggtaaggaacggaaaagaagaaggggcctctggtgcctgctggggccaggcaggaagcctgtgctttgctccatcctgtttggatgcagcacaggtggcctggaacgtcatccccatgagctgttccttgaagaaagtgtttgcccttgggggagcactacatgctctaacagcctctgcggagtccaagaggccttgcaggagggagaaaacccttgaaccagagcccccagcctcatttgaccactcaccttatcctacacaggggtcctgttagggtcccctggaaatcatgttctcagaaactcatcgggggatgctggccttacctatctctcttcaccaaggacccccgtcctagactccactatgacccatcttgctcaaaagcagggtcttttatagcaggagccttgggggggtgtctaaatggtatccacaagtttatgtgtaggcacgcgtgcatttttctgggaagagagtctacaggttggtcagaattttcaaggggagccatccatgtcccagatcaggttgagaaataccaggtggggaaggggacaatggtgagagtagagcgaggtggggagagtgcttgctttctggagggaaaatctgcagaactggggcctctctgcatcttgcttcgcccccaccctaactgggagataaacctgcaatcagactggtagccccttacacacagacacagggctgctgcctcccctcctgacttgttcatgagaagtctccccagcaggtggtctgcagagagacccctgggccagcacaggttgaatcaattgtcactgagcagtagagggtctctttaggacacttaggtctgtctggaagggaggagaggcaagacgttgaggggaagctgacctcccctcggcctcccaaacaggtggcttctcacccagaacctattttctggggggtgggaaaaggggatcaaataagcatgatggctgcagaacagacagtccctatataatttgctagagaaaaagctatctgtatgtcaatgaggagaagatgggttcaggtttggagcttctcaaatggtcatatgagggtttctggtgtgtgaaggtgatgaagtctcaggggaaacccagtggctctttcgggaacgtccattttcattccatatttgtatggggagtggcagtgggtatttgtatgtcatagatgatgcaggggatggcgaacggcacgggcatttttaagatggaatatgagagttcaaggccatgtcttgccagtgactgctttaggagacccggggaaaggtgtgagaatccctgactgagatgggaaggccagagttttcacacgagcttggactgcaaacgcttgggtttcctgggctgggggaaggaggctggggaaggcctgggcgctggcccagacaagtgcagggaggtcccaggttcccaggactgggcatccagtatcctcgagggacaccatgagacagaaagataaggaggcaggcagataagaaagaggacaaagtggggaaagaggaagagggaggggggaaaaagaagtttctcagcaagccagccagactggtctaattccttttgggcaagcaaagacttccttatttaaattgatcaaattaccttcctacatccttagagatgaatgttagactctctgtccatttcccgatgggaccagacaaatggagggttgagctaggaccatatccagggcaggccccgaccacctcacagacatctgatggatcactcgcgggcagggtcagcatgggaagatggatgcgatggtgcggatagtgttggtcaatcagcaagtcttcctgggggtgaggattttgaatttttctggaggcaaagtctccactgcaaagccaagtatatacacagacaggtcctagttctcctgtgtgggcttggctttgtggggttacgggcacagaggcatggtgaacacagccactgcatcccccacggagctgaaccttccctccttcacaatcccacggcggttccagttcctgggagattttcagatgagcagaaccaatctagaaacaagcggttatggccatatcttagacggagagagggagatttgggcaggatgagctgaagtcatcataatggcatttatttggctggacatcaagcatcgtggaagaggtgccccgggagtcaggtgggggtgtcgcctgcctcaggctccagttcccgtggtctcctatgaggggtctgcagtgccctgcgaggccgcatggcttttttaacccagccatgttgaaaatgtgttctggcggtcagagataataccttttcctatagaacatcatgaagtactgcaaaattcaactttaaataaatatccagtttgtgcaaaaccagcccctaccttcaaccagattctcacatagatcaggggtgtcaggccctggagtcgtaaaatttggggagataggagaggacaagaggaggagaaactgaaaacagcaacaatcccacctatgctcaattacttgccctgctaattggaagaggccttcgcagctgagggagcaagtcgctgttgctgctgcaggctgcgtccatcctggggcagaaggtgcaagacctcctccaccacagaggcatggaagcactgagggcagaggccacgcagggtccatttctgtgcccctcttagtgcctggcacgtggccccatccagggtggaatggaaggaaattgagtggaatttgaggcagggaagctggaaggagtcaaacggctgaatcttttcttcagaagcctcagtttagccatgttcactctctcttcccccaaggcttttacccgaggtaactaatcacaaagcattttggccttgacaataccaccccgtattcttcaagctgtgagtgcaaaggctggaagcagtgggatagggattggggggtggggcatggtaatcccctggtgaaatggccccaaggaatggaaacagagttcagacccttgatgttctctctaccttcccgcagcgcctggcccctggccaaatgcaacactaacaccagcaacaacacggaggaggagtaagtacccacacacccagcagagccctccccaagcccggtgccctccaccccatagaagccccagcttggcctctctccttagtgctcctgctccccactcccagagcaccagtagaatattttagaatcctgttcccttcgttggaattccatccctgtggacagaagtcggggagggatgagatctgtgtgacttcttggggaagtcgtctgatctcttcgcctctcatttttctcatccataaagcaaaggaattggatcagataaatgctttaagctttagcactctataccacgatatatctgagggtgcagaaccggagttccttgacagagcactggagattctccttaatgatgaaaaggcattttcttattctacaacctcaggctcttgagtgccagtgaaatgcccttgtttttgctgctgttgttattgttgtttgtttgtttgtttttgagatggagtcttgctctgtcacccaggctggagtgcagtggcgccatcttgactcgttgcaagctccgcctcccgggttcacgccattctcctgcttcagcttcccgagtagctgggactacaggcgcccgccaccacacccggctagtttttttgtatttttagtagagagggggggtttcaccgtgttagccaggatggtctcgacctcctgacctcgtgatccacccgcctcggcctccaaagtgctaggattacaggcatgagccactgcgcctcgcctgaagttcccgtgttttaaggccaatttgggccaattttgggggcgtaatcagagcagtggaaaaaggcaatttaaatatgtccagagaatagcctcttcaaagggtgacctgctataattcctttttccatcaccagatactaaggtggcagattagggacagcgtggcactattcaggaggggaagtcttagttggagattagggaaaaaatacctatatcagtgagaaatgccgatttcttgacttccaacagacagagaaatgtgccaagggtttttcttgttatttctctctttgttcctcagctagaacttttttctattttctccatgaaggaagcatgtcttttgtttgcataaatttggacatcaaatccagagacccaaatgccagccataacgaaaaatgagatgattttatctacaaagcaatagctatagtgatatgtgtttgacttaaagccaaacctgacactaaacacccttgcagctgcagtatcaagtctttcaggcagggaacggctccagatactgaaaccatggacagaggtcctgggggtttctaggcatctttgtcctggggctggggtgtgggcaaggatgtgggtggatagcgtgggctgcacccggctcttcaatctttcaataaatgggctcacttcactggtccactttgaagccaaggaccaagggacaaaactgggaactatcccaaaatgaggacacacacaaaataattatttatgaacaccttccccgactcttcactccatttctgtcattttcatatggtctcatttgtcctgaataatttttccctcccccatcaaactgttcccagccaaaaccagcagcattttgcagttctgtgtagggttcttttggggcagtgctgggtggatttggggatgcagccgatggtgctgggtctttcctaggctctcagcagtttggtacccagacaggccaaggcccgtaatccagggccacaaatcttgcacaaggcaagctgagtccggcgtaaactgcagggcaaagctcacccaaaaagcttgagggcagcgccgtctgctggtgacttgacgttaagactccagtgcctgaaaagagaccagggttcacatcaccctggaggacagaggaggggtaactttccttgctcttttcatttaatgattttaataaccttttattctaattcactttattgaaatactcttgctgaaaacttggaaaacaagaaaagcacacaggggcatacacacacaaaaactgcacttcatgctaaccatggaattccactatcagagatagccccacttaacatgttgacaaatatacttccaacttcttcctaggcatatatattgaatacttagattgatacaatatattttatatatacatatacttgttaagagcatctgtttcccaactcagttgcctcagagctttgtgaccttggacaagtgtattagtccattctcacattgctagaaagaaatgcctgagactcggtaatttatcagaaaagtggtttaattggcttgaggtactgcaagctatacaggaagcatagcagcttctgcttctggggaggcctcaggaagctttcaatcatggtggaaggcaaagggggagcaaggagtctcaaacggcaggagcaggaggaaggtggggtaggtgccgtaaacaaccagatctcaagaaaactcactcactgtctcaagcaaagcaccaaggaattggtgccaaaccatgagaaatccaccaccatgacagggacacagattcaaaccacataagctggttacctaacttctctgtgtatctgtttcctggcttataaaataaggattgtaatagggtcttattacatggtgggagtgaagactgaatgtgttactctgtgaaaagtgctcagaacagtgcctggtacatagtaagtgctcaataaatattgacttgtgtggtaggcagaacaatctcccccaaaagatgtctaccatcctaatccttagaacctgtaaacaggttacctcatatggcaaagggaacttcgtaaatgtgattacattcaaggtccttgagataggtaatgatttgacttggctgtgtccccacccaaatctcatcttgaattgtagctcctctaattcccatgtgtcgggacagatctggtgggaggtaattgaatcatgggggtgggtctttcccatgctgtgaataagtctcacgagatctgatggttttgtaaaggggagttcccctgcacagactctttgcgtgccgccacgtaagatgtgactttgctcctcatctgccttccaccatgattgcgaggcctcccaagccatgtggaactgagtccattaaacctctttcctttataaattacccaccctcgggtatgcctttattagcagcatgagaacagactaatacaggtaggttatcctggattatcagggtgggcccactgtaatcacatgagtccttaaaagcagaagagtgggtcagagaaagtaaatggaagaagaagagagtcacagtgtgagggggactcgacccatcactgctggctttgaagatgtaggaaggggacctgagctaaggaagccacagcctcgaaaggtgcagccagcagggaaacagggatctcagccccacaatcgcaagaagctggattctgcgtaagatccaaacgagcaggaatcagagccccgcctagagactctgggggatggcagccctgtcaacaccttgattttagtctggtgagatccacagtagacttctgacctacagatctgcaagataatacatttatgttgtataagtttgcagtaatttgttccggcagaaatagaaaactgatccagctattacggtaaactcttttgtagtctgcttcttaacttagcaaaatattaggaaccgttttcccacgtcactagctcttctgaaacagcgttttaagtggccatgtagaattcaccgttgaggatgagcctgcatggtcgtgtgattcggtggctctccctttttgattgtcatgaataatggcagtgattatttttccacacgtatcgcacacagccttgattatttccataggaagtgttaggtaattgtgaatggatctttttcaatgagtgtttaattagcagaatttatctctcaaccatgccttccttcagcgtgtggaagagagaaatcagaggggcctgaaggggactcgaggggttgtcccttccgcaacctttgtttcttcaactattcaatggggcattactgcctgccttgaagaaatttacatgtattcattagataactttataagagttcctagctcttaaaagacacccaataaagaagaggcagcagtgtgaagtcttatgttgaagaaaaacctgcagtcacaggaccatcctgcggacgctgcctgaaccgtctcgcagcccagcaaagtccgaaggcgtgtctgaactcggccacatttgcgaacctgcgaccacacgtatttgccactacatgcgtcacagacccgcctcttcgaatgttgcttcccttctgctcactggctttctcattaaggcccaggttttcacttgatccagagagaggtttcaagaacagcggacaggccacacccttccattcagaacggagagcctggcgtgggatttccaaaactccgagtaactttcccaacttcaatgtgtggatttgggtctatgtcgtactacctcaaaacgtctccagtctctggctgtttgtgacttcccaggagctcatgaaaatagatcagaaattgtagaacattagactgagccactaatttctcaatgtatactcaatggggtggtttacctcacgcttcaggaataataataacaaatcaataaccccatttcatcccaatgcgctggaagcaccccttgccacgccctctcttcaggacgtctccacgacgccacacgccacgccctctctccgggacgcagcagcctgccccttccatttggtaatgtccttgatatatgaagtctgctaaatgtgccccggcatcatccagcagcaaggcagaaaagaacgaagagaaaaaagaagagagaaaagctacctaaaacacgaggaggaagtactgaaggaagctgcctctaaagacggggtgccatggtcccagcaggcctgacccctccctgcagggctccagggctgggtatcttggagcaacgctatcagggggccttagcttcggccctggaggggagagggtgcttggagctgaggaaaagtcggtcccagcaggctgcagaccatgcctcctgagaccatgtgaagcccccatcttgcagaaagaatcctctccaagctccgggaactcaaggggggcttataagtaaagagagttgcttgtctgcagcctccggtgggcagccgggggctgcccctgtgagcctgctcatgtgccccccacccgaagcatttcgtttgccctcacaagtgggccggccacacgtaggctgagggcttctctggggcactggaagatacaatgttcacaaactttcacccaaattcagtggtgatgagagctgtagggaacgtcccaaagcccggtcagtgagtgaccttgcacttgcagcatccaggtgaaggcaggaagtcactggggtctccgatggagcacaggagcactctgcaggcctgggccagcgtgggtcgcatgggatggcagaggggacacatggacccaacaaaaaggcagtctccagtacagcctgtaaacttgaatctgcgggaaattctaagaataaaagttaagcactctaagctatgtatttcattccgtgcgggcccacgtgacaggttattcccaggcttttgatggagaggtgtgatgcaagcccttggaaatgagcctttacatcgtccgcacaaacacagtgagggaggtggagagggttctggagggaatactgtggggctccccaactctgtccagagaggggctgcctcagaactatccaggcaatgcttaaatgcatatttccaggcccagccctggaagaggtgagtgggccctgggaatcagaattttctggaagttccccagactttagcagacctctgtgacattgccatgctgcgttttcattctcagcatcctgaagggtgtggatgttgtcgtgggcacatgggaatgtcatcaccattaccttatagtcgaccgtgacctcctgggactgagctgggagagaaggacctctggagtctaccctacctcctggcctgccttcccctacagggactccccatgtgactcccttgagactaagaggaccctgttgtggacagccacatcttgggcttcagcctgaaattgccctaggctctctaaaaccctccaaagctacagtcttggagcacagtgcgctgtttgtgtatgtgtgggtttccaggaagaagacgaaaaagaaggatgcgatcgtggtggacccgtccagcaacctgtactaccgctggctgaccgccatcgccctgcctgtcttctataactggtatctgcttatttgcaggtaagcgacaggggtggaaggtgcagcggaaagggggaaaccagggcaccaggcccaggagccagagctccacctctccctcgggaggcctgaggcctggacccctcacggccaccacttagttattgtgcctcggtttctccttttaaaaatagaaggttccccaagaggaccatcagagtgctctgaagcatgggtggggaattgagcttcaggtggacagccagggtttcggcactgtggggccccctcaagtgagttgtacgaggaggatgcaggggcggttgcttctctttggagggataagtgggtggttctgaacatgcagcagggtagggaggcaggggcaagctgctactatttttttctttttttttttgagacagagtctcactctgtcacccaggctggagttcagtggcgcgatctcagctaactgcaacctccacctcccgggttaaagcgattctcctgcctcagccacccgagtagctgtgactacatatatgagccaccacgcctggcttttatatatatatatgtattttttttttagtagagacagtgtttcaccatattggctaggctggtcttgaactcctcacctcaaatgatctgcccaccttggcctcccaaagtgctgggattccaggtgtgagccactgctcccggcctctactactcttctaataagcagaagagggattgagggcctctcctaggaaacctgtttgtgaatgcagggacgagatactgctcctcttaggggaagccaggggcctgggcttttctgagcaggcctccagggtggggccaccagagggaacgttcctgagcacgctgtccaccaaggatgcaggacaagctgctgcttgtgggggctggcggggactttggggcatttctgaggaagcctgcaggctgcaagctgcaggacaaggaggagggatgacctgctgctctctctaggtaagcatggggtttgggggcccttcccagcaggcctgctccaggacaccaatgcagggtacactgttggtcttctgagggtacacgggagggcttaggggacttcccaagcaagtgtgcaggacaggtgtgcaaaggcaggtctcttctgagatgtgtgggactgggatgcatgcgagaggagacgatgcctctggggctctccggagccagtatgcaaaatgaggatgcagaggcaagtcctgcctgtccttctgagagtaggcagtaggctttggggcactcctgagcaagcctgcaagacagagagccactgctctgagaggctagttgatgagttttggggcattccagattatgccgcacgtcagggatgccatccacatggaagcagaggctttcgattattcgagcataggctgatctcctgctcttcggagggattgcggggcaggtgaaaactggaagaacttggagcctgtcccagcgagcagacaggatggggtgcttgggcaagctgctgctctctggtgcacgcgggctctggggaggcagggctgggcactgttctccttcaggtgggcaggaggctttggggcgctgagcaagcagcaggtgggcggcaggggcaggctgctgtgcccgtgaggataggaggagagctgggggtgctgcctgtgtgggaaacagcagaaagatggagaaggtagaaaatatttactgtctgttccattgttaatctctcggaaattctcctatttttgttgaactttgaccccagaaagggcaggtctttagcccctttacctgactctgccagtgtggcctggaaaacggtacctcctgggatcttgtagctctctgctgagaggcaatggggccgctctttggggtcaatcccagctcttctcaggagttctgtgactgtgggacagaaaagcttctcagagacatctcatcagaagcgggggtgattacactgaggtagtgacaccgcaggcagggccattcccatattacatgatccagcgtcttccacacagagcccgtgcccacaggtgggtggtccacgctccagaaacacacgcacagccatccatctcccacatggcttctttagggcctgtttcgatgagctgcagtccgagtacctgatgctgtggctggtcctggactactcggcagatgtcctgtatgtcttggatgtgcttgtacgagctcggacaggtgagtgtgccccaggcctggggaggggaccatggcccccacgggagtgttccgggagacccagcatggtggatgggacattacctacccttgaccatgagaggccaggcaggtctggggacctccgacagtgagggtaggtggtgcggcctcaagcccttctacacggaacccttggacaggacgctgagcaggggccaggacacctaagctctgggctctgctcttccaacaagctgtatgaccttgagcaagtcaggctgtctctctgggccttgttcttgtcacctctgagataagcaggccaggccaggtgcagtggctcacatctgtaatcctaggactttgggaggccaaggtggacagattactggaggtcaggagttcgagaccagcctggccaacatggtgaaaccccatctctactaaaaatacaaaaattagctgggcccactggcatgtgcctgtaatcccagctacttgagaggctgaggcaggagaatcgcttgaaccccgggaggtggaggttgcagtgagtggagatcatgccacttcactccaacctgggtgacatagcaacattctgtctcaaaaaaagaaaaaaaaaagaaaagaaaagaaaagaaaaaaaaagaaaagaagtaagcaggccggactgcaatctcgaaggacccctccagctctcactactcgacactggggtaagcaggaaggagagctcagtcaatcttggagtttctcttcttggacagtcagcagatacaggacatgttactccgtggctttcagaggacttttaacatgtggagaatgaaaatctgaaatagggcccaggtgaatgaggacttccttcgaatcatctgtggttggggatgggaaaggatactcaccccttcacatttcttaggtgctgaactgtgtgcccttgggacatctttttctaatctgcacaaagacattgcctaagctggtagaggccctgtttccaagatttttgaactgaaaactgtgccaggccaggcatgggtgcaggcacctgtaatcccagcactttgggaggccaagacagaagggtcatttgaggcaggagttccagactagccagggcaacatagcaagaccttgtctctacaaaaagaaaaaattagctggacgtgttggtgtgtgcctcaggaggctgaggtgagaggattgcttgagcccaggaggtcaagactgtagggagtcatggcctcggtttacagagcaagaccttgtctcaaaaaaaaaaaatgataaaataatgctatgccatagctgttgatgtaaacaccagcagatcacagtagccgacctccgtgtggctccacgtacaatacatttcaagtgcgtcttgcttcttcattagaaccactgcatgagacaagaagctcaggtgtgattacctccatcttgctgatttagaaaccaacatcagagacaccaagtgacttgtccaaagtccacagtcactgcccagccacaccagactggtcctctgtttgcttccacactggtgcctagcgtcataacttagaagacctcagatacacaggctgaggcttgcgtgggtggcctagccagccctggtcacctgccccgctgctgcagtcatgttaaactccacagacacacgagctctgtaagtggcccattgggctgatggtccctggtctcagcccagcttcagtgggatgagacaccccgactcagtcattaaccctgcaccttcttgtgcttgggtagtaccctaagcaaccaagattcagcaggaagctgggagagagggaggcacaggaatcacactccaaggaaaacatcattagaattgagagaagacatcttaaagaagtggggaggaggctggaggcacaggaggctacataatgatcaaggccctcagtaacgcatgtataacaaataatgctaagaagaactgggggctgtgaagtggggtgttctttgttgtgacagcacactagattttcagtttgagcagagtgagacgtcctaccccagtctagcctcggtggcctggacccgcagccctagcatcacctggaacttgctagacttgcccccaacttccgggagccaactctgggttgcaggctggcactctgtgtttcgcacagccctcagggaaattctgatgctcaccgcaattttaaaaggactaattatattattctctctactttcgtgcatgtttgaaaatgtaaaaaacaaaaaagaatgcaggtcatggcctccttaattgatttcacccatcataatgcccctggctctaggtgtccagcccatctccagaccagtcagattctttgggggtgggtcccgaacttcatatattttaaaagccctttgggtaacagtcacgtgcaaccaaggaaagctgtgttcctggaaggtgttttcaaaaggcaggttgtgccccattgctgactggtgaaatcaatttgggaggccatggcctgtgttttttacatttttattattaatattttcaaatgtatgcaaaagcagagagaatagtgttatgaatccccatgtaccctcacccagctccagctgttatcagcattctgcccatcttgtttcatctgttccttttcttgtttcatccgcccttttcttgtttgattttcctgtttttgtttttgctcttttgtttcatccacccttttcttggctggcataagcaaaccccaggcagtaagcactttagcattttgaatagaaaatagaatgtctcaggaagtcaaactcactctgccaaagggaagagttaggcttgggaactgagtcatgcaaaagctgccttccttttctgcccagatagctgtaatttcacatgcttactttatcttacgtaaaatgtagtttgcataatttacttttcctccactcccttcttttcacatgtagattcactgagcgctaatcaaagcctagcaagaatataaccactggcctcattgcctacccaccctttcttttctttcttctctcctctcctgcctgctgcctgctctgtcccctttaagtattgacatcctcaaaaccctctttggaaaaagcacaggccacagatcttactgtgacttgtgtttctttctcctaggtgtaccttcaaccttgataaaaataaacctctaaatcaattgagatctgcctccgtcactttttttttttcaaagactcagagtctcactctgttgcccaggctggagtgtagtggtgcgatcttggctcattgcaccctccacctcctgggttcaagtggttctcgtgcctcagcttcctgagtagctgggattacaggggtgcaccaccacatctggctaatttttgtatttttagtagagacagggtttcaccatgttgcccaggctggtctcaaacccttgacctcaggtgatccacccgcctcggcctctcaaagtactgggattataggcatgagccacggcacccggccctctgtcactttttgatttacaacatgtatctctaattttaaaggatccttttttaaaatatgtatataatttccatttatcttttaaaatttaataatcattctttgttatcatgtaatacccaatttatatttaaatttactcaatcaacctatgttttaaaaaaattcaatagaatagattagaacctcatagaatagaaaatatcagagtgcatttcctgtagtaatggtaagtgttgtttttgaaatcatttctattatatatgtatcactgcatactgtgtagccgtgaggtaaaatatgtttctttgtactatggtcaaaaaaagtcagcctctgtgatgcccaatgacctccatcttcttctttaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaata

SEQ ID NO: 34794 - DNA, 48180 bp, Homo sapiens
gcaggcgccgttggggtgcgcatccggggacctgcaggttacaagcagcagatcccaccttcagtcctggctctgacaagccctccaggtaaggcgcctttgcatttagccgagctagagaagagagctggaagccacctctacctttcacggggggaagggactgcccgcgcgctcgcccccattatctcagccctccgaagcgcgccacggactccagccttgtctctcacccccagcctcaccccgcgtccctgacccgcgagtctcccgcccagctccgcgtccccggtccctgcctccaggcgcgtacacggcgcgctaagaggcgcggggagctcttagcgcacctactacttaaccggaccggctacttactggccgccaggtggaagcctgcgatcgagctggccgggcctcccagcaccgccgctctccaggctccctttccaggactcaactttggtcccagccccaatcgcagctccggtaacctttccaggaaccgaaatgctagatacagcggaaggagaaacggagggaggaagacaaacccggagcagggcggcgcggcagtttggacacgccccgagctctcctgggctctcagtccccgtcaggatgggaggcgcgtgccgagggaggaggctgaggacacagcctcctttcgccctgcgctgcccggccttccgcgtgaccccgcctatgacctcggggcgttccgcctacgtctgaccgtcaggtgcgcacgcgcacttacaggcttgttttgccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcaggtgagcggatcctggtggagggacccctcagtctcctgcgctgttgggactggttcctttccgggcgtcacccgcactgggacaaaccctcgctgccagaggggttccagcgcggtgggagccggtggctgggttgtgtgagccgaggagattcgctcccaacgtaggagaaagggcgtctggccgcaccgtgcggtgatgagcccgtgggttcgagtgacggggctggagaaacccaggctgctgctttgcctgttgcagcacccaagctgagaggtgacagcgtgctggcagtcctcacagcccttgctcgctctccaggcctcctctgcctgggctcccactttggcggcacttgaggagcccttcagcccaccgctgcactgtgggagcccctttctgggctggccaaggtgggagccggctccctcagcttgcagggaggtgtggtgggagaggcgtgagcgggaaccggggctgcgcgccgcgcttgcgggccagctggagttccgagtgggcgtgggcttggcgggccccgcactgggagcagcaggccggccctgccggccccgggcaatgaggggcttagcacccgggccagcggctgcggagggtgtgctgggtcccccagcagtgccagcccactggcgctgcgctcgatttctcgccgggccttagctgccttcccgcggggcagggctcgggacctgcagcccgccatgcctgagcctcccacccactccgtgggctcctgtgcggcccgagcctccccgatgagcgccgctccctactccacggtgcctagtcccatcgaccacccaagggctgaggagtgcgggtgcacggcgcgggactggcaggcagctccacctgcagccccggtgcgggatccactgggcgaagccagctgggctcctgagtctggtggagacgtggagaacgtttatgtctagctcagggattgtaactacaccaatcggcactctgtatctagctcaaggtttgtaaacacaccaatcagcaccctgtgtctagctcagggtttgtgaatgcaccagtcgacactctgtatctagctactctggtggggccttggagaacctttctgtcaacactctgtatctagttaatctagtggggacgtggagaacctttgtgtctagctcagggattgtaaacgcaccaatcagcgccctgtcaaaacagactactcggctctaccaatcagcaggatgtgggtggggccagataagagaataaaagcaggctgcccaccagtagtggcaacccgctgaggtccctttccacagtgtggaagctttgttttttcgctctttgcgataaatcttgctactgctcactctttgggaccatacggcttttatgagccgtaacactcaccgcgaaggtctgcagtttcactcctgaagccagcgagaccacggggaggaacgaacaactccagacgcgccgccttaagagttgtaacactcaccacgaaggtctgcagcttcgctcttgagccagcgagaccacgaacccaccagaaggaagaaactctgaacacatctgagcatcagaaggaacaaactccagacgtgccaccttaagagctgttaacactcaccgcgagggtccgcagcttcattcttgaagtcagtgagaccaagaacccaccaatcccggacacaaagccaccacattctgtatcttctgcattccatatttggccctttgtagctgatcactttccagatttcacagtttcaaaatgatggttttaatagatacttgaaggtatcggtcttagtaatgacctgctgcctaattgcctgacaacctcttgatagtttaacaaatctgtccaaaatgagctcgcctttgtcctatgccaaatgtacaaagaaagactaattttaaggcattaaaggaataacgtcagtattttgatccttataattctggttgttctgatcctagtttatgggcagtgactcgggaatgtatacctaatgtatttttacctttaggaaaacggaattactattttatttgaaatatacataataattacctcaggtaaattaataaattcagttaaacttcagctgtctatgaccataataatttttactcatttgttccccttaagcaccaaccttttgtgagcactctaactcaaaaccctttggcaaatgtatttctctggtcctcgatttactaaacagagtttatgcaatgcagttttatctttacttgattttatcttgagatcattaaaatgagtttagatgctgatatgaattttagtagagtgatgtcctgagagcctattgagacatttgggactgtttgcttctataccaatttattttacactgctatactttttttttgagacggggtcttgctctgtggcctagtctggagtgcagtggtgagcctggagtgcagttttatctttacttgattttatcttgagatcattaaaatgaatatcgatgctgatatgaattttaatagagtgatgtcctcagagcctattgagacatttgggactgttgcttctataccaatttattctacactgctatacttttttttgagacggggtcttgctctgtgggctagtctggagtgcagtggtgcgattttggctcactgccacctctgcctcccaggttcaagcgattctcctgcctcagcttctggagtagctgggattaacagacgtgggccaccagacacggctaatttttgtatttttggtaaagacagggtttcaccaggtggccaggctgatctggaactcctgacctcaagtgatccacccacctcagcctcccaaagtgctggtgtagaagcaaacagtcccaaatgtctcaataggctctgaggcccgttgctatactttttaagtacttacgtctgctttttagtttttctgacagactgttttcctcgcagactgttctgcatcatgtttttgaaatctggcagcaacagttgttttattgttgttgctgtcaccatactctttccaccagctttaatttggggcttcttgtttgttatagctttgataaccctggatctatgcttaatgtaactgtgtgtcattacaacctggtagttctgactgagagctaaatgtctttcctactagttaagtgcataagcttgagtgcgtggacttcatgacatttggttttctcagaactcagaaattctttttttttttttttttttttgagacggagtctcgctctgtcacccaggctggagtgcagtggcgcaatctcggctcactgcaagctccgcctcccgggttcacgccattcttctgcctcagcctcccgagtagagtagctgggactacaggcgcccgtcaccacgccgggctaattttttttgtatttttagtagagacggggtttcaccgtgttagccaggatggtctcgatctcctgacctcgtgatccgcccgcctcggcctcccaaagtgctgggattacaggtgtgagccaccgtgcccggcctcagaattctttttgcttcgtcctggtttttagctattttccagataattgcaggatccctgagttatgtttaaatgtggtcttctggtacattctgtcaccttgtacaaaagagaattttttttcatactcttagctttgatttcatcaaagtgattgatgctcattaggatctgtccagatttaggtgttcctgccaataatcaatacctctgattgaggttctagatttagcattttaaaaacaaaaagggagtattttgaaaataataagtatatgtctttaaaaacaagtatattccctagtaaagtgaacctatgtacaactagttggcaggacctgttcactttgaatatattgcacaaacatgtctaggtcaccaccaacttttcctcactaacaaggttgattattatttgctggtctggtggagctggcctcttgaatcctcagtgctccccactgaccccctctatggagctttatttaagacaacaggggttggaaaacatttcctgtaaagtcccagattgtaaatattttaggcttgtttagggcaaggggaaaaatcaaggatattatataggtgtttagataaccagaaaacaaattccacaaaattttttagtaatgacatttaaaatataataataagtataatataggtttgttaatgaaagggatagaatttggtgggggaggggatgacattttccttaattgcacttcagagttggtgttttctgtcatcaaactgataaatattcatctgtaaaaaccgtttgtagctcacgttactgatccaagttacaaatgatttcaaaatttttttgcaaccttagcctagtctctgtaaaatttgtattattagggcatctgtccttatagggcatatctttatagaatattttcagtttatttctgtaactgttataccactacactgttctgtcactgagcacacacttctttcttttctctctcttatttatttatttatttttttgagacagactgtctgttgcccaggctggagtgcagtggcacaatctctgctcactgcaacctctgcctcccaggttcaagtgattctcctgcctcagcctcctaagtagctggggctacaggcatccaccaccacgcctggctaatttttgtatttttagtagagacagggtttcaccatgttggccaggctgatcttgaactcctgacctcaagcagtctgcccggctttggcctcccaaagtgctgggattacaggcatgagccactgcgcctggccgttgttaaattttatctaactcattttgctgatcagttcactccactatattgtgtattccttttagtttttaagtcacaagtttgacaagcatgctatcatttggagtatttcagtttgtaatagaaatgttgaacaggataaaactgtagtactacagttttactggaaggaaaatctcaaatggggaactaatgccagaatgcagcagtgattatagaaaggaattttaaaagttaagcaaatcatcttagaaatgcagcattcctttttgtacccggtcatacaagaaagaagcctctggaaattcaatcagatatgtgacatatttgtctgaatcatcaaagctaagaaaatgtaataaatatggtcacttgattgaaggacagttgcattctcctatatttctactgtctccaacaaggtagaaagataatttttttcattgaagttatacttttttaattaaaaaaggaaaaagtaaatctttttattttgaaaaatgttaaatctatagaaaagatgaaaaaatcacgaacacctgtatatcctgtcactaactgttagccttttccacactgccgaaatctttcggcaggtacatacacacccacacgcacctcttttgccaaactacccaaaagtaggttgcagacattgtgatactttgtcccaagtacttaattgcagcttgcacctcccaagaacaaagaaattcttttacgcaactccatcactgttacaactagaaatacaatattaattcaagaatatcatgcaatacatagttaatactcaagtttttccaattgttccaaaaatataccttatattctttaaaaaaacaaaaataaaaaaaaccaggagccatatgcaggagataatcaatgtttatgcatttgttgttaggtctttttagactcccctaacctaaaactatcctttgacctatctctttcttgtcaccattaaaatctttgaagagtctaggtcaggttttctgcagaacatctaatattctggatttatggactgtttatttcaaaatagatcctggtcaaacatttctggcaagaatatcacatgggttatgttgagaacaccccactacattacatcaaaaggtacaggatgccaggacatcccactactgggaatgccaaacatgaccacttgttaagagggtgactgctatatctttcaattataaaggttcatgttccattttgtaattagtaagcagacactggggtgacatttgagggcctttgactatcctctccttaacaatcttccagtcagttgttttagcatccattgatgatccttccattatagcatagaaagtggccattaaattattattttctaattttatcctttcaatatttaataattgtcatttgtcattaaaagaagaaagattttgtctgagctctaaatcagtcactcaaacaattttattatttttttagaatcaaataatttacttcttgattccctaacttagatatatctggttttttattcaaattctagtatattgatttcaaagtatgggcatctagggttctggtatttttctcaggtaagctacattatttttatttttttcttatctcctttgactcagaagaggtttgtttatatggaatgacatatatagtgttaaacactttaaatatattaggaactaatatgtttggcatataatacatctaaaaacattgtttctcttcttcctttcctctttaccactcccaaccatatcacgtttgaaaaaaaaaagtttcttttttgaagactaatttgacagttctaaggcttatttttaagaaattaatcttggaacataagaaggcattttgtctgttctgcatgtcttgattatttgaaaagataatgctcacgttaaggtgaacttgttaactctttctattgtgtgtgtgaaaatgtaatgagtatatagactcatgtgtcacctaatggaggtaagatatctacttagtatacatgcctttggtccagatcagacgcttatccaaaagatcacttaagtctggggagtcatggtctctctttggtctgctgataaaatttatctggtaacccatttaggaggtcccagggctgaaaatgtcttaggttacgttaaaccttcctggtatcattcctgttttctgaagtaggaagccaaaagagcttcctgcagcaatttaatttgctgtcatcaagtagagcatgttataatgatgacagttattattttttagtacttagtagctacgggggatctagttgtagctagtttatttgatttatcttgacgtaatttattcatttttacaaattgcaacactcttgattaataaatctgtgcatgtcaatggtagcaaaataattgccttgcaaaaagtttcctcttttaaaactatactgtttcccaaatttctgtatacaataatgcatatatacaatccatggaaattcaaaaaaataatgcttattcatagataaattagtgtagcagaatcaatattggtaaattctacctctatcacatcattttcataactagagaataaaactgttgacacttaagatccacatgtaatgagataaatttatactacttttttcttctttacacctagagaatgggacattttagagactgaagagcattataagagccgatggagatctattaggattttatatcttactatgtttctcagcagtgtaggtaagtattagaaatacataattttaacaattcagatcagatgtcatattttaacttcatttacttcatttactttcattgcctctgaaattatctttattgtgctaaaaaatacgtgacataaatttaccgtgttaccatatctaagttcaatagccttaagtatatccacattgttgtgcaaccaatccctagaacattttcatcttgcaaaagagaaactctatacccattaaacaactccctattttcccatcccccaagccctagcaaactttgtttcttggaatttgactattctagatagctcatataaatggaattatatagtattttttttcttgtgatgagattatttcactcaatgtcctcaagttggttcatgttgcacttgtgataatttccttttatttaaaggctgtatagttcattatatgtattctagggtaggagaaatttttcctctattctcctatgtgcttaaggcttgtgaattaagctgacaaaagaaagactaacagttaaaaaagtatacaaatttatttgatgttaatattttttaatgaaaagaaacaaataacattaaggaatgtacatacaaacgaaactagacaactactaagagtccctaacactttcatgtactcacaaaagtatttcatctttttttttttttttttttgagacggagtttcactcttgttgcccaggctggagtgcaatggcacgatctcagctcactgcaacctccacctcccagattcaagcgattcgcctgccccagcctgccaagtatctgggattacaggcatgtgccaccacccctggctaattttgtatttttagtagagacgggatgtctccatgttggtcaggctggtctcgaactcccaacctcaggtgatctgcccacctcggcctcccaaagtgctgcgattacaggcgtgagtcaccgcccccagttaaaaatatttcatcttttttctttttttttttttttcaagacggagtttcgcactgtcgcccaggctggagtgcagtggcgcgatctcggctcactgcaagctccgcctcccaggttcgcgtgattctcctgcctcagcctcccgagtagctgggactacagacacccgccaccacgctaattgttttatatttttagtagagacggggtttcactgtgttagccgggatgtcttgatctcctgacctcgtgatctgccagactcagcctcccaaagtgctggaattacaggcctgagccaccgcacctggccaaaagtatttcatctttacagccatcagtcaattatttgttctgctacttcttgaagatgtgcaaaatttctttttaaaaaaattttattatttattattatttattcattttttgaggtggagtcgcccaggctggagtgcagtggtgtgatctcggcttactgcaacctctgcctcctgggttcgagcaattcttgtgccttagcctcccgagtagctgggactacaggcgcacgctatcacgcccagctaatttttttgtatctttagtagagatggggtttcacggcgttagccaggatggtctcgatctcgtgacctcatgatctgcccgcctcagcctcccaaagtgctgggattacaggcgtgagccaccccgcctggccagtgcaaaatttcttaagtttaaatatacagtcttaattatacctgtgtcttaatgtcccaagacagattgtaggtaacagaatctcaattgtgcctcaaagaattaacaacaaaacaaaattcaatctattctctgcattcaggcagaaagggggagagcagagaacccttcctgcatctgctatttctcggttgccttcagtttgagataattaatatggcaaaacagcagatttttggagtagcatactctgattgccttcagtatataccacattttttttttttttttttttgagacaaagtctcgctctgtcgtccaagctggagtgcagtggtgtgatcttggctcactgaaacctccgcctgcggggttcaagcaattctctgcctcagcctcccaggtagctgggattacagtcacccaccaccatgcccggctaatttttgtatttttagtagagatggggtttcaccatcttggccaggctggtcttgaactcctgacctcgtgatccaccggcctcagcctcccaaagtgctaggattacagcctagcctggcctaccacattttgtttagccatttatctgtcgatggacatttgggttgcttccacctcttggctgttgtgaatagtgctgctgtcaatatgggtgtgcaaatatctcttcaagatcctgcttttagtccttttgggtatatatccagaagtgaaattgctggatcatattatgattttctttttaattttttaattttttggaaaattgccatactgttttccatagcagccgtaccattttatttacattctcaacaacagtcagggttccaattttttcacatccttgccaacgttaactttcttttggatagtagtcatcctagtggatgagatggtatcttgttttgatttgcatcttcttaatgattagtgatgttgaacatgtttcttgtgctttctgtccatttgtatatcttctttggagaagtgtttgttcaagaccattgcccatttattagttggattttttgttgttgagttgtaggaattctttatatactctgaatgttagccccttatccaatatatgatttgtaaatattttctcccattccaggactcttctattcagtgtgctaaatgtatcctgtgattcacattcacagaagtgttaaatactgatgtagtccaccttctctgtttttttctttttgagacagagtcttgctttgttgcccaagttggagtgcaatggcactatctcggctcgctgcaacctcccgctttcgggttcaagctatgcttgtgcctcagcctccctggtagctgggactgcaggtgtgtgccaccacacctggctaatttttgtatttttagtagagacggggttttgccatttttgccaggctgatctcaaactcctgacctcaggtagtccacctgccttggcctcccaaagtgctgggattacaggcatgagccccacacctggctgtttttatcttttgttgcctctaacctcaacttatttttatattgataaaacatacaaaaagtaaaatacaagaatctcaatttgtattgcttgatgtattttaacctattcacattatttctgaatatgtagttactaaaaagtaaaacttcatgaggaaaacttttcaaaatattaaacatctataaccatgttaaaaggatgggatgagaatatataggaatgatcaatattgtgatagtttttaaaggactgttttaggaaatgaatttttttccaagtagaaaccctctaaatctataggcactaatattacaagtggtctctttcccctgagaggaattaaggaaggtcattttactaaattgctttccatatattttccatatattttctatttaccccaatcatcctgttttctctcacttgccaaagttgtgcatgattcagtactgggtaaaaagaaaagtgaatgataaaggatattttcaacaattctttataatacattttcaccttgcattgtgtatcagttagaatgacttgtgcagggccaggcaaggtggctcacgcctgtaatcccagcactttgcaaggctgaggcgggcggatcacgaggtcaggagtttgcgaccagtctggccaatatggtgaaaccccatctctactaaaaatacacttgaacccaggaggcagaggttgcactgagccaagatcacaccactgcactccagcctgggccacagagcaagattccgtctcaaaaaaaaaaaaaaaaaaaaaaaaaaaacagaatgccttgtgcaaatatcagaaaaagtgctgaatcagttggcttatactgtaacgtaatttattctttttttttttttgagctgagtgcagtggcacgatcttggctcactgcaacctcagcctcccgtgttgaaacgattctcctgcctcagccttccaagtagttgggattacaggcatgcggcaccatgcccagctaatgttgtatttttagtagagacggggtttctccatgttggtcaggctggtcttgaactcccgacctcaggtgatccgcccgcctcagcctcccaaagtgctaggattacaggtgtgacctgtaaatttctaaaccaacatcaactaagatgatgggattactccagttgaattttttagactaatcagaatgtaccctctgggatcgaacatggagagagtttctcttagaccatgaggctttgttgaggaagtatggatacctgaatagaactggggttccatcaagaaggtggaaggggccaatggatactgttttggtagcaatgcctgcaattgatttatttttccattttaaacacttctggtttttagtactcaattatctaaaattataagaaacaatttcaaattcaacagcaaaaaaagaaaattattttaactttagattttttttttttttttttttttgaggtggagtctcactctgtcttccaggctgaagtgcagtagcacgatctcagctcacctcaacctctgcctcccgggttcaagcgattctcctgcctcagcctcctgaatagatgagactacaggtgcctgccaccacgcccagctaatttttgtatttttagtagagacggggtttcaccatgttgccattgctggtcttgaactcctgacttcaaatgatctgcctgccgcagtctcccaaagtgcttggattacaggcatcatccactgtgcctggccaactttagattttaattggcatgttaaacattttgtttacaaatttctgtactccaaaattgtagccttgatttaaaagattaattggtgctttcagtcctttactgatcaaagtaactatgtcaattcaaaatactttaaaatgaagctaatatttatttatttttatttatttattttttttgagacagagtcttgctctgtcacccaggctggagtgcagtagcgcaatctctgctcactgcaagcttcgcctcccgggttctcgccattctcctgcctcaacctcccgagtagctgggactacgatgcatgccgctacacccggataattttttgtatttttagtagagacagggtttcactgtgttagccaggatgggctcgatagcctgacctcatgatccgcccacccaggcctcccaaagtgctgggattacaggcatgagccaccgtgcctggcctgaaatgaagctaataattaaattatgttttaaaatagggtttatataaggaatgtacatgtacaccatggatgaatcttgaaaatataatgctaaggccaggcgcggttgctcacacctgtaatcccagcattttaggaggccgaggcaggcggattgcaaggtcaggagattgagaccatcctggccaacatggtgaaaccccatctctacgaaaaatacaaaaaattagctgggtgtggtggcacgtgcttgtaatcccagctactctggagactgaggtgtgagaattgcttgaacccgggaggcggagattgcaatgagccgagattgcgccactgcactccagcctggtgacatagcgagactctgtctcaaaaaaaaaaaaaaaaatactaagtgaaagaagacaagacaaaagaccatgtattatattattctatttgtatgaaaatacagataaaactctatagagtacaaacaaagtacattagtggttgtttacagctggcaggagaggggatgaaacagggtgatagctgaagggtatagagttttttttgaggtgacaaatgtgttctaaaattgacagtaatggctgggcgcagtggctaatgcctgtaatcccaacactttgggaggcaaggcaggcagatcacctgaggtcaggagttcgagaccagcctggtcaacatggtgaaacctcatctctactaaagtacaaaaattagcctgttgtggtggcaggagcctgtaatcccagctgctcgggaggctgaggcaggagaatcgcttgaatccaggagtcggaggttgcagtgagccgagatcgggtcactacactccagcctgggcgacaagaaactctgtctcaaaaaataaataaatcaaataaaattgactgtaatgatggttgcacatatctgtgattatattaaaacccattgtgattatattaaaacccattgaattgtatactttaaatgcataattgtatgatatgggaattatatatctcaacagctatttttaaatttattttttcttttttttcctttttttttttgagacagagtctcactctcacctagactggagtgcagtggtgcaatcttggctcactacaacctccgcctccgtgttcaagcaattctcctgcctcagcctcctgaatggctgggattacaggcatgcgctaccatgcccagctaatttttgtattttttttttgcagagaggggtttctccatgctggccaggctggtctcaaactcctggcctcaagtgattcacccacctcggccttccagagttctgggattacaggcgtgagacactgtgcccagcctcagtaaagccattttgaagaacaggctttatagaatttcttgatttgcccaacatttatttattcatttttaatttttttttgagatggagtcaagctctgtcacccatgctggagtgcagtggtgcgatgttggctcactacaacctactccgcctcctgggttcaagcaattcttctacctcagcttcctaagtagctgggattacaggcatgtgccaccatgcccggctaatttttatatttttagtagagacagggtttcaccatgttggccaggccggtctcaaactcctgaccttaggtaatctgcctgcctcagcctcccaaagtgctgggattacaggcataagtcactgctggctgcatttgcctaacatttaaaattgacagatagtgttggagttaatcattatagttttcatgtagtaaaggctagcagaaatagtgaattttcttttaaggtatggccatcttgaagtattctggttttctatagcccccctgtagatgatcattttccttattcctgctcttcccttcagtcaattatctcctccaaacaacacaggatagaagcctagcacttcctgtctaacaaaatagcctttcctccattcatttctgctataaaaacttaacaaagcttttggttatttccatttacagtaaaagcacatgagtatggagaagtagatcctctgcttttttgtatttgttattatgatgagggactgtaattgtatgttcttttagtctttatttttcttctgataattaaaatctcattgcctcataaattaggcatttgtatgcatagattttaggttcagaatattttaaaatccatgccacggttcagaaaattgtatctgtaataatgattaaattattataagtataaataacctagtttgcttcttcacagggttttctgtagtgatgatgtccatatggccatatctccaaaaggtttgtacatttcaatctatttttcccttatagctacagtagtagtaactcttacgtagttaagcattttctaaagagtctctttggtattctatggtttaatctttacaagaataatgagataatagttccttaaaagaggcttataagtaatgtgaccatatgctttattgtgcaagccagaacacttttgtagtgaagagactgctacgtaaggaaaaataggatcatacccagatagtcccaggcaaaggtagatgtatggtcacctactcagaagccacattcatattccatcattacctcttccctaataaaaaggaaactagtaatagtctgaattcctaaagtgtgtaaatgatatttttgtggaataatttaacgcttttcccataaaattaatttgggctatcaggtaacattgtaaagactagaacatatgtattttttgatgctgttattactagaaggggaagagggggtgacatgaatatgtaagtttgttaggtagcttaacatcagttgatcatcaggtcctgtcagttctatcttaaatctccaggaagaaacttaactaaaaatcagtatataagttggttacataattcatctataacaatgttttagtaaaggttcttaaagagttcctctgtatttcctaacctactccttaacctactgctatctgattaacttttctgctgtcctgaaactgctcttgtaaggtttccaattacttaattgttgatcacgaaatacttttcagtccttattttaggtgacacctggataggatttgacattgttgtcctctccttacttcctgaaaccacctgtattagtctgttttctgttgcttataacagaataccctaaaccagataatttattttaaaaaaggaatttatttcttaccgttacagaggctgagaagtcctagtttgagagaccacatctggtgagggccttcttgctggtggggactctccgaagagtcccaagacagtgtagggcatcacatgatgaaggggctgagcatgctagctcaggtctctcttccttctcttataaagccaccagttccactccatgataacccattaatacataaatggattcattcatgagggcacagccttcatgatccaattgttagttggcagatctgtgtctgtacaggtctgcagcaacctcaattcttgcctcctgaaagaaataattcaagtaaaggacataatgcagaaggagaaactgaggcaagttgtagagcaggagttaaaatttattaaaaagctttagagcaagaatgaaaggaaggaaaagaaggaaagtacacttggaagagggccaagtgggcaacttgaaagacaagcctgcggtttgaccttttgacttgggatttcatacactggcataattttggggtcttgcattacttctccccactcaccccacccctgagatcgtatcaggaagctgctaattaccaggtgttttctatttattaggaggctgccttttcctagcactagctgtgaccaataattactttagagagcgttaacaaccgcctgaccatcacctaacagtctctccacactccccatgtgaggggcaggggagacctctcctgccctgttcatacccaactagctacctaatgtaacacagtcacttcttaaaggtcctacctttcaatattttaataatattaatttaaatattaatttccaaaaaatgaaatttgggggacacattcaaaccatggcaccacctcttagcttctgtgacatttctctatcctggctttcctcttaactctaatgacttattcttaaattcttttgtgtattcttccttatcagtttatcccttgttggtttttctatgaggttggagagagagtgtgtgtgtgtgtgtgtgtgtgtgtgtgtgtgtgttcacacgtgcatatgtgtgttttatcctagattctgaactttgtcccatattagatgtatagccaacaatttattagataaatccatggtacttggatgaacccaggctcctcaggtctttacacatttgtctccctttttactggaatgcttttcctctctccatctttcttttgctctcccctttctccttcctcactgtcttttattcactcttcaaggttttgctccagtgtcacctcctctggaaagccttctctctctctctgtttttttttttttttttgcaatggagtcttgctctgttgccctggctggcatgcagtggcgtgatcttggtgcgctgcaatctctgccttaagggttcaagcgattctcctgcctcagtctcccaagtagctgggactacagacgccagctaccacacccggctaatttttgtatttttagtagagacggggtttcaccataccggccaggctgatctctacctgacctcaggtggtccacccacctcggcctcccaaagtgctgggatttccacctcctgggttcaagcgattcacatgcctcagccttccaagtagctgggattacaggcacccgccaccattcctggctaatttttataattttagtagaagtgggttttcggcatgttggctaggctgatctcgaacgcctgacctcaggtgatcctgcctcagcctccccagttgctggggttacagatgtgagccactgcacctggcctggaaaggcttctctcactgtccctcacaacaatttgggtcagaagcttttcctgtatactcccgtttccctttatcattagcccttaatatggagtgtcctaacactgtatttacagagagtttacttaactcccctactagattgtctagattgttaggattgtttttttttttaatttttgtggttttttttgtaaatggagtctcgctctgtcacccaggctcgaggtcagtgatgcaatcttggctcactgcagcctccacctccaaggttcaagtgattctcctgcctcagcctcccaagtagctgggattacagtcgtgcaccaccacgcccagctaatttttgtatttttagtagagacagggtttcactgtgttgaccaggctggtctcaaactcctgaccttgggtgacccaccacctcagcctctcaaagtgctggcattacaagtgtgagccaccatgcccagcccagtttttacgaatttctactttttgaaaatgctctcctaaaatatatttttaaaggaatataagaagaaaagaaatacaaattttactttttactggtttagtgccatattttcattgctattttgaaaataatattacatgaaattattacccattacactaaaaattctttccatgctggtagtcattggaattggcacaattctggagcaacgtcttctctactaaaaagatattttcatgtatcaaaattcttaatttcttggcatttagtctttttagtcaaaattctcaaaagaaggatattagtagtgattaggtctactcagcatactatgttgagttttgaaaagtactctcttttctccagatattttgaaaactctttaaagagtcttgctatcaggcccagtgctgtgactcacgtgcctgtaatcccagcgctttgggaggccaagttgggaggattgcttgagcccaagagttcaagaccagcctgggtaacgatataagacctcgtctctacaaaaaaatttaaaaagttatctgggtatggtggtgctactccctgtagtcccagctgcttgggagcctgagttgggaggatttcttgagcaaaggagtttgaggttacagtgagccaagattatgccactgtattctggcctgggtgacagagccagaccctgtctcagaaaaaaaaaaaaaaaaaagttttgctttcaaaccactacacatttaacattaaaattgagttttcattgcttttttgaaaattaaaattttatgtaacatgaaattattattttctattttagtagagatgacaaatgaagctaaaggtaatacaggaagaaaatgaaaaccagagtacctaaaatgaaagatattttaacggctagaactttaaatattatgtatcattatacttttgcatattatttcttatttttttcataaagaaaaacgcacctaaatattttcactttaaatatctttagggaattaccaggcacggtggctcacaccaacaatcccagcactttgggaggccaaggcaggcagctcacctgaggtcaggagttaagagatcagcctggccaacatggtgaaaccgcgtcgctactaaaaaaaatataaaaattagctgtgcccacgtggtggcacatgcctgtaatctcagctacttgggaggctgaggcaggagaatcgcttgaacctgggaggtagaggttgtagtgacctgagatcgcaccattgcaccccagcctgggcaacaagatcaaaactccgtctcaaaagtaaataaataaataaaataaaataaataaataaatatctttagggaacaaaaggtcatagttttccttattaaattgttctaccacttatctatatttgtttaaatttatttcctaaaatttaataaaagccattaaataggaagattagagatagaatcttcctatgttgcccagactggagtgcagtggcttttcacaggtacagtcatagtgtgttacagcctccaactcctgggctcaagggatccttctactctagactgctgagtagctgagattacaggcatgggccacttcgcctggcttagcctaccacatatgaaaaaaagtaatctggctgagtgcggtggctcatgccactaatcccaatattttgggaggccaaggtgggagaattcctccctcccgcggcaggaggattgctttgagagttggaggcgggaagttcaagaccagcctgggcaacatagggagaccctgtctctacaaaaataaaaaaattaggtgggcatggtggtgcatacctgtagtcctggctactcaagaggctgaggcaggaggatcacttgggcctcaaaggtcgaggctgcactgagccgtgatcggaccactgcgctccagcctggatgtcagagtgagaccctgtctcaaaaaaaaaataaaaataaaaataaacaatagtgccttttctaagctaacattttctatttttctgaaagtattttattttctgagttgtagtcatttggttctccccttaagttcatcatgatatgtaaacccttttaaagtggtagaatactgagtggtctatatagaacggaagaatttataacaggtttattgagataattgtctatcatcttttgtgtttttattatcttctttatgcatttgactcttgtgcctagtttttttaaaaaaaatgatttacagcgctaatggctgtttaacgtatagggtagcataagtctaaagaattctatttacaagaattaaagaatagcttatattatttttcatgatgttattgctatatgcgtatatagtgtgtgtgattatcttcttaccaaggtttatatgaaccaaaaatttccagtcattcttaaaaatgagcctcccaagcatttttcccttgtgtacagtctattgttagcacatttaattgtattgtcagaagtttgaatcccttactataagtaatagtgttataaaacttatacgttagaattgtttttattttttgataggaaatcttacatggtatgacaaatgtatttagttttaaacttttcttggataacaattcttaaagcactgtacctttttctgcagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggtaaggttgtatgtatatgtttggttgtgtcatattcacattcattctgacatttatggctcacttttaactggtctcatccccttttaaactcatatttcacagttcaacatacatgtttctcattgtaaacaaatatttttcttatcattttgcctttgctcatgatgttctcattacctatagtttctcttctgttctcatcattcttcatccttcaagattcagtttaaaccaggtgtggtggcacgtgcctataataccagctactcaggagactgaggtagcagaatctcttgagcccaggagttcgaggccagcctgggtaacatagggagacctccatctaaaaaaaaaaaaacccaaaacaaaaatagatccaattcaagctccacattttccacaaagccatcttgggctaccctgccccttgagagatttttttcttctctgacatgtctctggcacttgcttatagtattgtactgtttctatcctttctcactaaccagataataatttttttttttttttgaaacggagtcttactctgtcacccagactggaatgcagtggcgcaatcttggctcactgcatcctctacctgcctgggttcaagcaattctcctgcctcagcctcccgagtagctgggattacaggcgtctgccactgcacctggctaatttttgtatttttagtagagacgcagtttcaccatcttggccaggctggtcttgaactcctgacctcgtgatccactcgcctcggcctcccaaagtgctgggattacaggcatgagccaccattcccaacctaaactttttgcaattagaaagaattaatgatactttaaaaatatcctatgccccctaacagagtctcttgaatgtaatgtactcaatgaaaattttcagtaaaattgttagtgcatttttttctgtttcttatattacatgtctatgcatacagagtttgtaatattgtaatacttttcttttaaaaacagttgtagtaatcaatggtatgccattcactcagtgcttttttagtactaagtaagtttgatattctttttttttttttttcactgttgcccaggctagagtgcagtggcgtgatcttggctcattgcaacctcagcatcctgggttcaagcagttcttctgcctcagcctcctgagtagttgggactacaggtggataatttttgaatttttaatagagacggggtttcaccgtgttggccaggctggtcttgaactcctgacctcaaaatgatccacctacctcaacctctgaaagtgctggggttacagatgtgagccactgtgcccggcttggttttcttatgataccattttttcactcattgatatctttaactgttttcatattaccaaaactagtatggtccattaattgatgcatttgcttaataaaaataccttacatgctttgtgtgatcataaagaggaagcagtgactgtactgttgaccaagatttcttcttctgtataaagtcaaattggattgaattttataagctgaatgatactttcttttactttggattattgtgtcttgtttttaaggaaatgtagcagttgttagatcatatactgctggtgctacttcccttcaggaaagaacaagttccatggcaaacataagcatgtgtcaagcattaggttttattctaggtccaggtaggtgttcttcacatgtcattacttgaatttgaattgggaaaacttttgaggcttaaatattcagtgtaacccaagtataaaaactcatagctgaagggaaagggaggaaagctaattttttttttaatccaggaatgaggctacactcattttatcttgatgccaatccactaaattaagtgctattagtccccttttatagttgagagtgccagtgcatagagaatctaagtaaattgtccaaggtcacccttttgctgagtgttaaaaaaattagtgaggccatgcgtggtggtccacacctgtaatctcagcactttgggggtctgtggaaggcagatcacctgaggtcaggagtttgagaccagcctggccaacatggtgaaaccccatctctactaaaaatacaaaaattagccaggtgtggtggcgggcacctgtaatcccagctacttgggaggctgaggcaggggaatcgcttgaactcggaggcagaggttgcagtgagctgagatcacatcattgcactccagcttgggcaacaagcgcgagactctgtctcaaaaaaaattaatgagatttagtatttcctcaaggcaaattaattttctgctgagtaaagaatcagtcattttcatgcctagaataatattgaaaaaccatataattggtccatattttgaatattgaagttatgaatattatcagtttgaatccaactcagcttacttcatcattaacaccccatctcccacccccagtttccattacgttcctctatttagccaaaaagaaaaggctcaacagaagggaatctaattcactgttcaccaaaatctactatttcagttttgtaccctgaaacaaatacaagcacaaatgtagaataattgaacttgaatactatattgtaaagtacatgaggacatggtttgagtctttatttaccagtctaccctcagtatctagcataatacctggtatagacttatgttcttagtaaatattttttaccaccttaaaagcattttaaagattatgtcatttaaaaattttgcattatagatgagtaaatgtaagcctgaaaagcttcgatgacttttccaataataagccctcaacaagcactaacatttattgtgtgcttactgtatgctagtcactgttctaagtacggtaggtgcaatattttagtcctcaccctagagttatatgtgaattactatagagccacatattgaatctaaatcagaagagcaaaccagtactcttccaattgagtttttgccacagatccaaattagattttgccacttcatatttctttagagtgctttatccagcagtccaaaaacacttctaactaatgtttaaaatcactaaaaaaaacttcaaatactaaggtggattatgtatgcttttggatgaaataatttttttttttcattttacttgtatataatactatggtcaaatgataataaatatatacacacacacacatatatatatatatatatatataccatatacagaataatatttaagatatctggtctaaaatatgatattttcattcttataatgaagctgattaaacctttataattaatttttggaagaaattgtataatttaaattgcctatggagatgttttgtaaaaaactgagaagttatgtaagatacaattccttgtgaatgcatgtaaatcagtgtttcacaacctttttttcattattgtctccctaaggagcctttttcggtatttttttcctactctctttaccccataaaattttagtgccacagatgtgtcatatatcttttatgtaccatatgtatatctgtacatacctgctttatacataaaaagaggaaattttttgaccccccatcaagaaccaattccatctgttgagaatgcatgatatagaaggatgattccataacattgttcccaattctgttgtaaatgtctttttcatttttttatcctatgcttctcatataataattcatctgtgaaaattttatcttaataagtttttcagacttgttttacattccttggagaaaaaggtgtgacatgggatgtgattaaactgcagataaacatgtatacaacaccagttttacttagcgccttcctgggaattttaaatattattctgatccttgccatactaaggtaattagatagaaatgataaaactatttttgtagattgtgaaatttaatgagctttgtaattgttggaagataattatccttatgaagtgtacgtagttttttatgtctatagtttgtttatattttttggtcaggtagtactaaagcatgtaatactggcaaccaaaagacaacctgataaatgagaacagaaaaggaaggtctttgaagattcaaagttttttttttttttttttttttttttttgagacaagatcttactctgttgctcagactggagggcagtggcactatctcggctcaatgcaacctccatctcccggattcaaggattctcatacctcagcttcccgagtagctggggctacaggtgcatgccaacacatccagctaatttttgtttcaccatgttggccaggctgatcttgaactcctgacctcaaagtgatctgcccacctcggcctcccaaagtgctgggattacaggcatgaggccatgtgaggctgtgcccggcctcaaggtttggtcttgatttactaactacatgttgctaagtaggggaaaggcatggaagtaacattttaaatagattaatggatttgtatcagtcttaaatataaaagttactagtaatgtatatctcttatcttttatatattcgaaaaaattttttaaaattatgttttatttagagtgctttattcaatagtctaaaaacatttattactaatgtttataatcactgtaaaacttcaaatactaaagtagatcatgtatgctttaggatgagttggatttttttcattttacctgtttatgataatttgataagaattgtaacttctgtcttaagtttattggttatatctcattggtaacagttttattactgaaaaaccaataaaagaaactatattagaatgtgaaaaaaaatacaatgccgataataaatttaaacaacttctctattaagcattttataggtacaatatttgtgtttttctttttaagagaacatcgtgtggatgactcaggaagacagtgtaaaagtattaattttgaagaaggtacttttaacccatttggctgaattaatataacattatcaaagtgtttctaatgattctgtttgtttggtatttacttcgattttgcttctgaggacaacacagtgggtgattggggaagatcttcaaagctgaaagtgacctaaatttatttatttatttatttatttatttatttatttatttatttttttttttttgagacagagtttcgctctgtcgcccaggctggagtgcagtggtgcgatctctgctcactgcaagctctgcctccggggttcatgccatcctcctgcctcagcctcctgagtagctgggactacaggcgcatgccgccacgcctggctaattttttgtatttttagtagagatggggtttcaccatgttagccaggatggtctcgatctcctgaccttgtgatccacccgcctcggcctcccaaagtgctgggattacaggcgtgagcaaattgattttttttaaagaggcatacccatattggttatttggtggtcatgattgacaaggttacaaacattgtaaaaaatcgctttgtcttattttcagagagccagtatcctaaagcctttgagatatttgcaatgatttccatatctttactaccaaataaatatgtctatttaaagcagttctttattatcttaagtatgaaaatgggtatggttttgcctttttatttttgttgttttggtatactttagaaatatacattttcatcttttagatcttctctgattcatataagccagagaacccagtaagtagctatattttaccaaaaaaaaacctgttatttaggtactaattatatcctccttgcggaaagaatgcaaggactgatcctggccctcagtagttcataaagttgtggaaaagacatagtattattttactattttaccaggtactttcatagctcttttatttaattttcacaaaagaaatagtggaagataaatgtagtagagcagagtggtgaggagctacagtaagtttttgaactaggagaagtttgacattgattccatgcagaggctaatccagattggttatatctcactggtaatatctcattggtaacaatttcattactgaaaagccagtaaaagaaactgtatcaaatgtgaaaaaaatacaatgccagtaacaaatttaaacaatttctttattaagcttttcataggtacaatatttgtgtttttctttttaagagaacattgtgtggatgactcaggaagacagtgtaaaagtattaattttgactaggcctgaagtagggcagtgactgagaatggagaagggataagtaggagttgttgaaagaggaatcaagatagagatttggatagagaatattaaggattagagaaagccaacattgctgccaggttttgattctagatcacctggaagaatgagagagaacaagaatttaggaagggaggttagatgaaaagagaagatgatttcaatttggatcaagctgaatatgctgttactctagaacaactaaaaaatcccacaggcatttgtaattttgacagtagaaataaaagctagagataaaaatttatgagtcacccagtgaaacacactatggcagcagaaagggagtgagagaaaggatggcatgatgattcaagtgtggcaaaagattgttgaatctgaggaatgaatatgtgagaatatgtttgaaaactttcaaaataaaacacaaagaatgagaggtgaagtgccagcagtgcgtataaactccttttttcaaaggtaaaaaataggatgctaacttcaaggagctatcaggtaaagtgacggaggaagttaagagggtgaggtagaggtatgacaaagggaagatatgtaaaaatcagtatttcagaacttggaaggggataatgatatacatcagtgcttcatttactttaatgtgcttagaaatcacctgggaaccttgttaagatgcaaattctgattcattaggcttagggtgatacttaatagggttgcctgtaaaacacaggatgttgcttctcagaataggggagttaataaagaaatataaaaatatataatttataataaaaaataaaacacagaatgcccaattaaattttaataatgttttaatataaatatgtcccacccagttaaatttggatttcaataaacaacaaataacgttggtttttttttctttaatagagacaggatcttgccatattgtccaggctggccttaaactcctggactcaagtgatctgcctccctgggcctcccaaagtgctaggattacaggtgtgagccactgcacctggaaacaaataacttttagtattaatacaatccagctgggcacagtggctcatgcctgtaatcccagcactttgggaggccaaagcaggtggatcacctgaggtcaggagttcaagaccacccttggccaacatggtgaaaccctgtctctgctaaaaatataaatattagctgggtgtgatggcaggcgcctgtaatcccagctactcatgaggctgaggcaggagaatcgcttgaacctgggaggcagaagttgcagtgagccgatatcacgccacgtactccagcctgggtgacagagtgaggctctgtctcaaaaagaaaaaaaaaaagtataaatacaatccaaatacttcatggaacattcttatacttaactttcaaatatggcacagaacatatttatattaacacttattgtttatctgaaatttaaatttaactgggtctcctgtatatttactaaatctggcaaccctagtgagatgctgagcatctacatttacaacaaactaccatgtgatgtgatgcttctggtctacaaatcacactttgtgcagcaaagattgagagctatgctgcccaatatagtagccattagccacatgtggctatttaaataaagtaaatttaagaaattattttctgtcatactagccacatttcaagtgctcaataatgggtatatgtggctagtggccactgtattagcatagataaataacatttccgtcatgtcacagttctgttgggcagcactgttctaaagtacaaatgggaatgagtttagagaagatgtagtgttttcttttatgagatttctagttacttcaaaataatttttataaaataaaatttttaaatttcaataaatgtttgcataaaatatgtctggtaaaaacttccataattgttttaatttaaagctattcaaatttaaagaggttattatgagacaggattataatttctaattgcatagaatttgaatccatatactaatgtagtcttttaaaaaatgtgtaattaggatatctagtcaatccccatagtctaggatgcaacatttctgagataccccactgaagccaacactgagtagaagctataggaaactaaccacatattatgaagcaaactccagtctgacttggggcaatattgatactgacttgaaggagtaaagactgacttctaggtggtgattaagaatcagagaggtctatccaaaatagtacaagagccacaaccatcagggcctacccctggcaaaggttctggacaaaggtggccagttctctttgtgtgattacaaaggaaggtcataaggctatgttgagcatccaaggtgcttaattccctttaagtatagcagactatttccaaatctacttattgttggaggaggaactccttctcaagaatcctgagatagaaaagcaggcattattatgaaaaaaatcatagaaacttactgcatcttaggaaagcccccccacccacccactaacaacaactgacactacacacaatttaagatagcataaataaacatatttttgtaatattttatgtattaatacctggcataggctgggcgtggtggctcacacctgtaatcccagcactttgggaggccgaggcgggcagatcacgaggtcaagagattgagactatcctggccaacatggtgaaaccccatctctactaaaaatacaaaaatagctgtagtcccagctactcgggagactgagacaggagaatcgcttgaacccgggagttgggggttgcattgagcagagatcgggtctctgcactccagcctggcaacagagcaagactccgtcccccccgccaaaaaaaaaaaaaaaaaatacctggcttattttggtatttatttgtgtaaaaatactattttattctgaataagtggataaattacaaaacagtgtgatgaatatatatgagtagattaatatgtctgcatgattctcagttacatcaagaatagcttaatgtgtattaaccttaaggcgttgttcaagatgagaagtcagtacacttactttgtcctccttatttataaaaccaccgtcaaatcctgattatttctttgcagaaatataaatgataggggtttttaaaatggtaatgataacataaggatctttacgaatactaatttcttgttatttatttatttattttttgagacagggtctctgtcacccaggctgaagtgcagtggctcaatcttggctcactgcaacctcagtctcctggttaaagcaattctcgtgcctcagcctctcaagtggctgagattacaggcatgtggcaccacgcccggctaattcttttttgtatttttagtagagatggggttttgccatgttggccaggctggtctcaaacttctgacctcaggtgatccacctgcactggcctcccacctgctgtaatccacatgtaatccacatgtaaaccacatgtaatcccacctgctgggattacatgtatgagccaccactcctggccatgagtactaatttcatgtaacactgaaattcaaaatatatatccattgtagtaaatcatagaactgggaactgatttaataaaccactggagttcttcatgaaattcttgtaagtctaagatttaagtaaggtggaaaaaatctgcagttgaaatttaaagcaaatatatttagtatgagatcactatgttaacagagttctataaattacattcccatttttggattgagatataccaagtacaaaatacatctgagtatttcttaagataacaggattgaagtatatctctggggaagaaaattcaccttgcttttaaatgccatttaaaaattatttctgtcatataaattatcttattgttggccatgcacagtggctcacacgtgtaatcccaacactttgggaggccaaggcgggcggactggttgagctcaggagttcaagcccagactgggtagcatgatgaaacctcatctctacaaaaaatataaaaattagctgggcgtggtagtacatctgtagccccagcttcttgggaggctgaggtaggaggatcacctgagcctggggaggtcaaggctgcagtgagctgtgatcatgacactgcactctagtctgggtgacagagtgagaccctgtctcaaaaaataaaaataaacaaattctcttattattaaactactttgaagcctaaaaatttttttaaatgtttatttataaattttgctacaatgtaatttctacattactttaatgtcataagaaaaattagatgtataggtaatgtaatttttctcctatttccctatagcaagtacagatgaagctcaggttccccaaggaaatattgaccaggttgctgttgtggccatcaatgttctgttttttgtgactctatttatctttgccctttttgaaacgtaagttttattccatcttcatctgaatcagattatgttttaacctttatttcttaatgcaatgttaattaggcatatagatgttattgaaaatcttatgtaaggcaaatttttcttaccatgatgtaaaaaatgtatatacattttgttgcttgtaacttgaatgtagttaattatttgtccataatcttaactaccttatcttattttcttataaaagaatctgtttcactactctttccctctttcatctgagttttatgataaatacagttataaaactttagtgccatgatttaattatccttaagctctataatttcctacatatatgtatatatatatatgattcaatctggtaattttaactcaatttaatacctgaccttgaagaaaaacctagtatattacaaaatctctgccttgtgcaggctttattgacctttatcatatggctgttttatttttaaaataactttccatgaaattataaaaatagtacattcaaatcccaaatattacaactgtatttctatatccactcctttctgtgaaagtaaccactgctaatactttagtttgtgttttttcaaacatttttcctatgtatgtataagagtgtatgtatatacatgtatctattaaacttacatagattatgtgatattatcatttgacaacttggtttatttacttgttaatacattgtgtcatttttatgttagtacttgtaggtttgcttggtgtttttattttcaaaattattgagatatatgaaagttccagctcacctgatattttaggggcaattttttattgtgggaaaatatacataacataaaatttatcgtgttaactttttttgttttgttttgagacagggtctcactctgtcacccaggctggagtgcagtggtgcaatcacggctcactgcagccttgacctcctgggctcaggtgaccttccagcctcagccctctaagtagctgggaccacaggcatgcgccaccatgctcagctaatttgtttatattttttgtagagacaggatttccccatgttgcccaggctgatctcgaactcctgggctcaagtgatttgctcaccttggcctcccaaagtgctgggattacagacgtgagcctccgcgcctggcactatcatgttagctatttttaaggtatgcagttcagtagcattaagtgcattcacaatgttgtacaaccatgaccactagctatttccagaatgttttcatcatcctaaacagaagttccatacccattaaacagtaacataccaattaaacaatgttaaataaatttcagactgggtgcggtggctcacgcctgtaatcgcagaactttgggaggttgaggcaggtgtatcacttgaggtcaggagttcaagaccagcctggccatatggtgaaaccctgtctatactaaaaatacaaaaattaactgggtatggtggcaggcgcctttagtcccagctactcaggaagctgaggcaggagaattgcttgaacccaggagatggaggttgcagtgagccaagatcatgccactgcactccagcccaggtgacagagtgagactttggcgtctcaaaaataatagtaataaacaataaatataaattgcattttgtagtcagttaatagagatcgaatgtagggagagaaacttggcaaggaaggatatagtcatataaaggaagagacattgagaggcaaagagaaaaatatatatattcaaaaatccagtatattctgataacttaatataacattattgcattgaaagagaccaatttaattaaaaatataaccatgattatttagtaatgttagaatgataggcattatgattggtgtggcttgtttccttttcctttgtttcagactttctgtaatatggctatattagttatataattaaaataaacattaggaagtaaaatatgagtaggcagacttagtaacttaggtatgtaacaacaaacgcttaaaatgtgttcaaacttttgcttaggtctgttgtcattgctaaaaggcatgcacattcttgaatgtgtagatgtcgttattaaaacttacacttcactttaagtataacagttactgtgatttaaataaaataagaataattttttttttcttagcatcattactccattaacaatggatatgtatgcctggactcaagaacaagctgtgttatataatggcataatacttgctgctcttggggttgaagccgttgttattttcttaggagttaagttgctttccaaaaagtaagttaagtgtttttggttttatgtctgtttttaaaaaataaaacaaaaaacagagctaacaatgcaaatggatataccaggaaaataatttaaagcttttttttgcacacaaatttacaatttattaagagattatcatatttctatacattacagcatttctttggtaaaacaaaatttctcacaaagtatataattgactcttatttatcttttgtctactatgttttcctgaaagtatatttcataaaccattgttctactgtattgtaatatatattgtgcaacaaaaaagattcatggttaagtttggaaaatcttggttaagattaccaaacttattctagaacttctatccatagtatatatattctatatcatcatcatggcaaataaaatttgtgtcatttcccagaccacacaacactctttttttttttgagacaaggtctcgtattgttacccatactggaatgcagtggtgcaatcatggctcagtgcagcctgatgggctcaagagatcctctcatctcagcctcctgaatagctggactacaggcatgaccaccacacctggctaatttcttttatttttattttttgtagagatattatctcactatgttgcccaggctagtctcattcctgggctcacgcaatcctccagcctcagtctcccaaagtgttgggattacaggcatgagccactgcgcccagcataagtgttttttaattgatacatgatagatgtacatatgtttggggtatgagtgatcatttgatacattcgtataatgtataaagatcaaatcaagataattgggataccatcactttaaatatttaccttttctttatgctaggaacatttgaattactcttttctagcttttgacatgtacactaaattattgctaactatagtcaccctactgagctattgaaaactaggtcttatttcttctaactgtgtatttgtacctattaatcaactattgtttattgcctccttcccgctattattcgtggcctctggtaactaccaatctagtctctttctttcttttcttctttttttttttctttttgtaaaagatggcgtctcactctgttgcccagaatggagtggagtggagtgatcatagctcatggcagcctcagactcctgggctgaagcaatcctcctgtctcagcttcatgagtagttaggactacaggcatgtgccataatgcctggctaatttttttttttttttttaactttttgtagagacaagatcttgctttgtttcctgggctcaccaatctactctctatcttcatgagattctttttttttttttttttttttttttttgtgacggagtctcgctctgttgcccaggctggagtgcagtggcacgatctcagctcactgcaacctccacctcctgggttccagcgattctcacgcctcagcctcccaagtagctgggactacaggcacatgccatcacacctggctaatttttttttttatttttagtacagacggatttcaccatgttagccaggatggtctcgatctcctgacctcatgatctgcccgcctcagcctcccaaagtgctgggattacaggcgtgaaccaccgctgccgacctgagattcacttttttagctcccacatgagtgagaacatgtgataatttgtctttctgtgcttggcttatttcacttaacataatgaccatgaattccatctatgttaccccaaatgatggcatttcatggtttcaatggctgaataatattcccatatatatataccacatttatccattcatccattgatgaccacttaggttggtttcatattttgactattgtgaatagtgttgaaatgaacatgggagtgcagatgtgtctttgatatattgatttcatttcttttagatatatacctagtaatgggattgctggttcatatggcagttccattttaagtttttaggaacttctgtactgttttccatagtggttttactaatttacattcccaccaacagtatacaagggttcccctttctccacatcctcgccagcatccattattccctctttttgattaaagccattttaattgggttgagagaatacctaattgtggttttgacttgcatttctctgatgattagtgatgtcgaacattttttatttacttagtggccttttatatgtcttttgagaatgtctattcactgtttaaaagaatcattttgagggcctggtgcagtggctcatgcctgtaatcccagcattttgggaggccaaggcagctggatcatttggggtcagcagttcgagaccagtctggccaacatggtgaaaccccatttctactaaaaatacaaaaatttttctactaaaaatacagggcgtggtggcacatttctactaaaacaaaaaaatttttctactaaaaatagagggtgtggtggcatgtgcgtgtagtcccagctactcaggaggctaaggcaagagaatcgcttcaacctgggaggtggaggttgcagcagtgaaccaagatcacaccactgccctccagcctgggtgacagagtgagatttcatctcaaaataaataaataaatacaaataaataaaagaataattttggccaggtatggtgactcacatctgcaaccccagcaatttaggaggctaaaatgggaggatcatttcagcccaggagttagtttgagaccagcctgggcaacatagtgagatcttatctcactatgatataatgagatccctatttcttcacagacacacacacaaacacaattagctgggtatgatggagcacgcctgtagtcccagctacttgggaggttgaggcgagaggattgcttgaacccaggagtttgaggctgcagtgagctgtgattgtaccactacactccagtctgggtgacagagcaagacccatctcttaaaaaaagaatcattttgtaaaagtacaactgtaaggaacatatttttagggaaatgcttgtgtaaaattaagttcagtcatatagtctatggtggaacattagttgatgaatttagacagttctatttaagtattcctcaaatacagatactctttaacttgcaatggggctacatcctgataaactgatcatcataagttgaaaatagcactaagttgaaaatacaggctgggtgcagtggctcacgcctgcaatcccagcactttgggaggccaaggcgggcagatcacctgaggtcagaagttcgagaccagcccggccaacgtggtgaaaccccgtcgtaactaaatacacaaaaattagctgggtgtggtggccagtgcctgtaatcacagctgctccacaggtggaggcacaagaatcgcttgaacccaggaggtggaggttgcaatgagccattgcattccagcctggatgacaagagtgaaattccatctcaaaaaaagcgaaaaacaaaaaaaaaaaaacatttaatacacctaacctacggagcattgtagcttagcttagcctactttaaacacactccaacactcacattagttttcagtttggctaaatcatctaacacaaagcgtattttataataaagtgttggatatctcatgtaatttgccaaatacagtatactgtagattatagtactggatgtttacctttgtgatcatgtggctgattaggagctgtggctctctgctgctgtccagcatcatgaaacagtatcataccacagatcactagtctggaaaaatatcaaaattcaaaatttgaagtgtggtttctactgaatgagtatcactttcctactgttgtaaagctgaacagttctaagttggacactcataagtcagagactgtatgtactttaataaggttctaaaattaatcaacaaatgttaagtcagtgtatcaggttcagtgctatgggggtactatgagaattcttgtccttatggagccaagtagagggatcaagatataagatagacatatatttatattcaaagttaataggaagtacattacatcttgctacagaagtagagcagtgctgctgatacacattcttatagaatgtccaataccatcccctcaaagcacgtgtattccagtagggggaaagccaataaacacaaatgtgaagtcagatagtggtaagtactacaaagaagaatagaagagaaaagaataaggagtgacaagggcagggctgggaagtggggaaatgttgtatttgatacactgctcaaggaaggtatatatgaggaagttacatttaagctgagaccttagtgaagtcagcaaagagccatgcaatggcctggatggtctcgatctcctgacctcagatgatccgtcctcctcagcctcccaaagtactgggattacaggcgtgagccaccacacccagcctttattatactttgagttctggaatatatgtgcaggtttgttacataggtataaatgtactatggtggtttgctgcacccatcaacccatcatctacattaggtatttctcctaatgctatccctcctctagccccccaccccgcaataggcccctgtgtgtgatgttcccctccctgtgtccatgtattctctttgttcaactcccacttatgagtgagaacatgtggcgtttgtttttctgttcctgtgtttgctgagaatgatggtttccagcttcatccatgttactgtaaaagacatgaactcatccttttttatggctgcatagttttccatggtgtatatgtgctacattttctttatccagtctgtcattgatgggcatttgggttggttccaagtctttactattgtgaatagtgctgtaataaacatacatgtgcatgtgtcttcatagtagaatgatttataatcctttgggtatatacccagtaatgggattgctgggtcaaatggtatttctggttctagatccttggggaattgccacactgtcttccacaatggttgaactaatttacactcccaccaacagtgtaaaggtgttcctatttctccacatcctctccagcatctgttgttccccgactttttaatgattgccactctaactggtgtgagatggtatctcattgtgattttgatatgcatttctctaatgaccagtgatgatgagctttttttcatatgtttgttggttgcataaatgtcttcttttgagaagcatctgttcatatcctttgcccactttttgatggggttgtttttttcttgtaaatttgtttaagttccttgtagattctggatattagacctttatcagatggatagattgcaaaaattttctcccattctgtaggttgcttgttcactctgatgatagtttattttgctgtgcagaagctctttagtttaattagatcccatttatcaattttggtttttgttgccattgcttttggtgttttagacatgaagtccttgcccatgcctatgtcctgaatggtaatgcctaggttttcttctagggtttttatggttttaggtcctatgtttaagtctttgatctttcttgaattaatttttgtataaggtataaagaaggggcccagtctcagttttctgcgtatggctagccagttttcccaacaccatttattaaatagggaatcctttccctattgcttgtttttgtcaggtttgtcaaagatcagatggttgtagatgtgtggtgttatttctgaggcctctattctgttccattggtctatatatctgttttggtacaagaatcatgctgttttggttactgtagccttgtagtgtagtttgaagtcaggtattgtgatgtcttcagctttgttctttttgcttaggattgtcttggctatatgggctctgttttggttccgtatgaaatttaaagtagtttttttctaattctgtgaagaaagtcaatggtagcttgatggggatagcattgaatccataagttactttggacagtatggccattttcacaatattgattcttactgtccatgagcatggaatgtttttccatttgtttgtgtcctctcttatgtcctttagcagtggtttgtagttctccttgaagaggtccttcacatcccttgtaagttgtattcctagatattttattctctttgcagcaattgtgaatggcagttcactcttgatttggctctctgtttgtctgttattggtgtataggaatgcttgtgatttttgcacattgattttttatcctgagactttgctgaagttgcttgtcgcttaaggagattttgggcaccactggtcccacagaaatacaaactaccgtcagagaataccacagtattctctaatactataaacacctctatgcaaataaaatagaaaatctagaagacacggataaattcctggacacatacaccctcccaagactaaaccaggaagaagtcgaatccctgaattgaccaataataagttctgagattgaggcagtaattaatagcctaccaaccaaaaaaagcccaggaccagatagattcacagccgaattctactggaggtacaaagtttccattccttctgaaactccattccttctgtaactatgccaaaccgtagaagaagagggactcctccctaactcattttatgaggccagaatcatcctgataccaaaacctggcagagacacaacaaaaaaaatttaaggccaatatccctgatgaacatcgatgcgaaaatcctcaataaaatactggcaaacccaggccaggtgcggtggctcacgcctgtaatctcagcactttgggaggctgaagtgggtggatcacgaggtcagaggtcgagaccatcctggccaacacagtgaaaccccatctctactaaaaatacaaaaaaaattagccaggcgtggtggcaggcacctgtagtcccagctactcaggagactgaggcaggagaatggcatgaacccgggaggcggagtttgcagtgagccaagttcacgccactgcataccagcctgggcgacagagcaagactctgtctcaaataataataataataataataataataataataataataataaataaaaataaaaaataaaatactggaaaactgaattcagcagcacatcaaaaagcttatccaccacgatcaaatctgcttcatccctgagatgcaaggctggttcaacatacacaaatcaataaatgtaatccatctcataaacagaaccaatgacaaaaaccacatgattatctcaatatatgcagaaaaggcctttgataaaattcaacactccttcatgctaacaacactcaataaactgatattgatggaacgtatctcaaaataataagcgctatttatgacaaacccacagccagtatcatactgaatgggcaaaaactggaagcattccctttgaaaaccggcacaagacaaggataccctctctcacctctcctgttcaacatagtgttggaagttctggccagggcaatcaggcaagagaaagaaataaagggtattcaattaggaaatgagaaagtcaaattgcctctgtttgcagatgacatgattgctgtatttcttaaaaactagtacttgcatctagaagcttgatgaaatttgggttcaattttttggcaagaatactttataggtgggaatatgtgcttatatcagaagaaatataatgttttgtttatctcttcttaacatgtaagtagccactgattattccatagatccattaattcattaatgaatcattacaaaattctggtattttaattctatcattcctttatttatttgctagaatacttaccatgaagagaatctttccctcaccaactatttggttaacctgagctatagttgtataggaaaggcaggataaaggcttgattattttcttttgtttccctaacatcctcaaaaactgaccaaagagtactttattttaatatactatgaattcatagattataacactttttttttttttggcgacagggtcttgctctgtcacccagtttggagtgcagtggtgccatcacagctcattgcagccttgacctcctgggctcaagtaatcctcctgcctcaacctcctaagtagctagaactacaggcaccaaataccactcctggctaatttttaaaattttttgtagagatggggtcttgctatgttgcccaggctggttttgaacttctggcatcaagcagtcctcccgctttggcctcccaaagtactggggttataggtgtgagccactacaccaggccacagatgataatactttttgtgtgtttcaatccattgccattattattctgttttggtactcacattgtcacatttttggccagcttcttcaaattggctgagtcaaaaagactcatgacctagtagtcactgataacttctgtgctttttgctgtgaaagatctgagctcatctactttttgtgtcccagaccttaagtcagccatttttcagaggagtcctggttatttttagtggaaaattatatttagcattctttttaatggatatatcactaaaagtacaagatattatttttagtttttaaaattatgaaagtaatgaagctatgttataatgtttcattttaaaattacagagtttctgttctttaacaggattggcgagcgtgctattctactgggaggactcatcgttgtatgggttggcttctttatcttgttaccttggggaaatcaatttcccaaaatacagtgggaaggtatagccatacataattctataatgttaacctctgttatttatctaaaatcaacaagtaatgcactgcaatggttttgtttttacagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcaggtaagccaggtaccctgacattgcaattatagaaaatatacttgtaagcactcaacattttttgctgccattctctatttttacacagactgatttgagggatttttatcatattcagcatttaaaatttttaaaaatcccacaacttctataaagttcattcttgggtaggttatgtgggttatagttttggatacagaagttgtaggagtggcattgtggtagagtgtaaagtggcacagtggagtcagccaaatatggcttcaaacctcttgaacaagttacttaaactttctgagtttcagcttctacctttgttaaacaggcataacacctgtcatcgaaacttgtgaacattacaaatgatgtatttaaagcacctacctcagtgactggcatgtagcaggtacaaaataaatgttagctttaaaaggtattttaatcaattttattattcccagggcttcagcagacagtaagtttttccctttacactccttttattttttttaatctgacttaatattaaatgctatatttataggaggcattttatgtttaatttaaaagtaaaagatgcagaaatgattcttgtaagtttgctgtagtttggtaataccatttctttgcttttaaataactaaaccccaatatcaatctgcttgtcctccatttcacccccaacagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattcttaatacccactgcagaagtgtcattaaaataatatacagtggaaccagaaagagggttctgtaagaattagccatagcagaacaaaattatagaattttaaatacctctacccaagtagaggtatttttattcagacacctactttttatttataaaaaaatgcattttctattatcaagttcacttatgaaataaaaattataacacatattttccatttagcgtgcctaacatcctaccttgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatatgtgttattttatatatatatatacaaaacagtaaatggtttcttaaaattattgctatttttcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagcttttgtcttagcataataacctgtttccagcaagaatataacagaaaaaagtttcccagctttcaaaggtttataatattgattaaaatttagataaacttaaccttacacaaatgactcttactttcctttttattgagagcattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgta

SEQ ID NO: 34795 - DNA, 17561 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctggtgagcgctccgcggcctccgggaccccctggccgcacggggagagctcgggcgccccctgactgcgcactgtgagagcttcagagaccggagctccctcctctggggccctggctctcccgggcccgccccccgccgtgtttgtgggtgggtcctccacctgagtgggcgccggggcgtgagcctgggccgccccctgcagcccaggccgatgcccgggatcctgctctttgaggtaaaccaggagtctcccctgggagtggacggccctgcagcgggacctggcctgcctgtcccattccttccacctagagctgaggtacccgccttcctggcagggccagggccagggctggcgttggcccctcgtcttactgctgctgccgttccccatgaagatgggacctccccacattcctggccctaagggtcattttattagtcactgaacgcacgggcagcgcctggatcctgcgcccgggcagtcctgggcttgaacgtgtgtgtcagccgcgctgccagccatgctgaggctcgggactgagccgcccctttgttgtccccagccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccaggtgggcggcgggcagggtctgggcgtcccagagccccttacagaggcacagatgggaggggagggctgggggctgctcggaagaccccttgttcccccacctcccgccgaagcaccctgttggggagagcgtgtccttgctggctgtgctggggtgagggctgtgtgctggagggagcccctgcatggggcacggtgggcttcctgcaggtctccctgcaggctcagggttggctgcgccgcacctggctcctggtgcacccgtgagcatccctgtgtgtgtctgctggccaggctgggtagggccactgcacctgagggctgagctgaggtctcatcggtcacagcaccctgggccctgacgctggtgcaggtggccaccctgtgagggggaggcacgaggtgtgaggggcacttgggtgtgtggggccttctggaaacacagagaccctcgtgcacttggccagagccgctggctcctaccagcagggtgggcaccgggcaggcctgggcatagggagtcctcttggcaccttggaggctgcatgatggcgggggacccttgttcaaataagatgtcaaccctgagcgtcaggtcaggcccatccctcctgagctgagggacggtgcattggggcccagccagcactgtgggccagcctgtctcggaggcagaggttcttgatttctgagtgtttgggtcctgcgtgtgatcagagggcctcctttcccagttggggttccccggtttccccagggcagctgtggcacaagagtgcagctcttgggtggctcctccctgggaagggtctcagcagtggcttgcagacgtctgctgtgggtccccaggagggagcagaggctgctgggcaggcctggccctgctacagatgggcatcggtggcctccagctccctgtggcgggctcgtgctgtctgcacggcatcgtgcacactgaggaacagctgctcctcctcagccgtgtccccggggccctccccgaggaagcctcctctgctcagaatgtctctcacaggcgggctgcagcaggctagcagcaggctgatgcccagggccccgtagtctcggcgcaggtcctgcagcgtgctcacaccggctgcgtctaggaacagcagcggggcgcagtcgatgaccactgtgtggaagccggccgctgcgggcaccagcgcagccctggtgctaaccgggcccaggtcctcgccctgggcagggcctccctcaccgacccccgtctctgagcccccctccttcctcctggcagccatgcaccctgcgtccagccccgtgaggctgtagagtgactgcaggaagaagtccttgttggcatagtacagcggccccccaaagcggaacacccgcacgccgggctcagggacgaggccctcgaactctgtggcatcctcgtagaaggccgtgtccccgatgcgggccagcagggcggtgcgtgggcgttgggtgcggccggccaggctgagcagcgagaggatgacgccagccagcagcccggcctctgtgctgaccagcatacaggtggccgcggtgcctgcccagaccagcgcgtcagccgggctcatccgccacagccgcgggaggtcccacaccttgcgcagggccccccgcaggctgaccacgatgacgcaggccagcacgcttcgctgtaggtcgtggaacagcggtgccagcgccagcagcaccagcagcaccacggtggcgctgaccacgctggacagctgtgtccggcagccagtggctgtcttcaccaggctcttggccagggcggcgctggtggcgaagcagtggaggaaggcgggtagcacgttgcagcagcccacagccagcagctcctggttggcacgcacagagtagccgtgactgcgggcgaacatctccgccagcgagatggagaaggcggcagccacgagggccagggccacggcatccaaagccacacgctgcatcagcctgggctctgggacctgagggggcatgaaacccgtggggatgtcgccagccacgctcgagccaaagcgcttgtggagctgcccgaagtgcgacacgagtgtggccaccacgatgaccagcagctccgtgggcagcggcaccctcaggcggtgtcggtagcggtctgagagctccttcgcggctagcagcaccgccaggcacaccgtgctggtgaccacgtcgcacacgttggcctgcccggcgccgcgcagcaggctcagccatgtgaggaccaccatgccgggcccctggtgccgcgggatccgcacgcccagcaggtgtttgagctgcgaggtcaggatggtcacggaggcccccatggcaaagccatcgagcagtggctgtgagaggtaggcggacacgaagcccagccggaggacgcccatgaggacctgtggacggagtgcggtcaggccagcaggcgcctggcgggagccacctgcccctcaccagcacctggcatggcccgaggggtggtggtcacggcacaggacctgacaattctgtgttgcggccccgtgtgttccaaaccagactcctcacacgggcctgagttctggttccacgcgtgctcatgcccgcagacaactgtgacatccacgtgagcatcacacgtgcacacagctggccatagacacgtctaacccttgtcacgtgcagcagcccgttttatttcagaattaagacctctggtatcagaaggcaaccccttcctgctgcttcctacacatggtgcccactgccccccatgcagatgtggagccaacgggggccaaggtggacaggccaaggcaggagaccttcgggggtggggaggccatcccccactccacctaggacagaaggcctgggaggccacatggcctcagtccagcaccactgagccacagccacacctggcctgctggtccccaccaaggccatggcccaccggactggctccccgtgcccctcccctcctgcatccacagcctctccgcgtcggtgcctcgccctgggatgccccggcacgccccagctctgcccaagccttgctgtcttgggccagcacctcctctgccaaccctgtgcttgcccccagccttgccctcgtggatggccaaaacctaagggggggtgccctgggcccctccctgtgcccaagcagggctcctcacctggtaaagcccggtcatcagcgtgagggcggtggcgacacggatggcgtagcagtcacgcccgcagtccagcatggcagccgagccgttgagggtgctgctgttggctccgggctgcaggccgtcctgggaggggtcaaagccggccagctggagctcccggtccaccacctgccccaccatgaggcaaagcaggctgaagatgcccacggagacatgccgtgaggtgcccatgaggaagtagatgaggttggcgaagaaggacgtatagaggctgtagatgggctgcagcccggccagcaatgagtaggcgatggcctgcggcaccaggatgatgccgatgaccagcccagacatgacgtcgcctgccaggtactcccgcgggcggtactgacgcagccagcgcgtggcggggagcaggtcctgcaccagcgcccggacgcacagcacactgcacgagcagctgcaccacagcctggccttcagcatctcacgcagaccccggggtgctgggcgctgccgtcggaccggcaccggccctctgccctgctgcagaggctcaggggactcgtccatcctgttgcgtcaggtcccgtggccgacctgcggccgagaagagggcatggtcacaggagcccccggatccagggccaaacgacaaggtccccggcagcaacgggccccttggggcggacccctcgcccacccagggccggggattggtgctgggccttctcctggcagcgcgggccccagccccctgcccggtatggatggacgctgggccctgctggatccagaatccatcgtgaggtgagatgggattacgacaccaagcccatgccatggggtgtgctgaggccagcagtgctgaggggcggcgtggcggcaccctgtccaggctcagctccggcctattggctctgcggttcctggctgaaaaccaccctgtagcctcctgaagctcacctccccaacggggcaggaacaggctgggctgccaccacgcacatgtgcctaccgtcagaatgtcacagtcactggacacaggtgcaggcaagcctgagtccagctgctccgtgtccacctccctggctccccaggttggcaaacggtcctgctgtccaccccatgcccacaccagagccctccctcccccatccaaaccatcgcctgctctcctggagacacctccacccacccctctgtcacctgccctgtgggtcctggggctggcggaagtctcaggaagaggcctcctatgtccctgccaagctttgtgggtactgggaccccaagtctgctgggggagcagcactcagacactagcctagcccatccgcctggacttgggacagaattctgagaatatgcctggacgggggccccatcagggccagctgggaggggaggagggtgactggcgtctgtctcccctgcccagacagttctgggacgtgaggcgccctttttcccaggctgcaccagctcactgtggaacggccatgacacactgtcccgaggcagcaccgagagggcccagcccgctgcacacagtcaccctgggccggcagagccggaagggcacctgacctttcccttgatctcggaaaacaccgtggcgttagggaggcggtgcttagaggcctgactggtcccacgtgaggcctcgggtctgtcctgtttgcagactccaatgtactttcactttaaacattcttctcagcgacgttaggcaaagactttgctcccaggacaccaggtgcccaggacaccctggagcctgggctgagcctgctgtttgcacgctggcccagggtgtgcgagctccagtctcctggcgggtgtgttggggcagtgagcccagcctggtaggttgacacatgcaggctgggcacagcacccctggggcacagagcgggggtcctggccctcaggcaacattgcaagagttgtgtccccttccctggaagaccccaccacactgggtccctggatgccctgaagcccaccccaagcccctggggtccaggtgtgtggaatggggacagtagggccacctgccttgagcctgagggtgcccctaagaaaccacgagtccagggcatttctggcctcggctcccacgcccccctctgctgcagctgagatctgggcccaggatggttcttacctgagggagtcctcacaggcgcggagggccctgggatgacgaggggctggcaagaccaccgaggaccgcagggccctctggctcccgcgagcagcggggagagtgggggtggtggcgccaacctgcaggcagtggtctgtgccctggactctgtagttcaattatttacctacagattgctgagtcatgggtttctccagccatgttacctgatcggctgatccgggagttgaactgtaatcaggggcttgtaggagttagagctgtgtgggcctctgaggagctcccagcctcccaggagccgctgcagctgtggctctgcggccctgccgggggggcttagggaccagcgggaggcgggggctcaggggctgagcacaggtaaaccttcagctctggggtctggggtcgagtgcagcagccttcaaacccaggcggggctgagggaggcttggtctccgtgtccagtcgccggacaccctcctggtcctgcaaggagccagcctggtccaagctggagcagggcagaggctgacagccggctcagcccaaggctgccggtgcgtgcatatgcgtgtgtgctcgcgtaagccctgtgtgtggtgctcaccgcccagggcgaggactgccggggtcaaggtgccgtgactggccaggagtcctggtctgactggacccagcaccgacccacagcgcctggtcaccctcacggctcctctgccctcccctctaccacagaccaggaccggcagtgcctgcctcatagggctggggtgaagataaatgatttttttaagtgaactaaattaggcccacacgtgaaaataagggtaagctgctttttaaaaggaattattagccaggcacgatggttcactcctgtaattccaacactttgggaggcctagacaggaggatcgcttaaggccagcagttcaagaccagcctggtcaacatagtgagacgccccccaccttttctttttttttttttgaggcggagtcttgctctgtcacccaggccggaatgcagtggtgtgatctcggctcactggaagctctgcctcctgggttcacgccattctcctgcctcagcctcctgagtagctgggactacaggcgcccgccaccgcgcccggctaatttttttttttttgagacggagtttcgctctgttgcccaggctggagtacagtggcatgatctcggctcactgcaagctctgtctcccgggttcaagtgattctcctgcctcagcctcccgagtagctgggactacaggcacccgccaccacgcccggctaattttttgtatttttagtagagacggggtttcaccatgttagccaggatggtcttgatctcctgacctcgtgatccacccacctcggcctcccaaagtgctgggattacaggcttgagccactgcacccggccgccccctgccccccaacctttaaaaaattaaaagtaaaaaattagctgggtgtggtggtgtgtgcctgtatcccagctactcaagcggctcaggtgggagcatggcttgagcccaggagtttgaggctgccatgaggtatgattaggccactgcaccctatcctaggccacagagcaagagcccgtctcaaaaacaaacgctgtcattggcccagcactttgggaagctaaggtaggaggattgcttgagccctggaggtccaggctgcagtgaggtatgtttgtagcgcttcactccagcctacaagtcttttttttttttttttgagatggagtctcgctctgttgcccaggctggagtgcagtggcacaatctcggctcactgcagcctctgcctcccgggttcaagcgattctcctgcctcagccgcctgagtagttgggactacaggcgtgtgccaccacgcccggctaatttttgtatttttagtagagacagggtttcactatgttggtcaggctagtcttgaactcctgaccttgtgatccacccgcctcggcctcccaaagtgctgggattacaggcgtgagccaccgtgcccggccagttctgtctcaaaaaaaaaaaaaaaattccttgggagcctcaggtccccccgactttgacagtgagtactgggtgggagcctgcacggggcacctgtggccggagggtgagtgtaacgaggggctgcagccctcagtgctctcccatcccaagggaggccaggaggctgcggtgggtccctcgggtggggctggaaggccaacccggccctggcaccttgggcagcctgactctgtccggggaacagaagccacaggctctacttctcctgtccatgtgggattgaagccgagggtctcgcagaaccagctgatgtgccggggctccatttccccaagacgaggacactgacattgatggggcacagccccggagggaggagaccctggacactcaccccaccaaaggtacctccttgtggaagccgtctgccaagcgctgctagttccccacagccctgggtgagcccagggaagactgggctgcagtgcccccatttggaggtgaaatgggagtggaatgtagttgggatggccagagagtaggagacatcctaagtgtgagatgtggacagggctgaatgctccagggtctcgtaccccagagtgtgagatgcgggcagggctgaacgctctggggtctcgtacccctgagtgtgagattcgggcagagctgaacaggctccagggtctcatacccccatagcctccacctgggatgccctctccaagtctgatttctcctcgaagcccctgccctgtcctccagagtctgagcccttgcttccaccccagcccaacctgggccccagtggtccctgggaagcagctgtttgctcagcagttgggagctgtgctgtaagaagcggttggccagtgggtggggtaaggcagtcacgcagggcctcaggtccctccctgggacagataagggcccctctgggtgcagccaccagcagggttgttggagaactggggagacccagggggctggggttgttccctcaaggtctccctaaaggaggcagggaggacctgggtgctacagcaggggtggggcacctggtgcagacgcctgcatgcagggtggggtgggcagtgccacctggggccacagaaaaacctggagtgggaggtggcccttcccccctcaggaaaggtggtggaggtttccagaggctggcttatggggacctgtggtgaggttttaggcaggtgagcgtagttcaggaacagcctcagccgcactgcaggggcctggcctcaggtcttctgcaggcattgggccttatgcccttttagtccccacctaggctgggtgtctaaagtaggtgaggtcatcactgcaggatccttggggcctgacctgccccctcccacgtgtctctgcctcagtttctctgagcattgaggcagtggctggtgctgtcctgtggccaggcccagaggctgagtgcccagggggtccaggggccttgctggccagagagagtgggtagcccattctaccccgagcctgtgcacgcgcagggctgccaacacctccttccttccccgcttggcccacgcaggacagggggcgtgggggccccagcaactgggacctgcctgaatccgcctccctcctgaacccccctcccgcctgaacccctggccagtcttgtgtcacacgcttacttccttagttttgtctttaaatcagccgttttacattggagtccatttactgggaaaggagaccttgcatccttgcctcccacccgtgggaagaagcccggccgacagggctttgagaccggacccgagtttattcccagagaccctcccgcgggtgggcgagctccgaggtctggagaagaggaggccccggcccgcaccctctagcacctgtgtccccttcgtcccggccacagatgcaggttctcccaagaggcgggtctgtacccgccccgcgcccccagcccagcgggcccggcctccgcccctgccccgcactcccacccccaccctcaggagagcgcggccctgctccccaccccgcgcggtctccccccaccgcctgcgaacccccatgcacgcgcggccccgccccgcgcactcaccaggcccggcagccgcgcggtcttagcggctcacgcgctcgggcccaggggcggggacgtggggacccgggcggccgctcagccgcggccgcgcggtgaatgagcccgttgtgcggccgccgcggccccagcgacaccccgcgcggggtctacaagggctgacgcgcccccgcggcttccgttcccgggctgggcggtggctcgtctgcgtctccggccctgggggtgggctgcgcgctccatctcgccggcccagtcccctccccagcgtcggtctctcaaggcccctcccaatgggggccaggcggagggtgggccctcgggcctgtggactgaccccggggttcctgggcctgggggcggggatccctgtcccgggctcccctcgctgcgaggctggccctgccagatgacactcagaggcgccttgggtgtcaggccagggacatctctgatgctggggctccccccgctagggtcaggggctgccgggctatcgccttggggttctgcagagaaaacctgaagcccagctgggtcttcactttcctccaggtcaccgtgccccgctactccaactccgtgggactttggaatgcaccttctgggcatttaattcttatccaagtgcctcttaagttatacttctttgctaccagtgtgtcctttggatggaggggaggagaggtggtaggggccgggtggggtggaccccagggactcctgctgctcctgctggacacccagcccggggtacaggagcaggtggggaccagcagaggcggggcggagcaggagcccacacccaaaggctgtagactcctgccaaggctctgccttgatcttgtacaccatgggaggaccagaagggaggcgttgaggtgtccagacctttgctgtggagctgggggtgctgtggcatggggagactgacagacggggagctgtatagggccagattccggtccatggtggtaaccccatcccccaccactgcagatgcggcacaaagccagctgccacaggaggtgcactgccccacgggcagctgtgctcacctgcgtggcgtccgcaggaagccctcagaccctggccagcctggtctctgcttctcactccaggctcaaggctggctgctattccattcaccccattccctttccctcaggccagaagcatcactcacaactccagacccttgcacaccaatctcctcactcagttcaccctcagatgtccaactccacatggccaaaaccgagaccagtctcactccaagctcatccacccgcctagctgcccaagctgaaatccacagttgccctgtacgaccccccgaccccccacctcaccccccagctcacctcaaacctcatcagtccctctgctcacagcctgcacagccaccacccagtctgggcaccatacctctctgggcaacccccatggcccccagccagtcttccagctcccaccctgactccagtgagctgccagagggatccttgaaaaatgctctggaagccaaggtgggcggatcacgaggtcaggaaatggaaaccatcctggctaacatggtgaaactccgtctctactaaaaatacaaaaaaattagccgggcgtggtggcgggcgcctgtagtcccagctactcaggaggctgaggcaggagaatggtgtgaacccgggagggggagcttgcagtgagccgagatcgcgccactgcaccccaggctgggcaacagagtgagactctgtctcaaaaaaaaaaaaaagaaaaaagaaaaatgccctggcactgctcagctcagaaccttgaaagggatccttgtttcgctctgggtcagggtcccatcctcaaagcagtcacttccagagccccatggagcctcatatcccatgatatccacccttattctgtctcaggcccaccagctgcctccctgctgcctgattgtcatgtgtgcattcctgttccagagcctttgcactggcgatgccatctgctgcctggatgtcttcctgctggctggtcccgttgcatggtagccttaggtgtctcctcagagaggtccctcgctgaccatcaggctcctcactccctgtcgtatccccttcaccaaagattcccattccctgacgacgcctgtcccctcggaatgcaggcctcgtgggaattcagcccatccgcaagtgcagtggcagggcggcccccttcccccttgacgacgcctgtccccttggaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcggaatgcaggcctcgtgggaattcagccccatctgcaagtgcagtggcagggcggcccccttctcccttgacgacgcctgtcccctcggaatgcaggcctcgtgggaattcagccccatcggcaagtgcagtggcagggcggcccccttcacccttgacgacgcctgtcccctcggaatgcaggcctcatgggaattcagcccatctgcaagtgcagtggcagggtggcccccttctccctttcctgtgcactcatgttgcctcttggggtgtgggaggggaaatggggcactcctgggcctccaggaggtgcagagaaccagggtgaggtgtccaccaggtcctgcctggctcctgacccctggcccctgctgctcgcgactggcctgcctcgtgccactgagcctcagagccattccgaacccccaccccaagttttccatctcttgatggtgtagggttggggggtctccatgtacagatactctagttcataccaggccttcatagggttattttccaaggggaagggcccctcgggaagccgggatcggagtcctgtgtggcaccttgcaggctcccacatgctccgttgtggccacggttccagcctggagcatggagctgtgtgggcaccctgcttcctgacgctgaccgtccttctgcagggggtccactggacggggcctgagctacaacttcacccacctggacgggtacctggaccttctcagggagaaccagctcctcccaggtgagctgtgggctctgccctcccagcccgcctgcacccccttgccctgcccaccctctccctcacccagcccctctgagtccttggatgtccattcagggctggccttggtgccggagcacaggcctggcagagcatgggtgtggtgtgtggtgggcggtggggcagccctcctgtgttccagggtttgagctgatgggcagcgcctcgggccacttcactgactttgaggacaagcagcaggtgtttgagtggaaggacttggtctccagcctggccaggagatacatcggtgggcgagcgcaggccctggggccctggccggggcgggggtactcctgggcaggttgcacccctatcacgcaggctgctgcctggtcaggagatacattggtgggcaggcgcaggcccttgtggggggatgggggtgacaagggataggttggtggtcggcgcaggccctggggccccaggctggggggtactcctgggcttggtgggtgggcgaaggccctgggcccctggggtggggggtactcctgggcaggctgcacccctatcacccaggccgcacccctatcacccaggccgccgcccaggtcttggacccccttgagccagcgcttcctgatgtggggcgggaggctggcctgcatggagatggggttcatcttgagtcagacgcccttcatcaccttgcaccctccctccgtgggagtcactgaggcgagattcacctgtgctggggggacagcaaggctcctctgcaggtaggtacggactggcgcatgtttccaagtggaacttcgagacgtggaatgagccagaccaccacgactttgacaacgtctccatgaccatgcaaggtgtgcaccgcttcctggggtcctgcccggctgaaagggggcagaggaaggcaggagcagaggctaagccgctcatccccagggcaggtgtagacgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaaggtgcgccctgcccctccgtccgccccggtgttctgcgccctcagccgctgtgccccgggccgcgctgaccctggtggtgctgaggcggccccgcccgcagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctgggtgagccggggccgctggggtgggccggccagggccctccaggctggggagcggctcctgcgaaggccccgctgcggggagcgcacttcctccagccgcgcgcttcccggggtcggcctccgcgtggcggggcctggggactccttcaccaaggggagggggagcgagtggtgggaggcccggccctgggtcggggggcggctgggcaacgaccccacgcggcgacggcccccccccgccccgcagatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggtaagccggggttccagggaggtctctggccccgctggggctctggagggggcggcccggggagccgaggcctgagtgtcaggccccgcaggcctggtctacgtcacgcgctacctggacaacgggctctgcagccccgacggcgagtggcggcgcctgggccggcccgtcttccccacggcagagcagttccggcgcatgcgcgcggctgaggtaggtgggccgcggaggggcgaggggccgggccgggccggggtcccgggggggtggggtccggggcgggggctccgaggcggtgtgggtgggaggtggagcggtgggccgggggcgttcgccctgaggtcgggccgagcgtccccagctcccctggagaaccctgaggaccggccactgcgcccaggacccggtggccgcggcgccccgccccttacccgccggcggccgcctgaccctgcgccccgcgctgcggctgccgtcgcttttgctggtgcacgtgtgtgcgcgccccgagaagccgcccgggcaggcaagtggcagtcccctaacccgcgccgcggcccggactccccttccccgacgccatcacagcccttccctcccccaggtcacgcggctccgcgccctgcccctgacccaagggcagctggttctggtctggtcggatgaacacgtgggctccaagtgcgtgagtggggccgcccctccctctgcctggtcctaggcaggtccctgggtcccgaccccttcacccatgcggtcactcgggccacttgccgtggcccatcggctccctccctcgccgccctgcgtccctgcccttcaccccacacactgtgggccacgcgccaggccctgccagtggggtgtgggttctcctaggggacatgagatggacattcgggctccagccctctcctgcctgggcaggaagagtgcccaggggctggggaggtgccgccgaggggcttgagggaatgaggctgtgggtccacgcggccgtgccctgcctgctcccacctttgaggactgtcttgaccccagccttgttcttggcctgacctccccaggtgcctgtggacatacgagatccagttctctcaggacggtaaggcgtacaccccggtcagcaggaagccatcgaccttcaacctctttgtgttcagcccaggtgcgcccaccacccgctgccctggactcggccaccccattcttgggcctcagggcagtactgggtgggggcctcgagaagcctggggtcagggggctttcgggtgggggcaggttccggttggcacacatgtccccttgtctccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 34796 - DNA, 9149 bp, Homo sapiens
taaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggtgagcagcagcgcagcacccctgcccggcgagcttaacttgcccagcccggcccctgccggagtggcaccggcacctctccaagacgccctcttccctgcaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaaggtatgatgtgtgactcccaggggaagtgggctccgcggagatgccccctcccatccctgaccttttctcttccccgcgagtagggatctaattcctggacacctcccctaccacttccataccatcctttttctttttccttttttttttttttttttttttttttttttgagacggagtctcgctctgttgctcaggctggagtgcagtggcgcgatctccactcactgcaaactccgcctccagagttcacgccattctcctgcctcagcctcctgagtagctgggactacaggcacccgccaccacgcccggctaatttatttttgtatttttagtagagatggggtttcaccgtattagcaaggatggtcccgatctcctgacctcgtgatcctcccgcctcagcatcccaaagtgctgggattacaggcgtgagccaccgtgcccggccttccataacattcttaaagttctagattaagtaaggaaagttctggtgttcctaaggtaggctaagtaaataagcaaatggcaacgtgccttgcaggatatctcgaaatgcttagagaaaggatgtggcaatgcaggaccgcttccagagattccagagctgcccagtattgctgcagaagtcatcaggtgtccacccacagtgtagttcaaacgacaaagggcaagtgactgggggtgggggatacaaggaatcagtcaccgctgcttgcaactttaaccaagaatttcacttgaaaggaagaggtccagagtttatatttaatccataacactataaacaaagtgtgtgcctttaaaataaggaaccatgcagttttctccctttgaaagctgcatagagggatttttcattgcttgctataagctatcaaaattcccagtaagagggcccccctggtagttcccttattctttgtgttggtgcttcagagttgtattttccatggtattctgaattctttctgggttggctttgatcctcatctagacttcattgttaagcatcctttacccattagccctgaaggtagattacattgtttatgggttccccagagatcaatacaattagttttcaagaagagatgttaaacattggaaggtaatttttatgagtattttgaaaaaatactcatgattattaaattagccacaaatccaaagggaaaaatggatttttatttccttttaaaacctcttaacttttaaaaatagttaagattttaagcctgaaacttcacttacaattggaaactttctcagccttcattgcacttgttaaagaagtcattgttaatgttcagtctttataatggaaacctgggcaataacatatgagctttagtgttactcttcatgtttagatatttttgggaccagaaaaagctaagtcagtttttttcatgtaaccagtttttaattgctccacatcttggttaatttttttgacccatttgggaacatctttctctatcctctgtgggagagcatggaagtattttgcttttatagatcggtgtatgaaactccttatagattttatagagccacaaaagactcaatctaggaattcttttccaagtaaaataaaaatacagttagagcactgtgcagcgattcaagaatcacagctctagtccaggcctgtttagaaatgaactccaccacatttacaaacacgggctcccaaagtgtacaaaaggaaacatgtcagatttacttaggaaccaagcaaatcatttctctaaggaaaaacagtatttctatcaggtaattaggagttaccctttcatggaacacatatagcgctgcattatatatttctacagaaaaacagtaactagtgcttttgtaaggtagtaaaatatttaatctgcataaataactagttggagtagtttttcatctttggaaactttgttagggtctacagaagtagagaagtgttttaattgctgttgctgcatagcacctcttgtgaaactgagttttgtcttcactttgaatggtctaacaaacaatttggccacagagtagatttcccgggggaaaaaaaaaagttttcatcccaaatttcctaattctacaaactgtttttgaacatgcactgagagaagtaggtcattaatactgaaggaaggactggtttctactttttagaaacataagaaattatttgattctgggtctgattgctgagttctccatatatgcaactaatattaacatgagagttacaaagttgcctcttacttaaatttgagttaataaaaactctcaagaacacactacccctaaggaaaacactgcaattagtttgcaaatgaatgaactggaaaagaacatttactcctttgtggtaacactctattttacaagtttagaagtcataaaataatgggatttttataatactgttgacaatcagtattttgtaaactaaaaattcctttggttaataactattactattccttatgctttttctactatgatttttttttactttgttaatactgctctttcattgccaaaaatgattgcaaatgccccttttaatttgtgtggattgagtgctcacaagagtgttcctacagacttattgaccccttctagaaatttcctactgttgagcaccactaaagatgcctgctggtctgctgaccaagtgaacaggaacagggtattagacatgagttgctttttgagaaaaatctgcttttgtgggaaatacagtcgaaaatgattctgattgacttaattataaattaccaaggaaaaaaataaggataactgtatttacaacttagtcatttacaaaaatatgtcttccatcaacctccttttctccttgtcctgaaaacttcaatttgatctttaccatcttaaaatagtatacttctcaatgccttgctagtttattaaaaaaggacaaatagtatgtctgatagaaaaataggccaacatctagataagtttcacacttgtttaggtaattgtgtaaaagtatggatagagataaccatactgtcaaagtggtgtattaaaacatattgaacttgttcattctatcacttaataatttggaaacctagctgcccagtaccatgtaagccactgtagaaaaccctaaaagaacataaaatgccatgtctagaaacagagcttaaaattagtatgaatagcaaaacccatatagaaatgactgacaatcactgcattctggcatcaacggcaatatggtagagataactgtcaacaaatagagtactaataataatcactgtaataccttatgtttatacagcacgtagaagaatacagaggacttgtgcatcaaacatctcagttaatcctcagaacaatttgagtgttcccatttgactacttgaggtgacatagccaataagagctggagccaggactcagacataggccatcatttctaagtaaaattatttttctaaggaaaacattacacatattagaaggatgcattcctcaggggtaaggacaatatttgtctttttttccagcagccagttatgtgtcacataattgatcctgaatttagcatatttagtcaggaaatgggatttgacaataaaattagactttctatgcctgtagattttgagacttataaaaaagttatcattggtatcattagattttagaatggcagattggaggaattgaatctacttttaattggccaaattctattatttttactcaagattagagacacctctttgctcatctaattttaaaatatgctattgttattgataagcagtttgatgttttaaacctttagtcctgaataaccatgtggttatactttctatagttttctataaatgctgtatttacataggcaactgccattattagttgcctaagggatcatttctgctactatacggtatagaatcagaactggactcttaacattgtaaatttttttgtaagtcataagaaaaagtctagttcttctggtagacagaaaatagctgggaaaactgatttactgtttgatatatgtgattcttcttgggtttagccacctttcctaattttccaatattttattttccagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagttttaaccaacctagatctgtcagctaagctaattttatatttggtatacatgcatgtcaaataaagttaattttacatact

SEQ ID NO: 34797 - DNA, 38195 bp, Homo sapiens
ggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggtgagccagggcagggggctgcagcggtgggcgagggggcggcggctccttcccggcgggcgcttccgcggcctgaaaacggtacccgccgccctgccccgcggcccggagcctgtcggggtgagggtggcgaggggtggggcggccctcccgcgagacggctgccctgggaggatccccaagcctcggcgggtcctgacctggtgggagagggtgggtagtgaacacagggtgggcccaagaagggtccagggccggcctcttggccgcaggtaacccctctacaagtcacccagagacttggaggtgacgtcctcccgcaggctgggaaggattccgcagccagttcctcgccataaggaggtggttacagacacgcctgtgggagacatgggaccactacccgagctgaatgaggtgcccagggtcggtgggaatccacatagactgctgtgtctaggagagtgtgtacactctatatagagagaatatttgatgaggccgagaaccccaaaggaattgtttttgccatcgaaatgcataagctacaggaagtaaacatcgctcaaagaaaatgaaacccaggttccgacctggcctccaccagcaggaaaactgttgtatggaaatgtacaccaaggaactgtttgtaaggatgaaatggaaaatgaaagcatagaaaagtaaggcaatgtgaggacctcagaagcctttggatctggttagcaaggtgcaggctgtgtgaacagaagaacccaccttgctcttttgacccagggagagaagagttagtggtgccaggctgcctcccaggacaggcccagttttggggcgggggctggagaagtcccagggcagaccccaaggccagggattgccctggagtggacaaggcaagtttaaatgtgacctgtagacagaggacgatcattgatttaagtcctggcataattcatctgtttttccactgggccaattttaggcgttctttatatattacgtacaacacaataaaagtaacagcttctttttttataaactaacctttaggttgcatattatgctaggaatataactaacctaacctccacccccccacccccccacccacccccggaaaaccaaactttattctcgagggcaactggacactgtattatgtcctgccgaacccccgcccttacttaggtagaggcgcataagtattctggccatgaaatacaccttctgttttatagagatttggcatatttgatatatgttctttggaatttatgaaatagaaaacccaaaggaaaaagaaaaaaattaaacttttttttaaaaaaatatttcatttagaaagaaaaaattaaaagtttttgttatttccactttgacatgtgtatgaggagcattagaatctgtgttatgaagtgatacccagatggctttgcagtgacagaaaacacttctaatttttcaaataagttagaaaggaggattttgagaatctggaagtgaatgccgtggaactgtggagaaactcctaacaatactggcatgctgagtttgtcacctacacagcagaaagcattttacaggtattagacttaaaaatacctcattatgctatattttcatttcatttcaaccaacatttactgcaagcctgctatgtgccagtctctagtaagaataacatggagagaaaatagacgggcagacgatagcagtaatttcagaatgggcggaggaggtggaaatgcagagtgttcttgggtgctcggagtagggaacagttcatatgacacaggacatcatatttaagctggacattgatctgtccagtggaagtttgccaggacacaaggggagccagacatttcgggcagagggcagaagggaggcaaggacgcagagacagaagaatgcagggaaccgtgagctctttaacgtgccttgggtacgagtgttttggtggcaggaggtgactctggtgggtcagttgggcctgggccctgaaaggccacgtttgtcttgttaagaaactgaaagtctgtcgtgtatgggaagggtggactcaggggaatgacctcatattgcaaaagaaaccatgagggcaagaggactgaaattgacagggctgaaagccagtcatttaggaggctgttaaaatgtattcaacagatatttaccgagtcctgccttctatgtggcaagtaatgttctcagtcctggggatacagcagtggacaaaataggcagaacccctgtcctttgtggaggtcaacatggctgtggtacagacaagataagggcctgaactaagcctgtggggatggagaggaggcagtggattttagaaacacttagaagggccaggcatggtggctcatgcctgtaatcccagcacttagggaggccgaggtgggtggatcacttgagatcaggagttcaagaccagcctggccaacgtggcaaaaccctgtctctactaaaaatacaaaaattagctgggaatggtggcatgcacctgtaatcccagctacttgggaggctgaggtgggagaattgcttgaacctgggaggcggaggttgcagtgagctgagattttgccacggcactctagcctgggcgacagagtgagactgagtcttaatttaaaaaaaaaaagaaaaaataaatatttaggaggtagaggtgatggcatttggtgacccattagacttggggaaaagggggctgggaagaatcaagccttactcccaggttcctgccttggggagctaggttaaagctgctgccattttctgtatattactaaaatacgaagtcacaatatcccttctagtgtgtaatgacgaggctgcttttaccccattagtaggatgcatactctaagttctttttccaaggtgggaagggtttagtcaatgcaatgttagaatcttaccccccttgtgaacccaaactcttcatagcatttgccagtagccaactcttgtctctggtcaaaaagcaagttttcactgtttaaaactcatttatcccatgtagggattgaacctacgaatacttcattagcaaatttgaagacttggccataccagggcaagggcctaaccttatactatgtgcagtgtccactggggggaagtcagtgtaaggcaggtaccatttgacacattatgactttctgaccactagagccatcccacagtggaacagacagtgcctgctaaggtcactgcactcgtgctctgtcattgaaatactcaagcctgctctataggatcatgtgccatcgaaaccagacaagacattcttgcattgaatatattggtctggatcatttctaaggccaactcagcaatcagatgtatgctcgtgtttacaaggtcaggtcattactagaattacttgatctctggaatttaaatgtatatacacacacatgcacacacacacacacacacacacacaatcaggaattgagatagcagatctgggaataaaatctaggggacttgcttttggccatccatctactaggcagtcctcagtcttcctcattggtggaatcttgacaaatcctgtgctcaattaattcatccttccatcattaaatatcacttttgcctagaaataacatacttcacatctaggtcagttgattatgggaaactctgttatttgatagaatcttagaataaatggcttagttccaatttctgtaaccttcgaagacatgtgcaaggatatgtaatgtatctctgtctttcctcagttgaatgtagctcaaggtgatgttaaaaacagagaatgaagctttctgtaactggcattccaccgacagatatttcatatgtgcactgcacagtgatagctcatagtgatgtcctaagataacctaagaattatgaagtgccctttgagtcatccaaaatcagttaaattagtttttttttctttttttttttttttttttttgtgagacagggtctcactctgtcacccaggctggagtgcagtagcatgatcttagctcactgcaacctctgcctcccaggttcaagcgattctcatgcctcagctcccgagtagctgggactacaggcatgcaccactacacccagctacttttttttttttttttttttactattacaaaatttatttaacaaaaagtctaatatgaaaatgtacatgacctaacttttacatcatagtaaaacaggccctatggagagaggacatgggtttctctgctgaacagccattttttatactcattccaaggcttctaacatgaggatactgtttcctcgtattaccaccattccagtattgttctgttgcccactagtcgccatctccacacattcatctatcacaagattcataaagggatcaagtccctgcaatattccttggacgtgtctgccaccatttaatttcaatgataacttcttgtccataaatcccttctagccatctggttagaacatgatgctattcgagatgttcaacaaaaggtggcattcgagatcttcaaggaacgaagaagggacagcatgggggtgaccaggggcccgaccgcaggaccgggaggcgagtcggccagaaagaggtgcagtggctgctggtggtaactacgccgacgtgcgagctctgctactaatttatgtatttttagtagagatgggatttcaccatgttggctgggctgatctcaaactcctggcctcaaatgatctgcccaccttggcttcccaaagtgctgggattacaggcataagccactgcacccggcatcaattaaattacttttagtaaaattttggtattaagtatttacatgcttatatttaccgtttatgctaacttcttatgtttgatgacatttgaattacaaaatattttttctaacaatacacaatatcacagaatttgctgtcattaggacagttatagctattcatgagagtgactggcctgcccgtgatacttggtgtatatgcattgaagggtggggtttagattgtggtctttctagaaactaaagaatatttttcacagagttcataaggattatcatttgctggatgagtcaataaataccactagaggtcatgtgacttcccaaggccacacatctggctaatggtacaaatgtttttttctgtggcctcccttagcacgaccccacttttttcctcgtatgcttataaaatccgggcaatgtgagaagtcagaaacactgatgtaacaactagaaccagttttaactttattatggtggtatctgtaggcttggtggaggcataaaaggtcatggaggggcccggcaccgtggctcaagcctgtaattccagcactttgggaggctgagatgggtggatcacctgaggtcacgagttcaagaccagactggccaacttggcaaaaccctgtctctactaaaaatacaaaaattagccgggtgtggtagcacatgcctgtgatcccagctacttgggaggttgaggcaggagaatcacttgaatctgaaaggcagaggttgcagtgaactgagattgtgccactgtactccagcctgggcgacaaagtgagactctgtctgaaaaaaaaaaaaaagttcattgaggaaaaaaatcttaacagttttcaaagaaacgtctctctcttttcttccctctcttctcccctccccttcctttcattttcagaaaaaaaggagaaatttgtgcatataataagatgaaaccaaacacacttctaaaaatctgcttagatcctttctttaaaaaaatctgttgaatattttcatggcctttgcaaaatatagtataatcactgaatacctaagaaaaattaactgttggcaagtaaatgatacagatgacaaggattttctcttttaggtctattacctagaattttagtattcctctgcaaattaggtaggaacactgttactcagtaaaaccctattttaatgagatgattctgggtacaaaaaaatgaattttacagaaaattagaaactgatggtctattcagattatttttgtgagaagaagagcagtctgttctagtcacctaatgctaagctatggaacacttctgcattatacctgttttctaagtgaatttgggtgtgtgacacatagatacaaaaagttcaaaaatgaatcctatggtttatcagtgttttctgcttcgtaagattgccatcaccctcattacatgactacatgagaatgcccctcttggtactagctcttgtaggaagaagtggcacaggctgtactgtcacagggtgtggtaggtagctctgtctctgattacctacaagttcctcacaccaaaaggaggttaccaggtattgcttccagaagatctacagaaagcccaaggtattgcctcctgtggccaaggacgcaacaccacagtggtgcattttgttttattttaattgatggctattaaatgcacacatagatatcatgacacagttacatgtcagaaacaggcagtgctcttatctctatcttccagggactgatatcatgtgtaatggattcttcacaactcagggttcacacaggctccatagtcatgagtggctgatggatctcattgagaccagtgcctttcccccgttagaaatgggatgctcgcttccaagttctctcctcaccccttttgtgcatgcgtggctttctgcctgatcacagttgtatagtgtacattggtgcttaatacctatttattggatagatggattttaaattattttctaaggtccaggagcagtggcttatgcctgtaatcccagcacttttggaggccgaggccagcagatcacctgaagtcaggagttcgagaccggcctggctaacatgatgaaaccccgtctctactaaaaatacaaaaattggccaggcatggtggctgacgcctatagtcccagctacttgggaggctgagtcaggagaatcacttgaacccaggaggtggaggttgcagtgagccgagatcgctccactgcactccagcctgggcaacagagagagactctcaaaaaaccaaaacagtctttttttttttttttttttgagactctgtcgcccatgctggagtgcagtggcacgatctcggctcactgcaagctctgcctcctgggttcacgccattctcctgccgcagcctccggagtagctgggactacaggcacctgccaccatgcttggctaattttttgtattttttttattagagacagggtttcaccgtgttagccaggatggtctcgatctcctgacctcgtaatctgcccgcctcagcctcccaaagtgctgggattagaggcgtgagccaccgcgcccggctcaaaaacaatcttctaacagtaaacatcctggaagtaaataatatgctttttcaggcatgtctctggactttggccattcttgacctttgtagaatgcgtgtgtgggccatgtgtacacagcgtcagcggggaggagttgcctttgctatgtattgctttataatctatccccatcagctcttgaagaaaatacatcattttcaccaagtgtgaaggtggaaatttgtgctgaaacatgtttgcctgggtggttggtaacacagaagcagagtggggatttactcattggtcttgcatttctatgtccacatggatgcctctacaaaacaaaatgatatgtgtaaaaaaatttcagaccatgcaatacctaaagatatcttagtcttttcagtatgcattgaaaaatagactattaaagcctaagtactcagtaatataactttgttgttttacaaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagtaagcattcaaagaatgttaattctccctttcttcttaaccaaaaacacaataaactaaatataggttttaaaacagcttttttgagatagaattcacttaccatgcaatttacttgaaataaggagatttgaatttgaagatttgcatgggaaatttttttcatgataccttgcccatgtctacatatatcctgatcatcatgatgtcataccctcgtctccctcccccatttcccaaatccttattgtaccctttttttttttttttggtttgagacggagtctcgctctgttgcccaggctggagtgcagtggcgcgatcttggctcactgcaagctctgcctcccgggttcacgccattctcctgcctcagcctcccgagtagctgggactacaagcgcccaacaccaagcccggctaattttttgtatttttagtagagacggggtttcactgtgttagccaggatggtctcaatctcctgacctcatgatctgtccgcctcggcctcccaaagtgctgggattacaggcgtgagccaccacgcccggccctcattgtacccttttatacacccatacacacacacgcacacacacacatgcacacatgcgcgtgcacacacacacacacttttctgaagctacatataccttttttgtttaaaaggaagaatcaaaaatgtccaaaatgtaactggagagaaagtgggcaacttttggagtaagtattagcaatcgccaatgggtttgtgggactcccggggaccccttgtggggcgggggacagctctattttcaacaggtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaaggtgagcagggctggcccctgtgtgccccattcatcctgggcctgcaagaaatgccatccctttgcactaaggcttggtggtgagctcccttctccccgtttccataggtggtagctggtggggaagcacaggatttagcatttggcaaggctaaatctgttctgatttttacttttggaaacaggtacaagtaaaaactgtgtgtatctcaaggaagtagcataatgatatttagcccattcaaaaggaaaaagaggctgggcgtggtggctcatgcctgtcattccatcactttgggaggccgaggcagaaggattgcttgagtacaggagttcaagaccagcctgggcaagatggcaagacctgatctctacaaaaaaattaaaaaaaaaaaaaaaaagctgggcgtggtggtgcacgcctctggtcctagctactggggatgctgaggttggaggattgcttgagcctgggaagttggagctgcagtgagccatgatcgtgccactgcactttagcctggatgacagagagagaccctgactcaaaaaaaaaaaaaaaaaaaggaaaaaggaagaaaggctgctatggttccagagttagtcctatatattaccttattaagagaaagcatcctggtatctcaagatggctttgggcaggaccagtatttgaatctaggagtagtaagaacttccttagctcctagtaaccatagatatttagatatttgtgctgtagtggcggtacccaaatccactttattttcttgggatttttaaggactagaaatgatgttcatcccgctagtcttttctgtaagcaaaaaccacttcgtctttttgctgctgacccttgggccaaggctaagcatggcatctttcaattcagagccatgtggtcaagtggactagagggagatttggttcatcagatcaagtccactttcctggtgtgtgactccatcactctgaacctcctgcagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggtgagcagaccgatccattgtgatgttgttttttttttttcccttgacatttgcagtggaatcttacgtgtctagactcctagatcaaaacctttcatggttcagtctggattggtgttttgcctggtcttggaagaagtgcttttgctgaaaagattggttgccctattaagggtcatggataatctcttttagaagaaagaaatttgtaaagctttgaccgtactgattgtaggcaaaagaacagtaaggttataaatcattgtattgtattcattatagatggtgcagatgggcctctgcctagaaccaacaattgtttttagtttgtctttgatataaaaaatatgtttaaaaaacccattactcagaatttttacttgttgaccttgtctgttctctcagtctaaaatggagattattcactttacattttcctttttaaaaatgctttggaaaatgtcatgttgtggtaggaggctatcgcattgccacagatgaaaagagaaagagacacatttttcttaacccaaagaacctggaaaaatgtgctcatacctgggagtggatgtcaaagatgatagtaatgacacaacccagaacaagtttgaaatccccactgggcgtggtttgttaaggagtcctctgctgtccatgccaagtgtggggagaatgggtgtgggtgggctttgatgggaggaaaagggcaggaggttgggtggtgggaacgttttttccttcctttctggaattttagacacagcttatgagtccactgttgccaaagtgtggttgattatttctatgatatcagattattccagcatggcaaggaaggctttctttcttgtcatgaagttactttaaattttgattatttgaatacaataaaataatgtaaaaatttccattttaaatgttatgtcaaaataaatcgtgggctaggcacggtggctcacacctgtaatcccagcgctttgggaggctagggtgggcagatcacctgaggtgaggagttcgagaccagcctggccaacatggcgaaaccccatctctactaaaaatacaaaaattagccaggcatggtagtgcgtgcctgtagtcccagctacttgggaggctaaggcaggagaattgcttaaacccgagaggtggaggatgcagtaagctgagatcgcgccattgcactccaatgggcgacagagtgagactctgtctgggaaaaaaaaattgtcaggtaaaagctgaaattttctacattaaagcacaaggcataaaggtgttgagaaacttccttgtcagtaggtgtgggggcaattgagtctcatggccaggtccttagtttgatttgtatttgttttttgactgtttttttttttttttttttttgagatggagtcttgctctgttgcccaggctggagtacagtggcataatctcggctcactgcaagctccgcctcccaggttcacgccattgtcctgcctcagcctcccgagtagctgggactacaggcgcccgccaccacgcccagctaatctttttgtatttttagtagagacggggtttcactgtgttagccaggatggtctccatctcctgaccttcatgatccgcccacctcggcctcccaaagtgctgggattacaggcgtgagccaccacgcctggcttggcttttttttttttttttttgagacagggtcttggcagtcttaaactcctgggctcaggcagtcttcctgcctcagcctcccaactaatggggactacaggtgtgtgccactacacctggctaattattaaattttttgtaaagatgggggtcttgctatgttgcccaggctggtctcaaaatcctggcctcaagggatcctcccacttcagcctcccagagctctgcgattaagggcatgagcccatggtgcccagccttagtttgatctgttcattcactttactccttgtcatctccaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgtgagtttttggttttatttttgttttgagcaaactataaagcctcccctggaaagatgaaacaaataccactttttcttgtcaacacaagccaaggattgaggaaattccagtgtagcaaagataaattggctctcattttctaagtatagcataatgcatgtaagggttatcatagctaaaatggaaaaatattaattaccttttatgatgaaagctgtagtctttttttttttcttcatcatgtcctggcaaattgaacatttttgtgaccagaaaaggaaaaaacccacacgaacatgaactttctgtcatttttcaaactaggtctcaaagctgtattccgcagttcacttaagggagcgcaaacatattttcacaacagaaccctctttttttgttttgagacagagtcttactctgtcttcccggctggaatgcagtgatgtgatctcggctcactgcaccctctgcctccggggttcaagagattctcgtgcctcaacctcccaagtcgctgggactacaagcgcatgccatcacacccggctaactttttgtatttttaataaaaaagacaggtttttgccatgttggccaggctagtctcaaactcctggcttcaagtgatccacccgcctcggcctcccaaagtgctgggatgacaggcgtgagccaccgcgcctggccaacagaaccttcttttcaaacaaagtggtatgaggaaccctgatacattaaaaagaagaagaggagaaaagaaagagcagaactgctctggttgtaggttgagggagtgtcctggcttttccttccctttcaaaagcagctactcaggagcctctgagaactgagtttgaagccattgctatcaaaatcaaatttctctgcaaccccagatgaagtgggctaagcgagggggccctaagctcttgagaagcatctgttacaactgtgcctgggcataggggcagccctattgaagagcagagcaggtcgatgcaccagctgggggcctgtccttcattgctactaacaaagattagacagggagaaagatagacaaggataaaatcctctgtagtatagatggtcactttcgatgagtcagagtacatatctgatacaggaaaagggactggccgggtgtaatggctcacgcctataatcccagcactttgggaggctgaggaggcaggatcccttgagcccaggagttcaagaccagcctgggcaacctggcgaaaccctgtgtgtacataaaaaaaaaatacaaaaagttagctaggcacattggcacacacctgtactcccagctactcaggaggctgaggcaggaggatcacttgaacctgggagtttgagatgctgcagtgtgccatgattgtgccgctgcactccagcctgggtgacagagcaagactctgtctttaaatttaaaaaaaaaagaaaagaaaaaaaattgtgtccttggaagagaaaaatgtacattgtagataagtcaggaggagtggggaacaacttgcaaaaaagctcacctactggttatatctgaaatatgaatgtctgactgtctttgctttctgatttatttgctgcaatagagttaggaaacagctctgaataaccctgccatccattccccctcatacatttcagtggccaaaatcaagataattaaaatgtcaattgaaaagcgtattttgccagagtaccccttctgcaagtgatcgaagattactgagacagaagtttaaccaaagaaacttacccttctgtcaataaccgataagctgcaggaaacccaacagcatatgagaagtttccagatgaagcttcttccttcagggtgcatggttagcatctcattctccctgtcagatgagtgacagttatttttagtgtaaacacgttttgcatgcgtttcttctgtgaactggaaagcactgcccaagatttaggaagaaacatcaaaaatatctagaacccccatggccccaagcagagaaaaaatatatgtatctatgttttttataatagatatatctgtatttatattatataatgaatatataatatattctataatatataatgtagaatatattctacaattatataattgcatatataattatataattatataattatataattatatatacatatatataattatataattatataattatataattatataattgtataatatattctacaattatataattgtattatatacacttacatatgtatctgtattttttataatagatatatctatatttatatatatttatatatagatatatctatatttatatatatttatatatagatatatctatatttatatatatttatatatatagatatatctatatttatatatttttatatatagatatatctatatgtatatatatttatatatatagatatatctattttatatatttttatatatattatatatatatataaatttataatatagatatatctatatatttatatatagatatatctatattttatatatatatttatagatatatctatatttatatatatatttatatatagatatatctatatatatctatatttatatctatatttatataatgaatacatataatatattctataatatataatatataatataacatagaatatagaatatattatacaattatataattgtataatatatatacacttatatatgtatctgttttataatagatatatctgtatttatattatagaatatatataatatagaatatatataatatattctatattatataatatagaatatatataatatattctatattatataatatagaatatatataatatattctataatatataatatagaatatattatacattatatattatacaattaatatataattacatatataacattatatatttatataatatatatttctatatctaaatatctaaatatattatatatatatttatacgtatatacctagaactatctttgtgcatttttgaagattttccctgggagcttattggaatataaatgtctttcaaatcctgtgggtcttagactatcttgttccctaagtgacctgtggtgcatacaaatttctaatgggaaccaacttggccaagatggtgctttgtgaatctcattcacagaaactgcctcttttttaactttacctcagtgagttctagcattttgcattttaaaggaaggatatgtggagttgtcaccagctctgtatgaccttaaccttgagaaagagggaactgccaaggaaagggaggagcagataagctttcatgtttacagagtcaggtagaatgtgtatggcgagatgaaactgaccttcacgccttagctgggatatttataatcccgacagggcgtgccaggtgaggggagggtacgtttccatttcctctgagccaccccgtttaaacagtgcacatctgaatgtttggaagcttccttgggttgcatgtcacaaaaattcatcttttgtctttttcttcttttgacaaagaatttgtcttgtagacatattgtgttaaatcccttgcatttctgttttcacaggaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcctgtttggctcacactgactgctctgttctagtggtgtctcacctccagcagatgaaaagtgaaagcaaactggttctcaatcaagtcaatgatttgttcctaatcaaagacatgtttgctcattggttccccggtgccatttgacccagaccagcctgcccagcttccataagtgaaatattttcattttcttttccctgctacttcccagttataagctggcatggccaatactggaacatcttttgtaacaatgactgatagcactctcagtcattgtgggtgttgcctgaaagtgcccagatttcttatctgtggagtctcaagtgtacctgtcctatgtagatgtgaggaaacagacatcttaaatagtggcagggccttggggagggaggcagacctagaactgagcgcctgaacctcttgactctcgcaaagcagtgctcaccaaggagactgctagctcgccttctgcaagctgcttactcctgtaatcatctattcaagagacgattgtctgaaaagaactctaaggatctcttttttttttttttttttgagacggaatcttgttctgttgcccaggctggagtgcagtggcgtgatctcggctcactgcaagctccgcctcccgggttcacgccattctcctgccttagcctcccgagtagctggaaccacaggcgcccaccaccatgcccggctaattttttgtatttttagtagagatggggtttcaccgtgttagccaggatggtctcgatctcctgacctcgtgatctgcccgccttggcctcccaaagcgctgggattacaggcatgagccaccgcgcccggccaggatctcttatctcacagacggataagagatccatcttttttttttttttgagatggagttttttttttttttttttttttttgagatggagtttcactctgccactgaggctggagtgaagtggcgcaatctcagctcactgcaacgtctgcctcccgggtacaagcagttctcctgcctcagccttccgagtagctgggaatacaggtggccgccaccacgcccagctaactttttgtgtttttaatagagacagggtttcactgtgttgaccaggctggtctcgaactcctgacctcaggtgatcctctggtctcagcctcccaaagcgctgggattacaggcgtgagccactgcgcccagctatctcatagatttgtaaaaccttctttgtataacttgatgaatgtgcatatagaatgacttacaaaacgtgaaaaaaattgtcttccgttatgtttctaagcccttgtataaggaagaaagtaagtattagataatattctttcgtcaaacacagtaattggcataaacgaaagtaattcccttttttggttaacaattcttcacgtttcccccaaattgcttttgtcatatttaaagacgttcctggaagtagtgggaaataaaaaagccctggttgaaatatcaaagccacttcctcatcattcatatccagatgcaaagaccgcttcctcttttaagccacatggctatttttaaaataacagctctgtaccatttgtgagtatcgtaattagtttgagattgatttccaggtttggagttgaagcttcagagtcctggaaaccgggatttaatcctggctgtttattagctatgcgaacctgagtcggtgactgaaagagtagctgccgttagcatcatcatagtcatccctcatgttttgtaacagtgatcatgattctgtttgtcactgatatgtctcttgatttagtcagattttgaaatcgagaaaaatacttgacatatcaacagagcctccatttctctgctctcattatttgaaaccacaagtgaaaaaggttttctccccttgacttaagctgtgatggtctctgttaacttggagaaaggccagtggtctgtacaatgtgcctttatcttttgtctgactgcagtcccctttgagactagatctctggaaagcttggcaccttcagccacggctgcctctgctgaactgttccgtgagttttgtggtgtggtgtgaggtacacagtgactgtttggaggacgtgggtgtgtgcattgtaagctggcctctccagagcctcactgagtctccacaccttccctaggaagcatggaggagcttggcactgggggtcccaggaccagctgtgcttgttcactagttgagaattagttggagaatgttctggaaagcagttcctttaagctggtcccagttatattgggttactctcttcttagtctttggaatttttctgatgaaaaccttttaacctttatactgaacagggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaaggtatgaaataggttaacttgaaatatgtgtttttttaaaacagctttcctgagatataattaagataccatacagttcacccatttaaagtatacatttcagtgttttttagaatattccaggattgtgcaaccactgttactacaatataattttagaacattttttcccccaaacagcactcactgtctgctcctccaagcaatgtgctttctgtctctatagatttggccattctagacatttcatataaatggaattatacagtctgtggttttttgtgactggcttctttcacgtagcataatgtttttgaggttcatctacaacgtagcatgtatcagtacttccttttccttgctgaataaccttccattgtctatatatacaacattttgtttattcattcatcagttgataaacattagagttgttgccactttttacctattaggaataatgctgctatgaacagtgtgtacaagtttttactgggatatgtgtttttaattctctggggtatatcgttatgggtggaattgctgggtcatacggtatcgctatttcatattctaaggaaccagcaaatcattttccaaagcagctgcgccattttgcattcccaccagcagtgcatgagcattccactttctccacgtccataccaacacttgtttcttactgttttcactttgacttcagccatcctagtggatgtgaattggtatctcatagttctgatttgtatttccctagtgacagcgatgttgagcatcttttcatgttgaccgtttgtttgatttggagaaaagtctattcagagcctttgcccatttttaaaaattgggttatttgtctttttatgttgaattataagagttcattttacattctggatacaagacccttattaaatatatgatctgcaactattttctttctttttttttttttttttttgagacggagtctcgttctgtcacccaggctggagtgcagtggcgcaatctcggctcactgcaagctccgcctcccgggttcacgccattctcctgcctcagtctcccgagtagccgggactacaggcgcccgccaccacgcccggctaattttttttttttgtatttttagtagagacggggtttcaccatgttagccaggatggtctcgatctcctgacctcgtgatctgcccgcctcagcctcccaaagcgctgggattacaggcgtgagccaccgcgcccggctgatctgcaactattttctcccattctgtggatcgtcttttcccttgatggtatcatttgcagcacatttgtttttattttgatgtaatacagtttatctcctttttcttttgtcacctgtgcttttgatgtcccatctgagaaaccgttgcctaacccaaggtcacaaagatttactcctatgtttttctcctaagaattttgtagttttggcctggcgcggtggccaaaattacagttggccaccgcactccagcctgggtgacagagtgagactctgtctcaaaaaaaaaaaaaaaagaattttgtagtttcatctctgacatttaagcctgtggtccattttgagtttgtttctgtgtatgttgtgatataggagttcaacttcattagactctcagttctgtttcattgatctatgtttgtccttacgccagtaccacaatgtcttgagtactatagctttgtagtaagttttgaaatcaggaagtgtattagcccgttttcatacttatatgaagaaccgcctgagactgggtaatttataaaagaaagaggtttaactgactcacagttcagcatggctagggaggccttgggaaacctaacaaatcctggcggaaagcgaaggggaagcaaggcaccttcttcacaaggtggcagaaaggagaaggaacgcaggaggcactaccacacacttagaaaaccatcagatctcatgagaactcactcactatcacgagaacagcatggaggaaactgcccccgtgattcaattacctccacctggtctctcccttgacacatggggattatggggattacaattcaagatgagatctgggtggggacaacaaagcctaaccatatgaggaaggagttaactgtgagccagctcctgctgtggctaagggaagggaatcagaaggtggagagacttgaaattgcactcgagagatagtgccttccaactttgttcttctttttaaagactgttggctcttctgggttctttgctgttgcgtaagaattttaggatcagcttgttaatttgtgaaaaaagccagctgggatcttactagggattgcattgtatccccaaatgatttggggagaattgctatctccaggattgtgtcatcgcagagatagtcttgctgcttcttttccagtctgaatgccttttatttctttttcttgcctgattatcctgtaaaaaaaaaaaaaaaaaaaaaaaaaaagtgttacatagaaatggagagagcaggcatccttgtcttgttcctaatcttagggggaaagctaaggccccacctttgtcatcacttcagaggttcctggtgtcactcatgcttgagtgtcctggagttcccacagtgtgaatctggttgcttcttggctgtccctactgttggctcaaaggtcggccttcttgggctggtaaggccccactcagacctgtactgccaaattttcctactattatttcctctccctttttctttgttcctgtaggcacatggctttttgaaggtccttttagtagagtttgggctgggaaaaaaattgcatgcatctgttcaacccattatctttaaccacagtctcttgtttcatttggattgggacggctttcctgtggttatgatttggtgttaagaatggtgttactttttttgttgtcgtttattcggtgacttttaaacttagctgtgtcctaaaaggaaaagtctttccttctctaatgaattcttatgaatgagataccatgttcatggaacacacatgcatccacatgtgtaaacacaaacaatttcaaaaacattgctgcataggacagttgcatggaaacaaatggtgttcaagatgagtttcacttgccttttacctctgtgtgtatttgtctgtgaatcaattctagccaattttaggatgaaaaataaaactaatgctaatatagtgaatgtgtagagattttgaaaacccctgatcctttatcccaattgtaaacaatgttctttttagtacttctgtaataattgctatttctcttaaagccaaagagaaagtaacttttctatcttctgtgattttccagagtttcagattttgaaaagaaaacaagtaatcgttctgagattgaaacccagacagaggggagcacagagaaagagaatgatgaagagaaaggcccggagactgtgagtcctaagattccacggccactaccacacccacacacacgagagtagtccagccactgaattcaaatcttgtgatgggttatttgctttagaaatatagaaatcatgttgatattgaatattatctatctattccttttatatgtccttgtcctgctctgtgtcaattgtagcgagatgtatttcttttttgttgttgttgttggagatggagtctcactctgtcgccaggctggagtgcagtggcacgatctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactaatggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagcaaagctgagctaatgaagaagagacttcaagaaaagtaagaatgagagagcaattttatcctcctttgaaatatacatttttacaaagtatactactatataaaaacatagttttttaactatgttatgactaaaagaaaaatagacacctaattaaaatataaattcagaatatactaatgttccagttaatgtgtgagcatgaaatacttgtaagatggggggttggggactggagaactttaattctgccatttaggggcatttgttaaatgtacgagcctgggtaagatctctacagtaaagctgtgagctagttttcctgttactgacttaagctgatgacattgatgtgagtaagcataaagaaagatgaaaagagcataaagatcttgagtgacatttatttggaaaaaggtcaatttcaatttgttatttcaatcagttaattatttcaggctaacatgtagattgagcgtttggcatttgcttgtttctcttgatgtaagaagttacccaaaacttagcaaacctaagttgatgctgttctattggattcattggcaaacatgtttctagcacaatacggaggtgtgtgtgttttcttgaggttataattcccaacactctgtagaattatggtaacgtgatacaacatggcagctacaactaaggactttggacaaacagacctagatttaacatatgagtctgcaacttatttgtgttgggcaaggtatttatttcaattctctgagcctgtcttggcatttgtaaattgtgtgttgtaatttcttctatatacattgtgttaaatgatatgtctaatgggctgggcattaatgctttgtgcatagctgtcatttatttgtattatattgaaatcctctttccgatctttaagaagacttaggggaacttcctttttcccttattgaatctttgtcagaaactaaagtctttgcaattgacagaacctataactttttttttaatataaaagatatccacacatcactacatgagaagcgccttagctaattactactgtggtctgtgtttaaatactaaaaatgtatctgtatgactagtttaaacaattattcaaagaggacagtactgcatgtgagcttagatctgtacttttttatgtttaggcgtaagggttcagaaatatggccaggtctagtgaagaagcaaggaggattatgtatttcattttgcattcataaaccctacagccctaaaattcttatattgtacataaccttggggtttgtttaaaagccactgcgacgtaaaggagcattgtttatcctcatgaaatcttgacctttcttaggtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtgagtatgttgagtcagaagggcagcgacggggcagaggagggagaatcgcctttttatacagattggaattcggatttgagaataaattttaaaaaatttctttttcacttatctgaaggagtcctagcagacctctcagagagggggataaaatttaaaagttttgtcataataaaattatgctgattgtttgcactctgtcttgatttttcagaaaagattttttttgagagtaagaaatgctagtaggtcgtggggtgataaaggtaggcgagaagatttttctactggagtgttcagaaggttgggaggcaagactataagtttctatgatattttccccaggattccattttttaatatcttttttaataggtccaaattaactgtgctacagatgacacacaacaagcttcttcaagaacataataatgcattgaaaacaattgaggaactaacaagaaaagaggtattcactgaaaaaaattacttccatagcctagtaatgaacagaaactgttgaacgttttgtatataaaatagttacatgaatccttcactaaatctggtttcaaaggttgttttccaatgtatcattatttcttgcatctagggtttgtaacttctgatgttccacatatgtgtaatgtgctttattgcgtacaaagatgatgtgaatgtcctatggtcagggattaagcacttcgtatttctttttttttttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagcacttcgtatttctaaggataggtttgtaggagagctaagagcatgggcttctatgggtaggaagggccatctgctctggggaattgtgcaagaccagcgtgcctgctgtcagtgaatttgggaccctggaatcatcagcctgcagtttaaattcataataatggaccaggtgtggtagctcatgcatgtaatcccagcactttgggaggccaaggctggaggatcatttgaacccaggagtctgagaccagcctgggcaacagggaggccctatctctacaaaaaataaagagttaaccaagtgtgatgttcgtgcctgcggtcccagctccttgggaggctgaggcaggaggatcacttgagcctaggaggtcaaggctgcagtgagctgtgatcacgccactgtactccagcctgtgacagagtgagaacctgtctctaaaaaaagaaaacaataaataaattagtaataatgccagcatggtgtgatagtttagagaccacagaagcttgtgaattagaagggatctttgaatttttagccttgtaaatatactctttgtttttcatttattttcttttaaagaggaggttttgccatgttgcccagaatggttttgaactcctgagcttaggcaatccacgtgcctcagcctcccaaagtgctgggattacaggtgtgagccatcatgcccagcagtagtgttcctctcttggacctaataattttaaatttaaaacatgtttcttcttttccactgactgcaggaagtaacaagtggcaaaataacagtatcaacgagtcacagccttattaacattggagtttgttattgtatccctgatttcggtgttatcaccttttttttaggaattcattatttgcaagccacaacttaaatacaactttctgaataagttagcgttgctgattaatagactggttagagctgatacattttttagatctcgctatgttgcccaggcttgtctcccactcctgggctcaaacgatcctcccacctcagcctctcaattctaggcatgagccaccacacccggccagagctgataattaaaaaaataaacctttttctaatattttactaaaacaggcagaattatttcaaaaccatttctagaataaatgtttctttttcagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcaggtgaggcaccttccaaaaccccagctgagcgaggccagccctgactgtattctcgcattggaaagcaatggtgtttagaatgtttgtaattttctattttatatattttttcacccgtgagtgtattaaaactttaaaattgaaacatttggaaagtgctcagtggatcttatctgttctacatttaataggtaattggattctttccagtttgtggcattatgattaacgttgctaagacattcctgtgcatgttgctctgttcacatgtggatattttatatttctgttgggtacacacctaggagtggagtcgctggatcataggctctgcatgttactcacttttaacaggtaatgccaaacagttttccagagtggttggaccagttttcactcccatcaacagagagtttccatggctctacatcttaccaacacttctattatcagtcattttcctttaaccactctggagggtatatagtggtatctcatttaatttgcatttccctgatcactaatgggaaagagtactttttcaagtgtttttggcctttgaggtatcctcttttgtgaagtgccttatcaagcctgccttttttttttttttttttttttttttttttttggtttggtttgcctggcattttttttgagacagagtcttgctctgtcgcccaggctggagtacagtggtatgatctcggctcattgcaacctctgcctcctgggttcaggtgattctcctgcctcagcctcccatgtagctgggactacaggcatgtgccaacatgcctggctaatttttgtatttttagtagagatggggtttcatcatgttggccaggctggtctcaaactcctgacctcaggtgatccacccacttccacctcccagagtgctgggattacaggcatgagccactgcgcctggcctggctttttaaaaaaatgtaatgacttctatgtatactgcacatacaagtctttgtcagttatttttgccttttcactctcataaaggtgtcatttgaggaacaaaagttcttagttttaaggtagtccagtatatcagccttctcatttatgattagtactttttgtgtcctgtttaagaaacttttactaccccaaggccaggaagatattccctctgttgtcttctaaaaattttgttgtcttaccttttacattaagatgtacaaaccatttgaaattggcttttgtctatagaaaatgaggtaagggtaaatatttatttttttcctatatgaatatccagttaacttggcaccatttaagccatcttttcttaagtgctctgctgccctcttcatcataacttgtgtccatatatgcatgggtctgtttctggattttgttctattttattggtctactcatatatctttgctctggtaccatgctgtcttattataaagcatcaaactttttttttttttttgagacagagtctagctctgtcaccaggctggagtgcagtggcacgatcttggctcactgcaacctccacctcccgggttcaagccattctcctgcctcagcctcccaagtagctgggactacaggcgcacaccaccacgctcagctaatttttgtatttttagtagagatggagtttcaccacgttagccatggtggtctcgaacagttgacctcatgatctgcccagctgggattacgggcgtgagccaccgtgcctggccagcatccatttgaatggttggatcatgagttatgtccatttctcagttaaataaatattaccaagctgtcttctaaaactgcctaaccaaaattatactctcaccaaaagataagcactcctatgtcctcacattcttgcattattttaaaaaccttggccaatctgatgaacatattatttttaatataataatgtcagcagtttgttattccctacatacagactcattatcaccagctgcccagagtggctgacccctgtgaaatgcagccagttgactggtacttatagctttagttttatttctacaggaatagagcctcaacctgcattctcagctcttcagagcatttccttgcttgggtaactcatgtcattgggttcttccactctgctgcagtcatgtatttttgctcattctagacatagacatttgttttctcttgatggatactcttgctcattcattcaataacttcttttttgagcacttataatatgtcagagacggccgggcatggtggctcacacctgtaatcccagcactttgggaggccgaggcaggcagattacaaggtcaggagttcgagaccaacctggccaatatggtgaaaccccgtctctactaaaaatacaaaaattagccgagcgtgttggcgggcacctgtagtcccagctactcgggaggctgaggcaggagaattgcttgaacctgggaggcagaggttgcagtgagccgagatcatgccactgcactccagcctgggcgacagagcgagactctatctcaaaaaaaaaaaaaaaaaaaaaaaaaaaaatcagacactgttcttactgcctgggatataggaatagacaaaacaaagactctgttcttactggctcaaagctagtaagtgatagaagtgagactaaatcgaatttaagtcatactccaaaacacccatgatccactgccaacactgtgagatgctgaaccactcacattgataggatatcccttaaaatgatctctttattacatacttttaagtaactatagttttgatagaatatttagatttttaattttacttttaaaataatggataataatttatatctcagaaccagcaaatttgaaaagaaaaaactaattttaaacatagaaagtgaaaaattagtattaaattccaataccaatggaacagttcactcaattagctgacagcattaaatattaaaacactattaagtgttttgttatttataattttttaaaaattacttaatttttaaaatgttgtgttgttttgttttttgaggcagggtcacactcctgtcacccaggctggagtgcagtcgcatgatcgtggttcactgcaacctctatttcctgggctcaggtgatcctcgtgcctcagcctcccaagtagctggaactacaagtgcatgccatcatgcccagctgattttttgtatttttagtagcgatgaggttttgccatgttgcccaggctgtcagcaggaggcctcagttcctcaccatgtggtctcctccagagggatgcttgggtgccctcatgtcatggcagctggcttcccccaaagcaagtgatccaacagagagcaaggagtgacagcgtcttttgtgacctagtctcagaagccgtacaccatcacttctgcggcatcctggaggttacacaggttgggtttattcattgtgggagggaaacatacaaggtgatgaataccaagaggcaaggatcactggagccatcttaggaggctggtgaccacacatgggacatggattgaatatggaaaagttcatgggaaatggtcttctgtctggttcaaatgctgatttggccacttaacaaattttcccaagattaagagccgttaagtttgtaaaatgaggatagccattctttattctcaggatatttcataaggtaaaataagatagtaaatgtaaagcacccaacataggacctcacacatgtttggaatttaacaaatagcatctatttgtgatgattattcttttaaatttagcttaagaccagccttcataaatacacctggcagaatcaatttactatattaagtaatcatttactatattaagttgatcctgaattgtttattatctaaaagtccagataattttgctgaattaatggtacctacagtatttaaactacctatatcagtgcagttgcaggatttgtgttgtttaaagcacacacacaaacacagcttgtatctgctatcggaatgtacctggaaagtcatggtcattatactgttttctagcaggattgtgcatctgtgattcacaagggctattgaaggatacagcactacctcctcatcgcataaacactgtaagaatctgcattcatctaggtactaacttctgtatctttttttcctctaacagatggaagtttactgttctgattttcatgctgaaagagcagcgagagagaaaattcatgaggaaaaggagcaactggcattgcagctggcagttctgctgaaagagaatgatgctttcgaagacggaggcaggtaaggaaaagagagaggaggacccagagctcacatcagcatggccgtagaagaggtgcctgtccaaagacgttcctgatttgaactataagaatagctgtgttcgcgccactgcactcctgcctaggtgacagagcgagtcccctgtctgaaaaataaataataataataataattgcttcacttacacttcatgtgatcatgttcccaacacttagtttgtcttacaggaaagcttgacagagacttgtgggagcttgatcaagctccttgcttttagataagcaaggattttgatttgattttaaaatgttgtgttgttttgttttgttttttgaggcagggtctcactcctgtcacccaggctggagtgcagtggcatgatcatggttcactgcagcctcaacttcctgagctcaggtgatcctcgtgcctcagcctcccgagtagctggaactacaagtgcatgccaccatgcacttgtaacaataatgttacgtgtcccaatgacctatcttgccatcgtcacggatgaaatattcgtagcactttaaattcctgaatattctttaaaaaatactaacaaaaattacttctgacttttagaaatttattttgagaaagttttaaaacacagcaaaattcagagaataaaataacagactctactatgtactccttcctgcattgacaactgcttttatttgcttcaagtattttttttttattaaaggaaaaagggagttgtagttagaatcaaagtctcctttgttccccatccatcattatattcctttcttctttaccttgtgctgttaggaatttggtgggtagcttccccatctattttatacttttacatatcacatacacacttacctatatcatatctcaaaaccagataatattgatttctctgtgtttaagttacaaaatgatcactgtaggtattgttctgcagcttactttacataatattatgattttgagctctcttgatatgtgcggatgtaatttattatacttcattgctgtattttgatttataaatatgccacttctttctaatctgtttcctactgatgacagtttggttatttcctgattttttttaactgtaattatttactttcactagtctcctagtgccaatagtatttaaaactaaaattagtctggtttttatgaaccttggcagtgtagtttgagtcttttttcccctacttctgtggactgtctgctcagtgttgtcatgtttcggggttgtagaacatcacacagcgtgttgcttttcgtcctggcaggcagtccttgatggagatgcagagtcgtcatggggcgagaacaagtgactctgaccagcaggcttaccttgttcaaagaggtgagtcccgtgtgatcctggattttcaggaaatagctatcctatgaaaaagatgcttgaagaaaaattccacttcattctctacaatggattccaaatcaaggcaccaaaaatatagcacccgtcagtctcattaccacagcactcccatctccatccattacccaccgaatccagaccagacccttcaccctgccagaaggtgcctggcacggccacactttttcttttttttctttttttttgagacagaatttcgctgtgtcgtccaggctggagtgcagtggcgagatctcggctcactgcaacctccacttcctgtgttcaaacggttctccttccacagcctcccgagtggctggaattacaggcgtgcaccgccacacccagctaatttttgtatttttaatagagatggggtttcaccgtgttggccaggctggtctcgaactcctgacctcaactaacctgcctgtctcggtctcccaaagtaccgggattacaggcgcaagccactgtacccggcctacagccacacttttaaaccgtgtctccctctgttctcttacagacattagccagactgaatcatccccttgaacttgtcctaagcttgtatttgcttgtattatgcccttcacagagacgcccttttcttatgcatattcctgtcttcctccagtctctttccagtgacctcttaccccatctttaaaatctatttcaaactccatctccatgaactgtttccattttgaacttccaaagtactttattcctctatgttggtacctgtctgctattttataggtgtttgtgtgttctaggtagatacttaagtactttatttttatttctatttttattttgagacagggtcccactctcttgcccaggctggagtgcagtggcatgatcgtggatcactgcaacctccgcctcccgggttcaagcgattctcctggctcagcctcccaagtagctaggactacaggtgcacgccaccacgcctggctaatttattttagtagagacagggtttcaccatgttggccaggctggtctcaaattcctgaccccaggagatctgcccacgtcggcctcccaaagtgctgggattacaggcgtgagccaccacgcccggctaatttgtattttcagtagagacagcgtttcaccatgttggccaggctggtctcaaactcctgacctcaggtgacccacccacccaggagaggtctcctagaacagaatgtaccttctcagaagcagaggcaatggtctcatttattcagcagatacttttgagtcctccaggatgtgcaagaggtactgcttatgctgggagtcagagagcaaaggcagccccggatgctgacccctcttctctggcaatggggtgattagaaagctccctgctttggaaaccatgctttatgatcaatacatacctcttcagaaatgcttcttaaggctgctgaacacaatctcaaatattcatacatgttactacatccaagtaatgtacttagaagcaaataaaggttgcctccaaaaacaaacattttgagagccaaaccaaagtctaggctgagtccaaaaaaccaagacggtttgcattggtccagaaaggtcagaacagagagatgcccgggagccagaaataatttcttgcatccatcacagtttgtatggatccaggacctagctagggtcagggcttatttcgaacatgctctgattgaggcttgaacctcagtactactccaaaactgggggaaatgatagggtgcattcttccatcattcctccttgttaactttatgtagataactcctgttcattctcaaggcccctctcaagttaattggtcgcatctaggaggcctttctgcaccaagatctaaactaggggcccttccctttctcccatggacacccttgcacctaacactcacctggcctaacactcgtgcctaacacttttgccacgccactgctgccacatctctcacctggcttctccaccacgtctgtctcccggcacacagcagtgtctttatacatcccagaggattcaaaagtgtctgctgaacaaatgagatgattgcctctgcttctgggaaggtacactctgttctaggagacctctcctgggctctgtggatttctttctccacattcccttcctcttttgcttatatcctcattcatcccttttcttctcgcagatatcctagtatttactagaacatgcattgtcctgtacctagaactgaaaccatgtattttcgcataccttgaaactgggatacagtttaaatcctaaaagaatgcaccaatgcacctgtaatcccagtacatgggaggctgagatggaaggatcagttgagaccaggagttcagaaccagcctgggcaacatagtgagatcccatccctacaaaaattttaaaaactagccaggtgtggtggcacgtgcctgtagtcgcagctattcaggaggccgaggcaggagggtcactggatcccaggagttagaggctgcagtgagctatgattgtgccactgcactctagcctgggagaaagagcgagactccatctgtcaagaaaaaaaagtaaagaaaagaaaaaaatcctaaaacaggccaggcgcagtggctcatgccagtaatcctagcactttgggaggccaaggtgggcagatcatgaggtcaggagttcgagaccagtctggccaacatggcaaaaccacatctctactaaaaatacaaaaattagctgggcgtggtggcgcgcacctgtgatcccagctactcaggaggccaaagcaggaggatcacttgaacctgggaggcggaggttgcagtgagccaagatcgtgccactgccctccagcctgggtgacagcgagactccgtctcaaaaaaaaaaaaaaaaaaaaaaaatcctaaaataatagggaagcaggtatcacttggagagatttttctctatgtgcatcgtgatgacttcagttaaagaccaaacacctgtgctcatgtcccactacgtgttgaatacgaagttgaactgatgttaaaactcgccatctgttcttcaagtgaaacaaacacaactgcctgcaaaatggaactaatggaattatcatacttattcccaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcattt

SEQ ID NO: 34798 - DNA, 14136 bp, Homo sapiens
agagacagctgggccactggcagtgagggagagtgaggatggcagagaccagtgccctgcccactggcttcggggagctcgaggtgctggctgtggggatggtgctactggtggaaggtgagccaggcagaacctggggtgcagcgggggcccagtgggttctgaggacccaggccaccagtgtggagctggcaaggagaggagaggtccccaaacccagctgggtgtccggtcccattggctgccttcccctctgtgcccggactcggggggtgttctgacaattgaacctgtgaggtgcagcacactgcccgctgggagcagagaggaagccaggcaagggtcagggagggagggactttgaaaggggacatctgcccaggagatgatcaagagccaggctttaggacttttcatgtccctccagccgggagaaaatttaatccactccttggaaatcctgctgagaatcccacataagatcagtcccccaaaaggctctggggacagacagctctgcctcctgctcttgtgtggctggaaccaagtcccttcagctctctgccctcaatgccttgacattccgaatgggtggttgtaaagattaaatgggataatgggtataaagtgctagcctaaatagactctagggtatttaagttcattcactcccatcctctccagccccaccactattttcactgtgtctactcctatgagcccaagcacttcacctctggaggcaacctgggtctgcgaggtacctacctcaacctagaatccctaagatgctcgctgaggccagagctagagacagtgtcaatcctgaatctgggccagcccaagctaaattgatggagaacgcagctttggttcaaagcagacccagagaaatcatcagcacgttttctcacctaatgagaactgacaatggagaggaagtgacagtcattagattggtcctgaaggctctggacacgactgtctggtggccccagcccgtgtctccctttcctgagaaccctacaatctagcatccttccaggtcctcaaacatgccataaaattttaccactttattttttggaaggggtttaaatttacatttttatttcatgtttaatgactagaaatgtcattatatacacaatgctttggtttttattttatttaaaatatgttttaaatttcaatagctttggggatacaagtgatttttgtttacatagatgaattacatcgtggcaaatgctaggactttagtgcactcatcacccaagtagcgtacattgtgcctcatttgtaggtttttttaatcccactccctctcccacccttccccttctgagtctccagagtccattgtgtcctctgaatgcctttgcgtactcacggtttagctcccacttgtaactgagaacaaacagcatttggttttccattcctgagttacttcacttacaataatggcctccagctccatccaaattgctgtaataagacattatttcattcctttttacagctattattccatgatgtatatatactacattttctttatccattcattggtcagtgggcacttacattgatttcgtatctttgcaattgtgaattgtgcctcggtaagcatagatgtgcatgtgtgtttttggctggattaaatggcagatctacttttagttatttaaggaatctctatactgttttccatagaggttgtattaatttacatattcccaccagcagtgcataagcattccctttttaccacatccatggcattgatctattgttttttgactttttaatgatggtcattcttataggagtaaggtggtatctcattgtaccatagcatgtctttgcacatgctattccctcctggaatgctcttccatgcactgtcctgcaggtaagtgcttctcatagttttgaaggcaggattttttcctgttcctcactttagataggggaagctgaggttcagagagcttaaggagcagcaagcgaggcaaccaagccaaaattcaaggtcgggtctctctgttgccagagtacgcccccttcatgttcacttccatgcctggcgtcctgggcagctcccagctctaacatcgactcttctccttggagcctctctgactttgctctacagtccttggagaaggcattttgaaatccaaaaggcctgaattcaagttccagctccaccgcttactagctgtgtacttagggcaagttagctagtgtctctgagcctcagtttcccagctataaatggagaagagagtatccaagtaaagattgaatgagatgactcatataaagtgcttatcctggtgcctggtgtgtgctaagtgcctggcagctgtcagtgattatgactgttatagcatgaagcatgctaccctatattgattgtcttccttgtctgtccaggaggttgctgatgttccatccaccccacacacactgttctgaccccagctgggcctcagcagccccaatgccagcccccacccttcctttcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggtaccagccccctccccagtccacaggctctggggtcctgcctggggcctgacccctgggccctgggcagccaggccaagggcatttttactacttacagaaaattggccaagggcagagggtgggcaggctaaaatgggctgaattccagattgattctgaagaacgacagctgatttctggaagacaggggttgctgaaacctgatgaaagagatggtaggctgtagagatcaatggtgtgggttctgtaaccaagcaacctaggtttgcattctggcttcagcatttctagttctgggcttcttccataaatcggatattatttcctaactcatataggtggttggaagtatttacttctattatgtgtaaataacttaaaataatgcttgatacctaggactctacgtaagtgtttgtgaacacaaatgggggcgttatcaccactactgcacccgtatgtatctgggctcctggagtggagggacaccgatgcagtgtggagaggataagaggcagggaggggcagtcataactagctagtgtctaatacctccttatacaaaaaccagggtcttccatcacagcttcagaaggtgtttataaaattgttttctgaagcagactggacattctcattctggttttggacactacagacggaggctggagcccccccggatgtgcatgctcagtgctgaccagcctggggggtctgcatcagtgagaactcttcctcccacagagaattgaagtttccacctttgcttgcccttttaggctggggaggcctgggatctcccctctgactttgccttcatcttctgtgtgaccttggcttcagtatctttgcctctttgaatgtcagtttccccacctatcaaatacaggcatgagctctcctgtgacagagggatctgatcacgcagagagagcctatggcccaaccatggtgcagtcaaagtcacccagcctggagagtgtgcattgggctccaccccttcagcccagttacttgagctccaacgcctcataggaaagacaccaatattaaggccctcttcagagaagaagggcagcattcaggaacacacactccaagctgtacttggcaggtgtgggaggtggaaaggatcggaggagaggtcactggtgcccagtgtctcccacaggcgctggccctacggctcggacggctgccaggctcacggcttccagggctttgtgacagcgttggccagcatctgcagcagtgcagccatcgcatgggggcgttatcaccactactgcacccgtatgtatctgggctcctggagtggagggacaccgatgcagtgtggagaggataagaggcagggaggggcagtcataactagctactgctccgtgtttcccagtacagggaagtgtgggtaggtgtgagtgtgcatgcataggcactcatttcaggaaaggagggagggtgggagagtgtgcaggagagctgttgggcctctcttgccattaccgcaaccttgggcaagtcagggatcctctctgaaccttagtctcctcctctgcgaaatgattttctttttctttttgagacggaatcgctctattgcccaggctggagtgcagtggtgtgacctcggctcactgcaacctcggccttctggtttcaagtgattcttttgcctcagcctcctgagtagctgggactacaggcatgtgccaccacacctggctaatttttgtatttttagtagagatggggtttcaccatattggctaggctggtcttgaactcctgacctcgtgatctacccacctcagcctcccaaagtgctgggattacaggcgtgagccaccgtacccggctgagatgattttaataaccaatctcagttttattttgaaaatgaaatgagatcagggatacagaaaatgcccttgcagacaggcactactctgcagacaggcgcagagaggctgtgtgtatgtgtgtgtagctgggcatgtgccctggcaccccacacttccatgaggcttcatgaaaactgtccagctctagatttcacaagctgcactgtcaaataccatcttcataattggccatatcagtgtacaaactgctccatttttccttaattttttttttcttaaaagtgactcattttttaaaatgtaaacacctgctacaagctcattctaaacaacatctgggaaatcacaggtttaatgttcttataattttaatacaattaaaataaaaacctgttcaccagagaccatctagaaccctgtttaccaccaggggtacataaacatgttttggggagctgtggctcagctaaccctcctagcaaaccttcagctcacagcctcggaagcagaggcacagagaagttaagcagcttgcctcgctactaagggcagagccagcactgggcatgacctggtacctccaagtcctgagctatgaatttgtccagcacagaggctgctgtgaggtctatagccagcacagcctcaaaccatggcatgtcctctttggaatccacagaacttcccttgccatagtcacatgtatagcccccttccctgaaaattcactgcccctcatgggtctctcctgtcatatgcctctctccaggccaaaatgctgccatcggtctcatcattttgagtggcgataggttagccctcttgtccacttggcctcagagcacttctcccactccttacatcccagcccctgcccctaatgctcccttggaccatcttatacacacacacacacacacacacacacacacacacacaccaccttctcagatagcaacaggcttctctgcctcaatatagaacagttaatccctgtgccagaggccttagatcaaagccctttctatactgagagcatggcagagcagtgtgaaggcaggcaaaggggaatgaggaggtctgaattcatctactccatccctgggtggttgtaggcatgtcaccttggccatctgtttctaaagctgaaagtctgaggcagcacaatggtccaggtagatattaattattgtgcccacagagaattgtttgaacctggaaggcagaggttgcagtgagctgagatggcaccactgcactccagcctgggcaacagaatgagactccgcctcaataaaaaaaaaaaaaaaaagaagaagaagaagaagaaaagaaaaggccaggcatggtggcttatgcctgtaatcccaacactttgggaggctgaggtgggcagataacttgaggtcaggagttcgagaccagcctggccaacatggtgaaaccccatctctactaaaaatacaagaattagctgggcatggtggcatgagcttgtaatcccagctacttgagaggctgaggaaggagaatcgcttgaacctgggaggtggaagttgcagtgagccgagatcacgccactgcactccagcctgggtgacacagcaagactctgtctcaaaaatttttttaaaaaaagacaggaagaactgacatcttaactatattgagtcttcctgtccttgcacgtaattatcgtgcccacagttgggatgggaggtgtcttagtctgcccaggctcctataatagaatgccatcgactcggtggcttgaacaatagaaatttatttctcagttattcaggctgggaagtccaaatgcgaggtgtcagcatggtcaggttcggtgagggcttgattcttggtttatagatgttcaccttcttgccatgtcctcacattaaaagagagagattgtcactcttgtgttccttctttcatttttttgaaacagagtctcactctattgcccaggctagaatgtagtggcaccatctcagtacactgcaacctccgccttctgggttcaagcaattctccacctcagtctcctgactagctgggactactggcgcatgcagcatgtccagctaattgtgtcccttcttataagggcactaatcacatcatgggggctccacccttatggcctagttatctcccaaaggccccacctccaaatgccatcacattggggattagggcttcaacatataaatttgaggggacacaaacattcagttcatatcagaaggtcacatccaagcaaactccatctggagccgtatcagtagaagcaaactgtcagatgagggaggttgtagacatgctcttctctcccgatcaaaacccatctggagaactgtcctctgccctggtatcttatatacaaaggagtatgacaaaaaaacagtagacagaggagggcacctgggaagtgcatcctgaagccagatccaggaggaaccactgaatgggaaggacccaatgacactgcagcagagaggggggcttcagggaagggactagaggaggtcaaatcagcatggctggttcatatcaaaagatgctgctgggacccagcctctgccattggcactgagattgagccccaacccccgagtcaagcattctcagagggtgtcctggaagcaggggcagtggcctgattctgagcaagtgctgaggatggtggtaagtccagacttctgcctccatcccctatgaccctcacctgaacccctgcctatgcttcttcctgaactttgtctctgaaaacgtatctgtctctttgccactccctcgtctctgtcctctgaagaagatggtatagtgtgtctatttggagaccttcaccatccattatctatttcattcttcataacaatcctctgaggcaaggattatcattcccattgtgggcgagaatactggggctcaaagaagctcttcacttgcctgaggctctgagttattaagcatcagagctggggttctcattttggtgagttgcttagttaacccctctctcagcctcaattttttagaccgtaacacagggataagaaaacctccttctggcaggatgtagtggctcaatcctgtaatcccagcactttgggagactgaggctggtggatcacttgaagggacactcttcgagatcaggaagtccattctttctcactctatcaggccatctcctcctcacaacctcctcttcttcctctgtcctgtgcaggtagccagctggcctggaactcagccgtctctctggtgctcttcgtgtggctgtcttctgccttctgggcagctctgccccttctgggttggggtcactacgactatgagccactggggacatgctgcaccctggactactccaagggggacaggtgaggtgggaggagcagcttcgaggctcctatccatgggaatcttggctttgaactcctatgacaagggtgccccagctgaaaatccaaatggggaaatgtcaacgtttgccagacaatctcaacttcttaatcatgatacccacctgcaggtggacagtgggactggaaaaagcctgttctgaaaactggccaggtgatgggaatgctgtgaaaattgggacccagagttgaacccaaaaagagacatcatacagggagccattggcttgtgtcagtggtaacagtcaccaagccgcaccacctcttagccatcttcagcacagtcgaccatcatggctctgacctcatcaatttctagagggagccacgcccttggtacaatagattcaaagaacattaaggtccttgcattgggagggaatgccctgagcatacgctatgaggcaatccctggagaaataggacagaatgcatgagggtccccaccctcatggggctcgtgttctggtactgccccatcaggaggctctagggagacaagggcttagggggatcctttaggaactgccttgaggaatggtcacatgggctccagcccctcttgcttccaccagagccaagttgcattcatctgctttacccatggtgtttaatcatgaggcatctgcactggatgacaggctttccaggtgatgcattcttgagaacgctgggcctggtccaagtgtccctccatggcactccccagccagggtccagtccttccagctgcccctccctggtggacggctccaaggtgacatagtcttcccttcagaaaatgggaatctgtctccctgggactcccactattcccttcacctccccatgaccactacctgggaacccaagctcttctgtggtgccttcaaccatttcttcagtgacacagtatccagtcttcttgttatcccgtctccttttaaaacctttgggcctagaatgctccttgaatgttcctttctcttggcccactgacatccccaccattgggtgaacatgtttcccaaactaaaatttcccattcttcatgcttgggggacaaacaggaaagcagggctgagcacttgaacaagaaagaggcctcttcctccttgtagctccctggctcctaaagggagttcacctgggacccgggagcaaccacactgcgagcttgtctgaatggggcatttccccacaaccgatcatctagggcagagctggtgggtccttgagggcagctggccatccctgagagctaaccccaatcctccacccgctctccctgtagaaacttcaccagcttcctcttcaccatgtccttcttcaacttcgccatgcccctcttcatcacgatcacttcctacagtctcatggagcagaaactggggaagagtggccatctccaggtaaggacccccttccggagtgttatctgatggtgcagcgcagctccaggctcttggtgtcccgaacaaagaattggatgtgacacacacaaacagcaaaacaaatattcattgcttttgcagcaaaagcttattcagcacagtattacactctcagagaggggagggtggaccaatctctgcgaagtgagatcagcaccagtttggtgtattttgggctcttttatatgtttatttttcttctcttcccaaggctgcctaatctctagccagcatctgccttttgattgataggtgggttgcttatgttactttggcccttgtgtgcttgcctgtcacctccatcccataatcttaagtacatgcatgatatgcagtccatatgcatcagctttaataagcttattatcatacggggtcattttaaggatactttttctctctaatgcacatgcgcatctctgaggagctgcccctgacaggtttggtccagacctagctggccacaggagcttcttactcactttttaatcttatttgtgttttggttgctcaacttctgtttcttgtcttgcttcttgctcactgcctcttcaccttgcttctgcttctactcattccgccctttaacctccaattccctctgctattctcctgcctcaagagcagcagtaatttctcgtttcctctcagggacaccagggaatatgaacaatgtgacagacagcaaccaggggttttctgcgttttcagtgatcaagagaaaatccagcttgtgcacagcataggatgttagaactggaaaccaccctccctttgctcagatcgccaaggcctggggagcaaggatcaggactgctcagattcacccagaccccgtaactctggggaccagggctccctactggacacatccgtgctgttccacttaactcttgccaaggatgtgaggtttggcacaaagttacaggctttttaaatgctacttttaaaccgctttgagatgtttaatttaatcacagtcacagggtggtgcccaaaagataaaaatcaacctataagcacatttgtccaagaaatacaatacttcaaaataagccctcctggccattttttagtttctgaattactattcccttgccacggttttattttaacttggtcacctggatgacctctagcaaaggagtcgtaacaagcaacaaagattagaacaaattcagatcttaatattatttctttgcaaccactctatgaggaaagaggttttctttcttttttttttttttttttttttttaggccgagtttcactcttgttgcccaggctggagcgcaatggtgtgatgtcggctcaccgcaacctccgcctctggggttcaagcgattctcctgcctcagcttcccgagtacctgggattataggcatgtgccaccacacccacctaattttgtatttttggtagagacggggtttctccatgttggccaggctggtttcgaactcctgatctcaggtgatccgcccgcctccgcctcctaaattgttgggatataggcgtgagctgccgtgtccagccttttttttttttctttgtttcttttttttttcctttctttttttttttttttttttttttttttttgagacaaggtcttactctgttgcccaggctggagtgcagtggcaatctcggctcactgcaacctccgcctctcgggttcaagcgattctcctgcctcagcgtccctagtagctgggattataggcacctgccaccacgcctggctaatttttgtatcttttgtatctgttggccaggctggtcttgaactcctgacctcaggtgatccacccacttcagcctcccaaagtgctgggattacaggtttgagctatcgtgccggccagaaggaggttttcttatccctgtgtcgcggactaaaaaattgaggctgagatgggggttaactaagcaactcaccaaaaaccacacacctggattcaaacctaggtctgggactccaccacccatgtggtcaatcacagtgcatgaaagaaactcttttttttaagtcacttcatctgccactttatttatttattgtaaattggaaaaggactgtgcaaatctattttagctggagccccgatgctcccccgaggtcagaaggagagaaagggctttcctgggaccagaatccagtcccctggctcccagctggctgctggcataggcgccgcttctaggctgtcctccgcgatgccggtcccaagccctgtctggaggtgcaaagttcacatttactggaggctcaggcagccgggagacaaggctgccaccatgatctcctcatttttctgcgttgactttaaaccattgtctctggtgggcatcgccaaggtcacacgcaggggtccagggacctcatcccaagctgagcggcttcccgagaccgcgtagcctccccaggggattccacgtcttagggcctcggctcccgggagggccccgaggtgctgagctccgttgttcgtgggtttttttttccccaaataagggacagttaagaggaaaaaaaaagtctcttggtcaacatattttaataatccaagatggaagaaaatatgccctcttccagcttaatcaccctctttgttaaagaaagtcaggtcagggagaaaacaggcaagaacttgagcgtcagaattgcacgtccgcgtgtttgtgcggggctggaacttggcagctcccgctgaaattaaagcgcgagtcttgcgccccctcatggccccaggcggcaccccagcatctcccgctctctggacaagcccctcccccgctgattgtatttcacattgggagcccagacagggtggtctcgccgggtggctgtagctgtggatgacgagttggttctaggactgaggcctgagggcagctcagcctggggccccttgagcacgcagtcacagagcccaggattcctcttaaagagcacagacgcaggccaggcacagtggctcatgcttgtaatcccagcacgttgggaggccgaggcaggagaatcccttgaacccaggagttcgagaccagcctaggaaacatagtgagaccccttctgtatttgacaaacaaagagtacagacccaggaggaagcgctcattatccacccagtctcggcctccagccacgttgggtattgtcaggccattttacagacacagcagctgaggtcaggcaagtttaaataaaaggcttaaggtcacacagtcttaaacaacagagaggcccatctggtcccaagttcccctgcagactcagccccctcctgaagcctggtccatgctgccccgccctgctgagtgctgacctggttttcttggccacatagggctgtgggccacctggagcaagctgacatctcctgtgacaatttctccccaggtaaacaccactctgccagcaaggacgctgctgctcggctggggcccctatgccatcctgtatctatacgcagtcatcgcagacgtgacttccatctcccccaaactgcagatggtacagatacttctagtacctaaaactagacccctctccatctttgttctctgtctcatctcatctcactttctggatttatgacctctgtgtcagtctcttcctttctgtgtttcttcctttggatactcacaaggcatagagcattagtttgcccccctaatcccccacctcgtctctgagtcataccaggctgctgcttgacattgcccaaacctcatgtgagatgacagggacagccagccagatggtgtagataaagactctgtgaccaggggttgagattagtccccaggctgggagcaggtgggtctggacaagagtatggctccatggactccgtgagccatgcatctccaccaactagtcagggaagcctccaaggctgcagaactaaatgattggcagttgtaggtggagggtgaccggggtcaccaggtgagaccagagagaggatcagtggctttgaagcttcttttctggacttttctgccacaacaggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcagtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatg

SEQ ID NO: 34799 - DNA, 270316 bp, Homo sapiens
ttccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgccgcctgcacgcgcacacacgcacacaccctcgggcgccttggacggggtgcgctggggagccagaagttcggagcgagcgcgggcgggcagagccgccgcctcggagcccggagccggcctgcacccccctgctttcgccgccgccccccggcgccgggtacccccgaggccggcccgggtctgcgcagacttgtgccgctggcggggggttcgctccttcttctcaaagatgaaaaagggcacggtcgtctttgccgcttctccaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtaggaaatactgggggatttgtttgttgattggaagagaaatgatccccgggggggagaaaatctgggtacacttctagtctttgttcgtaacagcaacacttgttttcaaaagtccagagtcccgctttaaagaaagtttaacttctgtgacttttcttctttttaaaaaaataacttttgtatttttaaaaaatcaaagcaatatttttaatgagtcgaaaacaatgaggactcacacctcccctctcatgaaaataaatgaaatccagatcagaattttctttgcttttaaattgccttttttaaaagatttatttaaagttggatagtgtcactatataaaaatatttatgaaacaatgaaataccagccaccagcgtttctcaggaggcttgttaacttcttagaagcaagtggcttcctgtgatttgcagaaatgaaaattgacctcagtgagccctggaaacttagagacagatgatgttccaggagcagggaatgtaaaaaggccatgtttaaaaacagtgcgttggaaggagcccaggtcttgggatagaaaggtctgttaagcctgccacatttcaaaatagtaaaaagaaatactaaaaacactacacgtattgcaaaggagcagaaccttatcagttcacaacaaccacagatttctttctccccgctttccaccttggttgtttttggaagttcaggtggtctgatggcttggggtgcgctggttgcctgcaatggttacctgagtagacatatccctcccttcagggagatgtgatccactgtgtagtcacagccgggagtgggctcctttctctgcaggctgcagtgaatcttgctggtcttctacggataggggcttctctgaggcacagattggggaacagtcttcaggctacgcccggtgcttcaccctttcactgttgggtttgtgccccgcttctgtaaacagcagggtcttcgggtccaagcatatctgaatgcttacaaggactagacttaaatccaacttccttaggaatcttttcctctttagaaggaaatagtagaactaattacaaagtgactcaggaaagacaaatggattcgttgaaccttttgtcagtagtgaggttttgaattgttgaatttttggggaaaggcttatttttctaatctcactgtttccataaatggtcacagatatttttctttagtgtttctttgtgcaactctatgttgaactctcaggtttcaggttttaaacagttaacaattcttttatttattgttggtataaaaaatgaactgatgataagctatatccattacgggttcttgctgatggtatcaaaatgccaaggtagactattttatttttactttaatggtaaatattatttgatctgcagttttaggggaatattagaacttttttttttaaaaacgagcttgaaacaaaaccagtatgacactttgctttgacaatatgggtaaagaaaattatagggaagaatctgtaaattcctcctctgtgtgatcctttataaagtaatgaactgcggggaacatgcctgagagagattattggagggttggagggttttttttcttttcttttcccaaaacaaaaaccaggactcaccatgacatatacttaattaaatttaatttaaagggggaggacatcccaatttagtttgagccagactgataggaatttctcactgagaggcttttccttgccttgtggtacaatgtgtgcccaggccccagcagcaaactaattacacataagggcgggtttgggagggcagcctggggggagtcggcttcctcctccctttcccatttcctctctccccccacttactttatacagcaggaattatatattagtatactcacttgggagactggagtccccttttatttagaaaaaggaacaaataagtcataaggaaaaaaatgttcgagtttttttccctgcttgagcttcagcagtttataaacaattttgtgttttgttggttcttagaatacagagcaacaattatgagggcatttcttaacgggaacgtttgggaagaatatacttttatcatcggtgtttagatcatatttgtccttacattttcagcagaaaagtatataatacgaacagtttaaagcatgtagatcccaaatattaaatagacttttgaagaaatgagctgtgacattaacaatattttaaggttggttgcttcagaaatggattgatctctcatacgtggtggtcatacaagagcctgggcatttgtgggattacttttctctctaatctcatgtgttatgtgttaattgtgagcataattatgctgcctgcaaatgaaaattgtgtcttatcactcaaggttggtgcaaataactgtatgtatgatctggtggacttaaaaatgaccatattcacatacagacagtaggtggataacacttttaagctccattttaggcacttgtacccagtagagagattgtgaaagggaaaataaataaatatgaaagctgtgtttagaggtcgaatctgtttagtggtaaaactttagggtctgttttctccaaagactgaagaatgtggccaaaagaagtgtccagatttctctgtagaactgcaagaaaatgcaagccaaccttgttaaatgcgagcgttacagctgcccctttggagtttagtgactggaactgcaaactgctaatgtccaacttttggactcagccagaaaaatatattgtaagcttattcccctttgacaaacctaggctgtgctgctgctgggctgcttggggacagattgatggctggcacaatcttttatagctgcatggtgctttttcttattttataataaggcatagattaccttgtggtatttaagttgcatctagagttgtgtttgaaccacatcagtgatacattttattctttcatattcataaaagtgataaaatcaggtaattcaggtccatcctacgcacttcatattcatggttgagctttttgacagacaccttatttagaccttgttgtattgcaattactttgtacctctgaaatcagggaagttctggggcttccctcttcttgggatagtttgtggagtgctagtatatttggatctaaatacttggagtgtttttctgtgggtttttattttttgtttcaaagctgtgaactcttgagtgtcctcaatctgtaagattctcattatgagcttcgtggtccatatttgaatttggaattgaaatttgaccattttttcaaatacattccagttttgtagtggtacagaatagggtagctttgaaatatgtgttttattttagtcaaagtaaaaatgggatgccctggtgggtgggttttcaggatgatgtttcttacaagggtaggttactcttagcttttaaattctcctttggtccactgattttttgcatagttgagaggattctcaaaaaaatagtttccaatagtccgggagtcttggctaactgtgaaactcactcgtttcctcttcttgattggataatggtagtagtggtggtggtggtggggagtagggggaaggtcctcgtaaaaacctatcttttttctacctttgtggcaggccaagggaagggtgtgttacatgcactacacccaccccgccttgtttaaaactggtctttactatcctaatgcaatgctttctatcctttttcgtgattcacatttgttttgaaggctctgtcctaggatttcattagcagttttaatttgcaggcatgggaccctggaaaatgggcttaaaagaaaaagctggcttattgatgaacaagttaagcatccgtcatctctaatgggaaattctggttgcttttaggcatctgacaggtttagatgtatgtgtaaagtgactgaaacactcttgactgggaatatacaacactgttgttcttactgatacataaactgaaaaactgctgctaatggtgggaaatgttaattatgtgagaacatattgaacttatattctctggcatgaacttttttaaaaaaatgcatcaactgtgctgcttttttttttaataggcacagctttctaattatcataattcagttcagctctgctcttggatggtgttcaagtgcaatctcaatttaacttgaaaggggatttttttttttaaacttggaatgtttaagaaaatttgaaaagttcatccaagaatgttgtctgcttaggtgtgagtaaatctaggggaatgaaatgagtgcctttctgtaataattcaatagatccgaatattaagaaagagactgtttttttgctttgctctgtatccaagcatttttgtataacctgatgctacacactgctgagttctctttgaaaaccagtgtttttctaatagatagtaaactaaataaatgaatattttattaccatctgcaaaaatgggagtcttctaagagagaaatacgcaattgttatgaatgtatttgacagaaatcattgttaatcttttataccaaccaagcctttagaaggtaattgctttatctgttccttctttactctgtgacttgatggcattttgtgaagggagtcgtctttgacggctttcatcccagtgtctgtatcccttaatttttctttgactttaatagcttttcaaagaaaaaaactaaatgaagcccaagcgcctaatcctccaggaatcaattttaattgtaagaaagaacaacttagatgggccttccgactttcgtccagcctgactccttctgctgagatgcggagagcccgcggaaaccaaatgacttcatttgctctggcacttaagaaccgaattcacttccgtggtggtgaaataaaaggagccaagtgttttaaatagccactccccgaggcccgcccgcccgagcctgttgagaaaagcgcattgtctgcttgcagctctagctgggagcctgcctggctcgccctcccccactgggcagctccatttctgaagttgacatctggttttctctctgttcacctgatctatccccgtacacgtgctcacatgcagactgcatgcatgcattctgcaggtaacagggatttgtgacattaagtgtgtgtgtgtttcaaatccctactgggatagggggaggaacaaagctaatggcacaaaataaaatgtaaacacagtagctgccccacatgccgccgctgctgggtttctgtctgatggtgctttctgggtaggcgtgcctattgttatggcagcaacaggcggcagaacttggggcaccatatggcggatgtgggcctcagataagctgtctggtaatttagcttatcaatagcattttgatatgcttcattttcagatcacccattactgtggctgggggtgtcttgggggctaactgattctgaaaccattgtgagccgatgcttcctttggtggaatctctttcaatcctttctccctggctgccttttcatctcaaagcctttgagagacaatgctggttagagttagagctccattagctgaaggaaccatcagccccatcttgaaatcctgggcacttagaagaccttgtcatgtattgtcattgagagaaaaacagaaaacagatacttaatagcatttcatattgtctgagccgagaaattctcttaattcaaagttgcttttgctttaaatattgaaggagtaagtttgatactgtttttaaattttgatgaaaggtttctagttttgttatgcattcagaatacctccctcatttcctttcatctttaaattttaccttagccgtaaaatgcaaaaattattaccatttatataatttgaaatcagggaatgtgccatttgtaatttggaggcaagaagcagcttccttcatgcttagaacttgtgaaagtggaaaatgcttccagaacaccactcaagtgtccagtgaagctgaagcaaaactaaaatctcccctactgatggattggtaggggaactcttgcctcagctggagccagcttagggaatctgcacttagtaggtggctcagtggaagtctgatggtgtgcatgaccatgtgctcatcacccatgtgaccctcattcaccaaatacttgtgtctctgatatgtggcaggcatgggggaagctagggcgaggctgtctgccccgctcctgtctcccgctgcctgcgtgttctcactcacctttccaggccctgcaccttttctcacattttgccttttgggtttgtcattcagggcacatagatccatttacatggctaactcaggatggttctgactgaaacccaggtcagcctctttctgttcctgctccaggaagctcctgccacatcagtggttcccaccttagcatgtgcactgcagcctccatggagcttttacagcctgggcaccacctgtgtaggcttaggtgcgttgtggtaggtgcagtgtgtctgtatttctgaaaggccccatcataacatccgctcctggctgggaaccattgatctagatattctaatttttgtctgcagatagaatcaggttaaatttggccacttcaaattctgaatgtgattttcttccctcaatatttgtgaggcagtgtacctaggaacataggctgaatctttatggaattcactaagatgttcttcattggttttaaagataagcctgcacaaaactaaggtctcacctttcgatccaggggaagcaataaaatgaaccagaaccaccttctctgctcggcattcatttacctcgtgggagtgtagcagttgtttccagatgtgattgtagaggtgtgtgtcacggttactggtgaggggcttgagaatggagttctgtctggctgcttatagaggttttgctttctgagtagcagggatgctcctagaggtcgttgggtggtatgcctggtgttgggaaatgaggggtaggaagggtaatcctgacggctttctggagatgaactgtggataaaccaccctgttgttcattttttccttccttgtctcttcccttcaccttgggcactttgaaatccagatgctcctggttttcacggagctactgcttgccactgagcgtttaaacatttatgggtgctactgtgtgccagggatttagtaattaggaaaaggtggctaatgaacagcgatcagtaaaactcccctgcccggcagagtttacagattagcaaggaaaacaggcatgtacagaggtcatggcaatccagtgggaaagttgtgtgtatggtatttcgtgagttccaaggtaacacatttttaacatgcttgaacatttttgaaattgggatgtgtttgacaatcatggctggccaggtggtggtaatgacccttgatgttgcatgcgctcaccaaagcctgtggagtgaatgcagcggagaggaaaaaaatcccagagtcagtagtgagcattcctaagaatactcttgttgttacagagggtggtagtgtatggacactgatcactctgagaagttactttagcttatgttacccgatttatttagcttgtattttcctttttatgtaggcataagattgatagagagtaaaaagtttcaatatgtataaaataatatttctaagtgataagcattgtgacatcatttgtttcacagtagtacgtctgaaataaaatcctgctgcatcttatcggcagtcatgtcttagggttagtgaaatgttgaaacaacacgtttgcatctctagtcctaaggatctgggaggttatacattgtggatgggtgttgccttgagggttgctttgagggagtggggttttttacacgtttatattttttaggagcatggatttccttatgtaacatcagaataaaggggaaacacactcactggggtaagccctcatgatacatccgaagagctgtgttgccctgtggtaggaactgaggagggctttgcggaggaagtgatgttggagttgggctttgaaggaacagggggattttttccagatgccattttggggggtgagttgggagtaggttgttagaaaataaacaaaccttgtgaaatattctcctgagtaatgaacttaaccctcgcatatcgatacggtttgttgccagtaatgggctactacagatttgaaacttggctgtgaggaattaattgaaaggagtaggaggggggaactgattgacatgaacagtgggctgtttcctgattttggtttggaaaaaggataatgtgggttcaaaatcacagatttggaattggacacacgttggctcagctacttgctagtgtggccttgcacaaattacttgttctctgcaagcctcggtgtccccatctataaatttcagttgtgcccactatataccagacacatggtgtggtgaatgctcagtaaatagcaacttcaaatgtcatgttgcataatagatctttaaggattttctgccaagtcaccctggacagtgacccttgaggaacacccaaggctgaggcatttacttagaatctgagccggattcctggtctcaggcaaacagatagaaatctaggagaggctgaggcaagcccataaagcccttgaccattaatcgctttgaaccacacgtcccttattcataaagtggaggaaatccatcagtaaatacgtaatatttgaggtcattccttacccagtatgaattaaatggaaatgcttcaaaaactggatagcatggtgcaacttcatctgtctaaaagaaaaccttttccttagcttcttgcttgaaagccacactcctaacattggggttgggttgtaaaagttcttttgtaagtggttgaatggaactcatcttttcatagcaaaacaatgcttagggtcttcggccttcttgtaaaaccattgcataatcccccctggggtgcagagggcattcagcttcaggtgcggagaagaaaggtacttttgctgccctcattgcacctcttaatacctgctttgggctagctgcttagcttctctgtgcccgcagtttccccatctggaaaatggggatgatgttatctacttggaagagttggagtaaagtttagattaggtaagtgctggctcggtaggctagagctgtaggtgtggctgctgttaaaacctaggccatttgtttctctcagtactgcaagctccagagataaatctttgcccctctcctaagactcgcttcctctgggccttaaatgtcactcaaataataattcacactcatgtgaatgaatggttgcccatctctttagccagtgtatttgcatgtttaagaggatggttgtgaattccagtgcctaactccaggtacttcctgggtagatgagctgagttccttctggaagctggtgatagaaccttgtgttttcgaagtcagctggcttaagctggtcctgctctgctcacattcccagctacacttctgggtgtgtcaatgtccctgtgtttttagatctgggccactcctggtgactggtctgagcagttaagattgctttgtgtgagcctgggccagggaccacctgcattttattgacatcttttccttttgtctcttaagcagtgtatagacatgtgtgctaattaatctggtttcccagttctttaaaaaaattaaaatgaagacttattgagggaggagagtagtctggttgaggagagagacttagattcaggcaggctgacagtggatgaggggagaaaatatatttaaaagcacttattcacaaccctgggagtctactaaaattactgaattacatacttcaaaagggtgaactttatggtatgtgaatcatatctcataaagaaataaaaccctggatctagtcaccacacagaacagcatcttgtcatgctcaccatggtatccccagcactctggctgtcatgtttttcggtgatcgagtgattaaaaactgataatcagacctaataagaagagtttctaccagttggttttagagaggagccaggaaaaaacatatagttcgtttcaaagataaacagtagtagtatttaaaatgaaacttttttactttagaaataatcagtttcaataatgtggaatgatgtgctccctaatgataaatgtttaccatggtaacccatccttatggattgtacttttaaacaatccagtaactaagtcataaaggataaagtgggagatcatgaagaggagacacctggaaggcatgggaggccacaaatcagtcattgaatctgatttgcagattgacttaagaatgggagaaaatggacctagaatcaggttaatgtgtacctcaagtttcaggctctgctctacctagcttttttcttaattttaacctggtcttccttgttcctgtgtccatccaccagatcctggctgccttcctcctggttactgtttgtggcagttttgcctatttgtattttcgacagggctgccctttatggttccccatggctgagtacctgtttgcctggtataatcctggtttatgttgcttgtcttggcataatccttaaagaaccctcctttactatcaaaatgtcccagtttggatgataaattatatgcctatggtactaataggaaattgtcagggaaactggcagactagacttttctagaatggagagaaaatcccaggcaggagggctttgtggtgtcttggtattgagctcatgacagtattacttttgaaggattgtcccaggccatttctgaggccacagctacaatagaggggaatttcaggaaacaactttcccttcaaacctgtgctatttcaaccaaattgtttcaaaccttgttcttttctgtggatgcactcataagtatttttttaaaaataattctcatcattcataggaatgattcagcattggttcatttccttttagaccaaaaaagtttaatttagaaagaagttttttttttagtggtattctgaaaggttggtttgtactgtatgaaattgggggatttcagattatattttagaacctgtggtcttggcactcttgacattcttaggtttcaaactcacttacctttgttctgagggagactgtgtaatgatgtcctatgatgcacctaaatagataagccagagaacattgagtggaattttagaaattttaaaagaaattttagtacttttagaactttgcctaaaaccaaaagtaattggaatgacactgctcagttcctggtggttcttttgacaccactgtttagttattttgtgatgtgccttaggcagtgacttcgggcaggagtggaggtgttcagtccagtgtttcagctctgaccaaaacaatggcgtctagactttgttgttgagaactctggtggagaactgttaccttgttggggtggttcactgggagaaggcatttgagggtcctccaagtgctgggtcttggtctctccacttctagctcgtgtggaaggaagtcctggttgggaatcctctgctatggctcttcctgtgaccttaggtaaatcatttgaaaatctttggtttatctttctgggaagatgatgctgtactgcctcttgcccctctagctgttttttgtgctgtgcttttgattaaagagagaaaatgtgtgagcccttaggcagaaaggtcctggaaaacttatcttatcataccatccataaccctcaaagacaggttttgtggaggaggagcagtactgctgagttcacttttagttgtgctcattcctgggcttcttggataggaagggaaggctgacaggccaggttctgtctcaagcccatataagagttgagttgcaattgtagttgaagaaggtgaagctcagagaagtttagtgacctacccaacatcacacagctgcactttaaaaccagttctttatctgtgtgactccacagctgtcaggctaacaaaggactgcacatcaagtcacctatccggttttcttgtggcatttgaagggagttaagatagattgtgacattgaaacaaaggtaggcttctcatttagtgtatttgcccagaaaaatgaggacacaatacttgtgttttcttggtggcccattttactccctcttacaaacatatggctaaggtcttgaaaagttgggtgtgtctcagttgagcctttcagagattacttatcctgccccattcacctctcccctgtggtttcagtcctccaggactgtggggaccagtacccctcacccccgtgactggttatactcaccgttgagagagagggggcaggactcctccgggccaggctaatccaaactattctctaggtgggtgtagtgggtagggggactgctgtagtttggaagtttggaactggacctgccagtttatctggttttgctttggaatgtgctgtgttggcaggcaggcagaataagttagccccctccatcaccctgtaggcctggatatggaaatggcctcatgctggggatagggtttaggcagatgaccttgacttcactttttgagaatgggagtgcttgggaacctgctgagatggggtgaatttctctcttcccacccaggtgaccagcttagcctgtgataggtgatgggcagtgatgggggcagctggcagaagagagttaactgtgcttgcccagagcccttcataatcaggactctgaaaaagacactgggtctttgaaatggggttgtttacagggttgatacccctctttgacaccttggttggtttttggtgggaggcagtggggctggttgatacaatcttttcctcctgtctacctgtttctggtgtctctcagctaaaaggtgtgtgatcactgattgccagtttttaggactctgtgctcatgactttccccgcttcccaacttgcttgtaccttcttagtcttcatgcatttcttaaattcttcctaggtggttctgttggctgttttggtgttgtcctaactgtgcagttcttactagtgcttggtgtattcagtaaggtagccggaaagcatggcttggaggtcagatcttggttgcagccccagttctgcctattggctgtgtgattttgagtaagtgattaactctatctcggcttcttgtttcctcctctgcaaaatggagaaaataatagtacttctccacatgtgagtttaaatgaaatatagcgaatgacccactgtcagcctctctgttggttcccccaacccattgagaagtctcttgcttcctccactctccagtttctcagttcagggtcctgaggttttcctcccgaataacataggctggtctgactgggggtcatttatttgccttttcgtcttcctcctttgggtttagttttaagctttgccccagcttcccctcttgctggatttcctgctttgttgtttttctgtttttttttttgttgttgtttatttgtttgttttgtttttaaatttttagtttgacaggctatttcccttttgttttcatattttctgttgtctctccctcctccctggaaaacacatccacccttcctgcctccacttttcaccctttctcctctgctcttatcactttaagatctcagagactctaccctgcagttcactacatttcaccaaaaatggtcatcagaaaagcaccacttctgctctctttaacactggattgaatctgttggcttatagagttcccagcactcttgatagttgttactattttggaataacataactcattctcatccgcattatgcttatgaacttgtggaatgacacaggtttccttcacttatctgtttgaccttgggcaacctctttatccttctgaagcacagtttcctaacccctgaaatggacatagaagtgccttccttatgggttatagtgcaggttcagtgagggtgagcacagtgctgactcgcggagaagtgtctcataaatgttagctgctgctgctaattatgattgtgactaccatcatccagcagctgtgaagtagagtgccaagtacctcttctgtagcatctgtctctctttttgaaggagggggtcaggagcagaatcttatttttattttagattttcagtgtctttgctttgggaaagtttagtacagtagagggcaattgaacccctgtgcacccattatcacccagcagcaatcatcacctcatggctattcttgtaaactcctggctcctctcccaccagattatttggaagcaatcctagttgtcataccgtttcatctgtaaattagtacatattttaaaaatatgactctttttaaaaaaaaacaaccaactattgataccgtgatcacaccagcactgtaataactccttaatgttggccgggcacggtggctcactcctgtaatcccagcactttgggaggccgaggtgggcggatcatgaggtcaggagatcgagaccatcctggctaacatagtgaaaccccgtctctactaaaaaatacaaaaaattagccaggcgtggtggcggccgcctgtagtgccagctactcccgaagctgaaggcaggagaatggcgtgaacccaggaggcggagcttgtagtgagctgagattgcgccactgcactccaacctgggcgacagagtgagactccgtctcaaaaaaaaaaaaaaaaaaaaaataataagcccttaatgtcaaatatctagtcactgtttggatttccttgattgtctcataaatgttttttcatagttggctggtctagatgagggtcccaaaccagatcaacaggttatatttggttgctgtgtttcttaaaactctttaaatcacatccccacctttcttgtaattgatttgttacagaagcccctgtgtttctcttctagactgcctcgttctggattttgcagttgtatctccatggtgctgtgtattttattctcttatcctctgtatttcctataaatgggaaatttagatgttgacatttgatctaattcagggtttttaaaaacttttttgatgcaaatatttcatagctagtattctaccaggaggcacacaatgtacagtgtcactttttctgtgatgttagtgccattgattgatgatctctgcctgtatctattatttcatgtagtttttgcaaactggtggttctctgatactctagttctgtttttggagacaggtctcactcactgtgtcacccaagctagagtgcagtgatgcgatcccggcttgccgtagccttgacttcccgggctcaggtgatcctctgacctcagcctcctaaatagctgggactgtcagtgcgccaccatgcctggctagttttttagttttttgtagagacagggtttcatcactcaggctggtctgaaactcctgggctcaagcgatctgctcacctcggcttcccaaattgctgagattacaggcgtgagccatctcacccaacccattcctctttttatggagaaggtttctcttagcaactatatggttaacctagcatatagtttgtaaaggaaagatagtttttttttgttttgcatatcattaggcaatcactgattttaaattattgaatgcgtttcagtccattgcagttcctcctcttactgatgctcaaattgtttcatctttggccagtgggaatttctttagttggctcctgtggccttttgatgtgaccctattaatagtcttttatagtttccttgctgtccaacctcttgtgtattctgggagatagaatgaaccatttctgcagagtttgggttccttttagtgagaaatggagtttctaggctatgatgtgtgtgctaggttctctgctttttttctcctcccactccttcagttgaataatctgctcacctttggaaatggatcctgcctgccatgtcaactctaatcgtggtaaaagctttccttgcacacttgctcatgcctggcctctttggctctcatttgccactttcatgcttgtgcttgtcatcttgtcctttcctcccttaagaaaaagaccaaactgaagaattaccatggatggtttgtggtttgacttgcctcctgaaggccaaagctcatgttaatgtaggcttcacagaagtctttagtcattgccttcatcatgtctgcctgatagtttgttctattccttgtatacataaccaggacatgagagattccttatcttattaccaccgtgagccattcaggctgcaagctgtatttcgatggtattgttgggtacgtttgtactcatctgtttcaataaatattgattgaattaagctttgtacttcttctccaaagtgtttaaaatagaatgtatttaatgtcctagtcatttaaagaatttatcactagtctattatttttataagcttaaataagttaaagatttgtagttttagatagatttatgcattggatccctagttgtaacatagctattgttttagtgctgcgggcctatagtagtaggcctgcaagtctaagatgagtgttttttatttaacaagtctgctattaaacttatttttagtattataatttctgtctttgcttcttggaaattgttttatgcccatgttggtgcatcatagactatgcacttaggccaaccaccccccagtccccccagcaaagcagggctcattttaaagacacgctctaatgctttcttcagagtttccattcagacctacagttttagcttcagtaatacttttttgttttgttggtgaaacaaagctgtatgcgttcacagtgcagccaacacagtctcatgacggcacaagtgaatagtcctgaaattatcatcattctccacaccactgagaagttaaccagcatcctggcctgggaaattttggatacacatttaatgcccctcacccaccaccccggcttttttttctttttaaagccgcaagcttaatgtaatggttcctctgtattaaaggaaagtacagtattgtaggggtttatttcccccccgcccccgctttcctccgtgggcactgagagtagggggaagagccccgtaattcacaaggcaggcttctgtgccccgcggtaaactcagtttcacaaagggaattttcattatggtcctgtggctccctaacatagtggaggcttcaggaggcaagtggtaaaagctaccaaagaaaaagctggactggagccactgacgtcatgtcagtaaatctgctggaggagcccagccatgcagcgcctgccagccggcccctgcactttggccttgcctggtcaactgttcttactgcttcctccacccccaccccacagaacagcctgtgttttttgtgttcttttcccccttttccttctgtgcaactgggctgtgttgaaacccataaaggcttttgaaaaccacccctactggtcctgtgcttaatgtcttgtgtggggatagtggggagaacccaacaatccatgaatgagggaggctttaaaagttttttctagtggggacctctttgtgatgaataaatccacagggaacatcatggaaagcagccagaggtgcgagcccctggtgcttagtacttttaaagaacttcgcttttaagtcctgggctgtgtgcacatgtgtgtgtgcgtgtgtgcatgcgcacagtaaaggacagagaaggccagtcagcacatgggtggaaatacagaatttcagccttctagcagaggatgatttaagagaatgagttccaatgcgagtcctttattacccattaatcattggtctgctcactctgaactctggtttgcaactggaacagttaaatcttaagctacatgcttctgtacatcctggatatttagagtcacaaccccagatgggcctgaattaaaatattgctgtgctaaatctatttttacatctaggggaatgacatctaaaaataaaccttatcccacctgttatccacttttgggaagttgaaacgctgttaagtcgcagcccatggattaagctttgatgacggcttcccatgtgatgcctgcattccacttttcctgccactggcatgatgttttcattgtttcggtaaccgttgtcctcctgtttattttgctgtgaatattcatttgcaaataagagtgaagcataggttcagactggttttgattttcctgaatcttagggtcagaaacatattaaaagcagtatcttatccatgaatcatgagatgagtcagttcctgaaaccactacaagcctcatagttcttggctacaagcaaaggcaggaaatccaggcttcaataacttcctttcccagtcctggctatagccgcgttggtggttaggttctgctgcctgcctttgtaagcggtaggaagatgtatgtctgaggaacaaaggcacttgagtcaatttactgaaactgtttataatttgtggtcttgatctgaatgtcaggctgcgttggcacaccctgctctgctgtgcggcccggcacaactcagccaggaaaggcggcaggctgagtccggggaagtgccccagcaaacacatggcaaatgtttcaaggggctttagtgttccagtgaatcctaaaactaggggacatgcaagccgacactaggcagaaagctctggattccatatgtatagttgaagtatcgactctttgtttgttcttcacttgagagaaaggagagaaaaaagagagagaggggagagagacgagagaacaaactaacacactcgccagcctgccaagctctggcctgtctcttgcttttacttgcagtttacttccttatatacagggtcctctttttttttttttccttttgcagtgtttcacgccagtcttcctgacttcagaatcagttttataactgttttattaaatattttaaagagtaagggagaaacacgaagttgtctcccaatgttgggtctgctgtgactcgtatttatttttctcctttatgagcagtgcccactttgtgtacgtacccaagtcagagcagagttgggttggtgtttctgtgtgaagttgggactcactgttgctttgtgctttacttgtgaatttatgagctttttcaatcttgagaaaaattaaaattgagtgtgactcattttcatttaccaactcttaccttctttttctacgctaattggtgttagctagcgtgggatttgagaaaatgggactgaaatgagacccttctcccccctactgtaggtttatatggagtcattggaagttctgatagaagtctaaaaatagcatgggtagacaaaccctgtgaaaagacactgaggaagatggaaaaaaatttgagatgatgagcagttagatattgatgctaccttttaaattgagcttgtttccaattcatagctggcaatagctcagaaaggtcaaattctatttcagcctttgtaaagaataaaataaaagcaaatgcaaaagtttgcctggctttttaatcaagtgtggctaattcagcgcacagccaggctggcgagggccacttcgttcttacttgtcgtttgtattttgtgtttgggtaattttctgttcaacttcaggcctcactaaaaggctctgataagctgttgagaaagtcgggctcattttgattttagaggcttgactgagagtcataatttctggctgtggttctccagatttcaggctggtacaaaaactccttagtcttaggtgagtttctttggaaatcactgtgaaaatatattactctcattaacatgtaaatagtcactgtctaaacttggaggagatttttccttatgttaagagaggtacaaatccagttatttttatttgtccttcattgatctgacagttaacttctttttcatgtagatttcaggctgggattagagactgaatcttgaattgcttatcgtctctagaccaagttgttcggggccagggattgattaattaattaaaatcaatgtaaatggatttgtaagcctcctgtaacagattatcctattagcaaccacacagagcacagcccatgatctgtgaggaatgtttgttgccttaagtgaaatggacccagactgatggactctttggggttactttatgaaaaacccagtggcttttgtaaggaaggggcctcacttaacctttacactgaacagatatttcctatagatggcagattattttattttctgagcctgccccagaaggcttgagttctgtttgtgtgttgtgtgagtttctactgtgcctgtgtctccccaacccttgcattcatgccgtccaagaccttgccatattttagccaggttctgccccctttcaggtgagattcctgctaagaactcttctctgaagaaaaaaggaggaaccagaaatacattcctatttgatagcaacaaagtggttttttcctccaacccaggcaaccaacaagcaagcaagctacaaagaagacagttgcttgttatttgaggctctgactgtacagctgtgcctccttagagtggttaagaagacaagatgatactttaggaaaactttgtggatttaacaaaggtcggagttcattcagtggctgtcatgtacattgtgtgtgtttttttgttttgtttttgtttcgtaattgtgttggacaggtagatactttctatagtaggaccagctcacccaccttttcttggatcaaagtggggctatctgagccaagttgagttaaactctgtctcctgcctcttttgggattgagatagcaatcccagtttgtctttgatgctcacactgtagttcagggagaccctaactggggagtagatgtttgacccatgggtatagagaagtgtggaataaagccactttgcagagagacaaggaaacacagttgtgctgaggacgagacaagagaccaagggaatagtctcatttcctgatggttttctatttcctggtttccatctcttgtgagggttggctgcagtttctgattcaggggtcttcagatggacgccttggccttataatgaactcgtattcccttaccgttttttcctaccttaggttagtgggagtgggtttctgttaattgaaaccaaatggtgtttggccgactagtttgttgggaaatacaccctgcgtgctgtcctagggaggccccgttcagcaaagggagctccatttggttacatgtgccttctgcttggtcagccatgcagggctgctcccctcagcagatagagctgtcctggaccctgtgctctcctgtgtattgggtttgagggaactgactccggttcctggactgtctagctaactggggaacaagaagggctacccacttccaccctgtctcagactggaacatttcaaggcttgacttagtcctttctgctgcctggtgtgccctgtggatttaggctgtgtggtgctaggttcaagcatggcaggtgaggaattttcccagtcgtgcctgggggcactgaagagttctggttggctgagcacggggaaagcaagccaggtgtgtcattagacctgagtgtcctgcctggtggtaccacccctccctgcccgcccatccctgagcaatgtggaaggcatgctgtcagtggcctttggcaagtgcttccctgtgataaatctgaaaaataaaaagtgcacaggtgagtacttcctctgttagggaatctcgaaaatcagaggattttattagcaaatggattatatagcaaatgcctttctcaaggagaccagtatggttggggacccaaaggggtggtgtcagaataaaagcctgcccagaagggggtgcggtggcagtgtcaataagcagggaggaaatttagatgagacttgagaattttagataacagagtaaaaattattttagaggatagatttttttggggaggaaaacccctacaagtacattagcagatgtacatacatgcaatattagtttgttggcatcttctacaaatttgaagccatttttacttgaggctcaatataacatgttttacttgttttgttggtgaagtttggtttgtatatttaggaagtggaaatatggaaactctgtgctttaaattgagaggggtacagtgaaagaaggggggtatgtagaaagttctcagaatagagggctgggcgtggtggctcacgcctgtaatcccagcacttgggaggccgaggcgggcggatcactagagctctggagtttgagaccagcctgatcaacatgatgaaactccgtctctactaaaaatacaaaaattagccaggcatggtggcaggcacctataatcccagctagctgggagactgaggtgggagaatcgcttgaacccaggagtcaaaggttgcagtgagccaagatcacgccactgcactccagcctgggcaacagagcgaaactccgtctcaaaaaaaaaaaaaaaagggccctcagaacagggaccagaggggtttagacttttataagtgtgtttcttctggtcatcacagatctaataaaaaataacatgttcatatgatgctttagagttgacagagctttttcagtcgggtaactctttgatctctcacaacttggtttgtgcaagtgaggaagcggggaccgggaggtgaggagccttgccgtgaagccatggctgaaatgcttcctgccatgcctgctccttccttgctgcgctctctcttttttggtgggaggattatgtgttaggacaaggctaggggaaaggtgaagtgggggtggaggatggagggcaggtggggtctggagatggtaaaggaattgtttaaactaccagagcagatgggtctctctgcagtattcagagcacaggcagagcaggaagggactcagatgtggttttcagaccagtgaatatttttgtcacttaaagagggtttttttttttttaaatattgattcctgctgttcatcctggatcttctaaatcttaatcactcatggtgaagcttgggtgattgagtgctctgaaaccttaccagctgatccttaggagtcccatttgattctagccccgtgtctctttaactagaaaagtttgagaatttaggtctcagcatgtcctgggagcttattagaaatgcataatatgagatcccatcccagacctgctgaattagaatctgcattttaataaaattccaggtaattagggcatgcgcattaagttttgagaagcattgctataagatgcttcagggaaacttcagggagtgtagctggggtaatttcacatactctttccaggtttgttatttgccttttgacttaccttatataactttttcatgcagaaattagttgtaagttggatttatcagtacttcctttatagtttctatgttttttatttgcatactaaagacttgcctattcagaaattactggagaaaagtcctccaatttaaaaaaatgaaatcatggtatattttatataattggatacgtctccaatttgtttggactggtataaggagcgaggtaggaatctagacccagtggctggtcacttgtctcatcactgtatctttcaccatttattttttttcattggtttcttcatggatccacacactaaattcatacatgttttattatccacatgttgaattaattactgtagctctataatgtgtatacctacctatttctcattactcttcttttaaagatttttttttccctagcttttctcatcggtttatttaatgaattgtagaaaccgcttgtctggttaaaaaaattccagaagctgtttttactggagttgtattacatttgtagaatagtttacctcattctgttttttaaatagttttaccttttctaaattatatacaccaatagtacttcagagcatttttcagttagagtcatgccagcctttgcaatggaattttgaaacttatatcttctgtggggttattcatagagactttccacttattctgtatcactgcatcctgtttatttctctcaataaaactagtgtatctgatttactcactagattataagcctcacaagggaagtttccatgtctctttatttaccagtgtaattgctcagtgtctagaaaacctctggtacatagatgcccaatacatatttgttgaatgaatgaaatttcggtaaccagagactctagcattgcagttgaagatcgatgacatgtcgaattgtttggatttggatcccagtttgaattcagtgcaccttttgagattattgtgcagtcttttgggggaagtgttccttctctgccattgaattgaggatggacctgggaatgttttggtctatgagacttgacagttggtgtgaattcattgtgaaagtggagactgatgacccagcacaggcgttgtcaacccacacattatttgggaaataatgctgtgaatcaaatcccacaactttgattcaacagcatctcccttttaggtcattctggtattaatttttcttttaattaggaaaaataaaatatttctgcaaagaactttgtacctttttttctataattagagatcccttagataaattagcatcacccatttaagcccttttgttttaggcacaaatacccaacctgtgtgctacttatggacaggaatggaatcttcattcatttttataactcttaacaactttggactttttcttccataactagagatcccttagataaattagcatcatccatttaaacccttttgttttaggtacaaatacccaacctgtgtgcactttatggacaggaatagactcttcattcatttttataactcttcaccaggtactcaaggtttaaataataagagaaaccaaatcataaacatacagtacattctaaaattataaattaaaaaatgatgttatacctgtggggtgcagtggaaacgagttttgcgtatattttagtttctgctacccttttaaaagccacattgatcttagaaacttttttttctatgataggaggatttctagaaattatgcttcttaactctcatttattttccctcaccgtggtatgagaagtgtgggatatttgaatggagttggtcagttatttataatactgttgcttttgcttcctaatttatttcagttttatatttggtgtaaaatgaaactcccctaatatttgaggcctttaatgcatctggtgccaagtgacttgattttgtagattataagtagttcagtcgactgcttcttcaataaaaattgttttgagaacgatcacagtcgctccactgcagattttgtggtcctccccttagctcgctgtgatggtcggtgagagagattattttgggaaagacaaagcacagagtctcctctgctctagcacagtcatgctttagagtttagattttgagcaaagccatagcagaccccctctgggacccctttgaattttgtgtttgattcttcatgtgtacagtgtacaatatttggagagtgtttgtaagaccgttgtgttttctttaataaaactgcatttatccttgtgtggacagattgtgttcttagagtctaatttcttagagaacactgggaactgtttacttagattttttttttctttctttaaataaaggcttcctctggttatcagctttaaaactattgaaagtcagccaaaaaagttggttgaagggaaaaggcactattctggagtgtcttaaattttagtcactatatgttgggggtgattagggcttttacttttccagaacctgtagcaaacaacaaaacaaaaacttagacgtcaagcctaaattttgcctttcttttgatcttggaaattggagttttggaaaaccaagcagggtaggcttaattaaaggagatgctgttatcttgaagtcttacctgagtgaaggggaaagttgagtaatcggaagggtcatgccggtgggttttcactgtctttagtttccaaaagatgctatgaaatttcagttcattgtttgcgagtgtctgtgttgggtggtggggattcagagaagaaaaactgcaggctagtgggaaaagggagttgtgttaaggggaccattccagtctaaaatggtgagtgatgtacgggaggtgtggggctcaccagataagagactttaagagacttagagctgggagtcctgagttccttttgaagctaaaataaataaaaattatatagggaatagaagctgctggtcattatgatctcctggactacactgggcataaaaaagatgactttctataagaaattctatccaaagagtggcaggattatgcaggaaatgtcatttggttatagccgaaggcaaactgatgcagagctgcctgccacagcactcgcaggctgcttgtctcatccccagccctctctggctggctccagggccctttgatctgctcacagactgtgtaaatggagagctgaaggagatagagccaactgatgttacttttctgtgtactccctttatccatggtgtgcccagaaatggtcagtttccctctcagcactcaggggccgccccttgaaccagatcctctctgcattcaacccttggtgccatggcaggctcaggtgtcagtggtcctaggctggtatcaggccacagcggtgcagggtaagaatgttggaaattgaccctgcgtgttactatctgagaacatcgtggacaacgttaagtggagtttgtctctctggctcactgtccagaccagtccctcgacaccactccctctttatagcttcatgacttccatctgtagaatgctttatgtcttaaatgtaccgtagccaagttcatggtcttatttgagcctcaggacaatgccgagagtagaaggataagaatcgttagccccattttagagatagaagaattgaggctcagagaaatgcacctgggtgtgcatttctgtcttcactgagtgcttttgtggctgagcggctcctccagcagcactgcctttcttcaggctgcaggcttccgtgaaacatttccctttcccttccatgttctcccaaatcagttacttccttcccattccctggaagctacttccgtccttctctcgcccggattactctggcagcctctcaggtaatcttccaatgccattgtgtctcagcaggttaattaatttgctgcatcatcatcaccatcattatccgataatgcacttacatagccattcttgtgaactggcactgttcttattgctttgtgattcatttaattttcacaataattctgtgaaggaggtagtaatatcagcctcatttaatgaggaactggaggcacagagaagttaagtaccttgtccaaaactgcacagttcttaggagccacagctgggattcaagcccaggcctgccggctccaggttacttgttctgagccactacatcttatcctggggctcccattctcaaagcctcctccctacctgcttcatcacccaaccaatgagcgcattccccttagcctggtgcttgagacctcccacagtgtggtctcagtatcagtggagcatagcatcccacagatggaatctttgtcacttcctaaatgtgctgccctactcataacattctctctcccaaaaaagcttcccttagcagaggatgggggctttggtttttggctctgccactgacaatacatgtaacataggatgagtcaatccacctcccctagctggactcccctgctcggtacgtggagatattatcataacactggttggttgtgagatatgagtgacacatagcaagtgctcagaaatggggatgaccttttccatttgttttgcctgcccaagcctccctatattttcttaaagcacctcctttaggaagttgtcttggagttcctccctcctttacctggagggatctttgctttctttagcccataagtgtcttacagccactttcaccatcatccttcgttgttgttcttcttcctcctaaactctgagcccttgcgggatacaggctgtgacttgcacatctttatattctcagtgctttgtttataatagaccctcaggatatatccattggaatgagtgaatttggggccactggaattcagttattgcatcccttggaaagcttggtgagtggtgcccagcatgaattgacctgcaggagcagccatctattgcctgtgctcttgagttctgctttttattaaaattcttccctgctatagttggagatccccctcacctctttttataaaacacaggctcatggggtagtgtaaatttgcacaaccattttctaagcaaattggctaaaaccctaaattccctagaagcagaatggccctggatgtgcttttaaaaaacagcatggattttagaacatggaaaaagttatgttagaagaactagactcctaccaagtcagagatacatatatttatttctttttatggttatgtttattttctttttatggctgagttggcgttgtgtttggtttgtgttgggagctcccctccatatacctaggctagaggaagatgacgaatgtattagacaagccttctgccaagcacaggaagaatgcatcttagccgttcagtttggtatgtgaaatttgccggaggggccactgttttccttctgagaagttagacagagttgaagtgtctgaggccagttcaccccagtcatagtaactgtacagctgagaaagtcttggttctctcttccagcctcctggccagtcaaccatgttcttctgtctcagccacttgcagcagcctttttgcctctgtgcctttgcttccaccggcatctgcctggcgtgccactcctgacgttccccaactattgtccagctcttgcttctttctgaagagaggaatgtacatcattttacagaagccttcccagctccaacagcataagaaaaccaagccttccttttattcccttagtcctccatactgctgctctgtgttggcattaatcacgttgtcgtctgcgtgttggatttaccctattgtctctctctgagcctcttgagggcaggaactggattttatctttgtatcctgcttggcatgcagaagctctcaaagtgtgcttgcacaagtcaaaggattgggatgggatgataatagctaacatttaccaggtgctgtgctgttttattcatagaactgggtcttggttctggtattgcttattcatttttggcatcttcagattagctggaagggtattgctacactgtcaaaaataaaatacagtgaaatttatgctaatgaaaacatacaccgtgtgtatgcccaactctgtgctttgcaaagtagacattcaatggctatctctggaatgactggattaatgaatgagtgagtggatgattgaatggaaagagactccatcctctgggaaggaaagaagaatggaatgggcttgacagccatactactcttaaagctgaacttgttgcttggctggaaggagggatgaggcaggagctaagctgacagaagcactcagggaattcgcatatcctctttcttgtgatttctgttttagggaaccaacaggtctttggtaccatctcccatttttccagaccacaagcttttatcttgttcttcagaatcctagaattttgccaccaagtttcagcctaaaggaaaatacacttgtagcatgcaagttctcacctcaaaacctgcgtgaaaatagtcggtgtcattgtagagtgatgcagtgcagaaaggggcctgggatgcttcacccggagaatgaaagtcccaaatctggatcccatttgctcttaccatccaccttgataggagtgtgggtgtggcacctgtcaccattctgcttgcatttgtgtgagtttatgccaggcaaacatgagtaaaaccaattccttccaacacttgacacatagataagtgaagaaaattttatcttacattgtgaacacaatggcaggtaagattgcaggaatgatggtttgtgtacaagctattaataaaagttgtgtgttgcatatacaaactttgctttattgtagatggccttttagttcggtgctatacatgtaatattcaaagtgtacattatattaccatgttgtctttttacttttatgagttatttgtaatgtggataataattcttagttcacatcacattttgctgaccactcaaggaaaagttgaactacaaatatttcaaatgaggtgataaattactgttgggttcttaattgtctgacaaagaaactccattgttctaaacctttcaaatatagtgtgattaccctcgtttgtgtgtcttgctcaattttaaagtataaatagagggagttccattaagcaatacaggctgttttcttaccatgcttacaagggctgttagagtatcaatgatgaaattgaaacttagtttgaacttgatatgcaaaacaaaataaatttgactcgtttgaaatattgcgtaaatatgttccagagcctggcaccaagtatctggggatttttagagctgacctcactgaacattgaattataagatacattttaacagtgtttttgaactggttgaagaaacccctcttccattcccttcaagtcaagtatttcctgataagaaatattctacattaaaagagaagtttcctgttgcacttcttcaggtttctgggttagtttaattcaatggattcctgaagctgcaagtgaaaggttaaataggtaccatttgcaactacttatctgtgaatcagaattttttgaatattgtgtatgcagaatgaaagagaaacatacttcgtttgtgatttaaactatgttcttgagaacatactgtaatttacataattcagataaattatctgttttgtatattgtggttatatataaggtttcctctgacagagggtgatttctgctgctaaagttgtttaaagacattgcccttgatatttctagctaacagtggagctcccaggtgcaacctgctgtggttgaattggaaacttgtcactgagctcttttcttacctggctccttctaggactttcaagatcctctggtgtggccgggccagatgggctagccctgatgcacatgtccttctacggttcatgagcgttccaagcttgagtgggagagtcagcttgggcagtgggggtgatagtcatatcctctcaccatctccataatgggcctcttcttccaggcaagagcaggtgttatccccattttacactgaagagaaaaccaagctgagaaagggcatgtgataggcccaagggcatctcctgaccttgactagcactcttttcaccatgctgttttaccctcgtatgtctcagttgctgtgcctaggagaagagttccagtttgtaaaactctctccaaattgatggccagttggagatttttcggaaggcttaagggaaagaaatagcacttgtgggactttttttttttttttttttttttcagaagcatgatgccagcagaagacttgtttacttgtggtgctatacttgtgcggctggtgtttatctcactttctatagaggaacgcagttgatgtcttcttttaaaaacactagacccgagacctgggatcacccttccactcctcctcatgctgtttgctttggcattcagccagctgcctgcctctatgtgtcaaaaacaagatctccccacccaaggacatgatagagctatctgcaagccattttaaggcacatattcacgtttaatggtggcacttgaattagttttcacaaagtctgtgcaccagagcttaactacctcactctcaggccaccttctgaaacttagtgacatcattcctaggtgattctctcaaggctctgcctatttattcttcatgcctttgcaattctaaccttttaatttctgcttcttgtagcataaactgctagaaagtagggaagagggtgtctgctagagagagagagggtgatagctgataacacaggaaaagataaacactatagttggcacatttaaaaggtatattgaactgggctctttagccctaattgcctttctttttttggaaggtcagtactattgtctggcacagtaggacactgggcacagtatgattgtgatgtttacaaagcatcatacttgtgtctagtcaactctgtttaaggaaacaggaagattgttagaaatactaaaaattaaatgaaaagttgtgatgcttgaagtgctgattagtattcggactaaagtatatgaatgaataacaattttttctctgcagagactgcagcatgaaatctcatgctacattgactggtggcagtggtttttatttcatagaactttcttttctgttgttgagatctgtgctgttggtgctggttctgctttggcagttcccaaagtcccttacaggacaagaatgatgagtggggatataaatctcaattccagcagctgctcactcacaggtgtctcggtggaagaattgggtcttgttgagcctgtagcttctctctatatactgctgggagatgctgcctgtgagtgccttgcttgatatccaggtgctagggctaaggacctctttgtggaatagccatctttgcttgaggtctgtgcaattgtgtatgcctgcagtgcagtgcctggtaaggctttcaaactgtgggcaagaatgtaacaatgcctgtcactcgtgaagagacacagtcggtgaggtgagtatggattagtgccaaggaaagttttctgggtcagagactttatcctgctgcaggaattaactccattgatcaaaaacagccttaattgggatggggctcgggggcaaatttcatatgtgattggcaggagtctaaactgtatagcttttctggagggcattttggcagtggggattaaagtgtcaaatgtgcatactctgtgactggacattttcacttcacagaatttatcctaaggaaagcattgtacaagtatacacaaaagggtgttcctccgcaccataatgtttagtgttgccatcacctggggctttattaaaaaaggaaaagttacataaattccagtaaaaccatacagtggaatattataaagctgctgaagaagatgaagtcaacttctatgtactattatggaatgatggtaaagaaattatgtacaaaagtcacagatcagcatgaatagtgtgatcctattttcaatatatatgtgtgtattgagtgcatattatgtaaaggtttatatgcattaattttgggaggaagaatatcaaatgctaatagcgatcatcaaatgctaatagtgattatgtaaagaccctcattttctacttcctacttctctgtattgtttgaactgtttataaaggtaaaaccatagtaatttgggctgggtgcggtagctcatgcctgtaatcccagcactttgggaggccaagtggggtggatatcttgaggtcagttgtttaagatgagcctgaccaacatggtgaaaccctgtctctactaaaaatacaaaaattggttgggcttgatggtgtgcacctgtggtcctaactacttgggaggctgaggtgggagaattgcttgaacccaggaggtggaggtcgcagtgagctgagattgcaccactgcactccagcctggatgatagagcaagattctctctcaaaaaaaataaaaaaaaaaaaccagaataatttgatgtttactttttatagttttgtttctttttttgaattttaatttttttttaaagatgtggtcttgctatgttgctcaggttacacttgaacttctgggctcaaatgattctcctgtctcaacttcctgagtagctgatagtttctttttctacttatttattttagagatgagggtcttgctttatcttccaggttggagtgcaatggtgtgatcgtagcccactgtgtccttgaactcataggctcaagttatcctcagctcccccaagtagctagaactacaggtgcatgccactgcgcctggctgattttttaatttttatttgttttgtagggatagggtcttgctctgttgcccggggtggtcttgaactcctggtcgttaacccaagtaatcctcctgccttggtttcacacagtgctgggattgcagttgtgagttaccatgcccagccctgatagtttctttttagaaagctgatcagcatgggcccctttttacgtcttttagttctttgacttactggaacttttctgatttcattttttaaaagggactcttctaccttttaaaagtcctacaacatctttttcttatttacctaaacagtaatgagaaaagaaataatgaagtcttaccaaattgttaaaaaaaaaaaaatggaattgtaggccaggcactatggctcacacctgtaatcctagcactttggaaggctgaggtaggagggtcacttgagcccaggagtttgagaccagcctgggcaacatagcaagtccttgtctctacaaaaaataaaattagccaggcgtgatgcttcacacctgtagtctcagcttcttgggaggctgaggcaggagaattgcttgagcctgagaggtcaaggctgcagtgagccgtgatcacaccactgcactaaagcctgggtgacagagtgggaccctgtctcaaaattaaaaaaaacccacgaattgtatatgtgttctttatgaaaataatgtgacagatatcattgggcatctactgtgtgccagggatacaaggatgaataagatgtggctcctgttattcagagttcacagtgaagtcaggagtatagttataccagtaaatgatggttaaactgggtgataagtgcaaatagagggcggtacagtacacacagtgagaatagagtggtgctggtaattcatttatttaataaagagggagcatctttattataatttatttaatcaagagcaagcactggccagacactgttgtaggcactgggatgacactgttgtaggcactgggacagcagtgaacaagcaggtaaggtcctgttctcatggagcttctgttcagcaagagagagaaatagacatgtcatgaagagcgtgaccggtgtgaagatgaagaggaggataatggcaggtgggttgttgtgacacgtgagttagggagagtagctcttcaggaggaggaatgatggtatgtagaggaggagagagtgagtgctagcgtctcctggaaggggatggaagagatggagatggcattgcaggcagagggcccagctggtacaaaggcacagacataggatatctgggaggcccccgccattttgggtttacagcaagttggggatggtgtttttaggactgtactgtgaataccatgtttaggagcttggattgatctgttggtgactggctggcctgctggactttaaattgggaagagatatgattggactggtggtttaggaagttccctctgactctgagactggattgaaagagaaagacgagagtcagggtagtcactggggaggccactgcagcggctcgggaagaggtgatcaggccgtggaagagaggtggaatgaagaaattagaatgtgcaggactgggtgattataagccatagaaatcctggctagagcaggagttggaagagattgaggtagtaatgacataattcatatttgttcatttaaatccaggtttgtctaatgccactttaagatgttctcttagtagtcaccagtgatgtcctgaggtcaaaccctggtcttttagcagttcagcatctccctgttgtttgagatcttgcatactgcaaacctccctggagcctcagagaccctttccccaggggtccctggctggtgaaggcctgaagacaaggccaagtcctctcttcattgctgtcaacattgttagtcctttcatgttccctcccctacatctgggaatgcagtgagatgcagtttcccatctcctttcttgtcccataagactagtaaacaggccctttaccctctgggggttttttactgagaatcaataaaaggaaactgctaaagaagcaaggtaacgtggaaggtgactgatgtaataaaggcaaagtagcaaagatagcaaggtaacaagttaacagctgtagcaatgaagcaagtgtggggtccctcaggaggttctgctcctcttacaaagtcactgtcctgattgctggtccctgactcttggttaggctgtatcaagcttcctgatctcatcttttatttctcagggttgaatgtgcagagcctgcctctctcttctctactcctcttctccaggtcctctgcacctctttcttcatgaaagctcctcagtccagtcctaggcactcagggagtgtccatttctgggcccacttggataatttgcatcttttgagggacattctccataacagtccccaaccttatggggcagtctttttgaagtatttcttcatggagtcacccttgtcctcaaatatctccctcttctctgtccgtctgcccgtccatccatccatccatccaataatttgagcttcttattggagcaaatcactgttcttagtactcaggatataaaaataaattgccaagggactctcagttttcttcctaccactctgactatggcctctggaatctttgctggcattgcctcttcctgtgagaaccactgacattttatgtgcacctacacagcttcacctgctatctgtgtgctgctgtcggtgcatgatgaccgccatcccagctctgcaatttaccttgctgtgtggcttcaggcatgttccctaaactctgttgctgccctcagttggtaaaatggaaatgatagtgtacttatttgaaaagttgctttgcagattaagttaaataatgcatgtgaagtgcttggcacattggctggaacagattaagtacttaaatgttattaccaccaccgccatcactactgttagtattgctgctatcactaccattctttctgcccttgggaaatatatcaatcacgtgagaataatagggagtaaaatgagagaccagacttttatctgggtgagaataaatcaaatccagtatctttgggattgatatgcaagcattatggggcaattttgaattgacaattgagaggggagcctgtgggaagacttcattagggataagtgagtcttaaatagtacttgggcctgaattgataaagaagaggcatcaagtttagacccaagctaagttggaaaggtctttagccttctgtctagtaggagggttctcgggttggtgaccaggtacttctcaggtgaacacggtggggcctgtgcatttgtttgtttgtttatttatttattttgagatagtctttctccattgcctgggctggagtgcagtgggatgatcatggcttactgcagcctcgaccttaggggctcaagtgatcctccaacctcagcctcccaagtagctgggactacaggcatgtgcaaccatgcctggctaatatttttattttttgtagagatgaggtcttgtcatgttgcccaggatagtctcaaacacttggactcaagtggttttcctgcctcagcctcccaaagtgctgggattataggcatgagccattgtgcctgtcctggggctgtgcatttaatgtgaggctcctcaaacccgtgcccacattggggattgtctctagatttatttaatatgctgcatgtttataattatgcctgagtgttttcagatgtctaaaatgcaaatctattcaaaacattactaaacattgtattagtttgttggctcttagtcattagatattaaaagtaggacttctattacatgggtggcctgtagaacattttggtgttagaaggggttcccaaacttgaaaaagtcaggaaccacagaatttgcctgataaaaccagaagcagatcctggcagcattctagctggagggtacaacccaattaaaatggctgtgtaataaagcgatcttatatctcataggacaaaaagtccagaggtacagtgatgctagggttagttagagcagcgtctcagtgacctcataggacctggttgttcgccttttccactccgccgtcctttgcgtgtcagctctctcctctcatgttcagcaaatggctgcagcagctcccggcatcacatctccatactaatgtcccaatatatttgttcctggcctcacttctctcagtaaggaaagctttccaattactggccagccttcagacttttccctcatgcctcactttgatgaatggcctaacttgcacattcctagatgaaatagggcctagggagtggaattcccacacacaggtcagggatcccagtggaagagggaacgtgtagattgaatcaggattctgccttcaagaaaggtggggtggagtatttgggtaggcaagaatatctgggcaggcaggaactcgggaggctgccaggcagttcatcagggcggtagctgggagaaggttcccaagcagtcacatccagggctgctctttggctaaggggcagaagcctcccaagcagtggccccagggagtctcctggcacaaggagaagtggaaaggtcttagagtgggatgataggatctgcaccctgtctttgtccccagcagctctgggccatttatcctctgtatagtgctctggggagagactgcaaatgcttcttttggcttttcttttttttgagacggggtctcattctgttgcccaggctggagtgcggtggtggaccacacctggctaatttttgtagtttttatagagacaaggtttcaccatgttgttttggctttgttaaatgagagcccactgtgtcctggcctaggcactgaagatatagtgaaagacaaataggcatggactcatccctctttcattcatttatttagtcattcattccagtagtagtttcctggggctgctgtaacaaagcaccataggctggggatttaagcaacagaagtgtatttgctcatggttctggaggctggaggtccaagatcaagatgccagcaggtttgatttcttccgaggcccctcttgttggcctgcagtaatggtcttcttgctgtgtccttgggtggtctctcctctgtgtgtgtccctagtgtctctatgtcccagtctcctcttgtaaggacaccagtcacactcggttagggcccaccttgttaatcacctctttaaaaggccatgtctccaaatgctgtcacatcctgaggtacttgggattaggggttcaacatacgatttttttgagggggagacacaattcagcccataacaattccgcagttctctaccaagtgtcagtatgtgtcaggcactgccctctaggaatgtagctatgaataaaacacaaaaatctctacccttatggagcataccatggggtcggggagtttagtggtcttcagtcaccgcttccagtttctgtttgggacccatctaacttagtatgattttagcaccctcctctcctccaaattccttattcctgtaaattccatgccctgagaccattccttcaccagagacaaaacccagggatggaaaagcctcgtgacccagtgtaaccagcagaacaggcatcagggacaggagatcctttctagttgagcaggactccttgagggatctgagaaacagataaagcctggggactggggaggaggagagggtatgggtctcgggtgatggctgggcaaggagaggctgtgggcagttttctttagccaagggctggttgccttcgtttcacctgggtggggggcccaggtgttctgctcctggggaagcttgtttctggaagccgcagcaggctggctgtctctctggggagctgcacgtgatgcagacggggctgctggagacaggcctactggcatggagacctaccttgcaggggctttgccagaaggggttgggatcagggagtcacttcctgaatgatttgggttgtagatgggcttatcagattaaaaaaaagatgcccagttaaatttgaatatcagataatcagtgtatgtcccatgattcaaatttcaggtaagcaatatttgggaaaaatttatactaataaattaatttgaatgtcatttttctgacattcacatttaagggggcataccatttttatttcccgaatctagcaatctcacctctaggggttcccagattaacaggtggcgatggaagatgggggaaagaccaacaagaacaatcgtaattcatttttttacagtaaaaatcttggccaaggaatcatttcctagctcaccctccccaccttccccccaagactgagactgtcatttgccccctttgcatgaacagacctcacagagaggtcatagcctggtgacttaggatgggcttcctgtcctgcgcgggctctttgtctgtcggcttccggccgagggatgggagggggagcagtctgaacactggtggaaactccggccaactctctccactgccctccttttctgttgcattggaaccaccggacaagcagaatcgctgtgccccaatccagcctcatctgtcttagaacaggtaggtgtctgcgagggagtgcagcagagagtgtgacttcctaggagttcacgggggggttcctgcagcccttggagagcaccctttttctgctgacatccctcccccctccattgagggacctctgtcattgctgctgaatccctggacctgaacctgtgatcaagaagtaatcctttttattttccccccagacaatgtttagatttttgaggtctcatttttagcagtgtcctggcacttgcttcttagtcaggggtcagaaaactttttctggtataggtcagatagcaaatatttttgactttgcaggtcacctggtctctgccaccacctctcagctctgctgttgtggtttgaaagcagccatagacaacatgaaaaccagtggatgtggctatgttccagtaaaatcttatttatggacacatgtgaactccatgtagtttattattcctttgtttttcaaccattaaggaatgtaaaaaccattcttccttcatgggccatacaaaaacagatggcagaccagatttggcctgtgagccatggtttgccagccctcttctaagtcatcagcagagaacattacagatcagaagcctggctctgcgttcccgacataggcgctgaatggcttcccgccctgaggtcacagcttctgctgctcccaggtgactgactgagctgggatccgaagtagtgggcttggcctctcagctgcccacaatgtgggtaccaactcacataccatagtttgctgtacagagaaaggttcctgcatggatttgtagatcttcagaggatgagccataaacagtcaagtctggccatggaatgtaatgaatgtagttatactgatcatagactataatatccagagtgattcggggctaataagtagccagcagaattgaatgtggggcagttgtatgcctctggtatgctactttctgcctacagttgtgtgtgtgcttggtattgtgtgttttaagtgaaaggatcaattggatttgaatttctgtcactggtagggtctagctacacctgaaacatgagtcaggaggcagggcccttcattcctgagtgtcttgactgatggaagctttgtgttttatggatagaagatgtgctgtgtaaggtggacagtggaattacacctccacagaaatcactcctggatggagaatcaagtttgcatgtgtgccctgtagcattcattcttgccgcatgctgggagatgggtggttattaggttatgtcaaagtagtgtttgccttaatacacgatcttcctgcagtaacccaataatggaagtggaagggagggaggaggggaaggtgatgacctgcttatttgaaagtgggaagcatctggaagtcaaggaagctttgtgtggtgttaacagggagctagtaggggtctgtaccccactgctcaccccaggcccctggcaggtttgaattcactaattctagtcctcaggtgaggtagcatggcttagcggtcagcaggacagcatctgggctcagactgcctggctcctggcccactgtttttcacctctgcctttgggcaaattacttcaccttgccatttactgggttgtacagtgggggtattaatagaagtaccttcctcatagggctgttgtaagagtgaaatgagttaacggatatgaagggcttagaaccatgtctggctcatagtgagcagcacgtgaatctttcttgtggttgtggtggtggtggtgaaggtagaggaggaagagtggttttcttagcctctaacctcatgctctgagggtaagcacagctctggtagtcatcattcagagtccgcttataaccctgtctcctcccaccatgtcatacagagacatgtgaacatctgtggggacgtgccccaggcattctttgtgagtagtggttcacggaggatgcttggcccagccacaacctaaggttttcatgctacacctgtcacttgctggttgtgggacctctggcaggtccctagcctctcagagcatgaaatagagataatcaggtgtcccccggcccctcacaggattgtcttgggggcatgacaagataatgaaagtcaaagtgctttgcaaactgaagttcccctgcagaggaaaggtgtgattgctgctgttggcatcatcttcctcattatgttcttgcattcccttggtctctgggtatccttcctccagcttctgtggggcaagggttttgaaacaatattcacagaatcctggtttttccataaagacatttcgatgtaccgttgcttttttttttgggtgaaattattgatgtaattcaagtttgaagttgtgtaataataatgtgctgattttgtataagggtattatttctgaatccagttccttccttttcttttttctttaattacactcttgtctttagagtagtgttcttaagtgcagtccaaggccagtctagttgtattcagatggctttgttaaattgggttttctgtgacccaggctttttttaaaaggaaaaatttcatcaaatcccaacaactttcatcctaattttacctgcttaaatctcttcctgcaccctaacttgggttgagtggtataaattttactttctgatgctttatgtatatcatcataattgtttaaggacataattcttaattaaatctaaagagcttgaaaactttggggttttttttttaggggggggagtccaagggtcttctgaacaacgcgttttcaaatgtggttggtttctgggattcccaggggttgggaagctgtctctttgatggtgacatttccaggaatcaggacaggactcaagtcctggcttgggtcattcccaagccccctcctccgcagcctgtgtttagctgactctgaccacagctaaacatgagagcagtttggggaggtgatggaaggtacctggggacctttgactctgcctagtggatgagggactgtggtggctgcatcctgtggaaatgattgcgtcctgtggaggaatgctcttgtctcacagtgggagtagggaaagtggcttctatatgctcacattaacaagggtgagattctgtcccatgagcttcctgagagagatcccgcttttgctccacctcatgccttgctgagtgcaggcagctcagccacagtccctaaccacacattgcggctctctacctcttaagctatgctccttgcttaactccagatgactttccagcacattgctgactctcccctttctctttccagtccttttttttggggggagggggggcggggggctgtgtcaaaaaggtcaggctaggggcagggatttgttttgtattgaaaaagacaaccaaggctgaggtaaatcttggcagccttttcagaatttaatctgggtgaagccgtgggttggacatggggtaggggtattaggatattggttcaaactgcgaagaacttggccagctatacaatcttgagctaatagctaaaaaaactctgacttgaaaattatggtttgtgaaaaaacattgagggcatagcctcctgaaagaggggagggctgagtaggaggaacatagtccaggtggcatgatctgtaatgaaaattcaactttgcaaaccggcgtgtgtttggaaatctaatgtttttttttttttttttttttttttttttttttttttttttttttggggggggacccagccatgctgtgtcttgtagatctcatagccagtaatctgctgaggtggagctctggccttggtctctcctggtagtgaggggcatctctcattatataatgttgctctgctaattaagtcaggaataatgtctatggcatatttaatttccaattagactactttatggatcaatttgaatttaatgttaaatctaatgtggaaatcattaaaaagttagatctctagagagaggaataggcacttactctgactattaaaaataacagttaaggtcatgtgttaatacattaagtgtttttatgtggactgggaagaaattagtagagaatgcagaacatatagatacatagatagtctgcatgcttgtgatttggggaaaattctggtgttcagatcaaattctacaatgcttatagtaactgctgcaacagatatcatttactgcaactttactgtatgccaggcccctggtgagtactttaaatgtattatttaattatcagaacaactctatgaggtgagcattattactcccctgtataaataaggaaactgaggcttggaaggtgaaggtctcattgtcagaaaatggtgaaggcaggatttgaatccaagccaatttcatttcaaaatcaactcttgactagattgaggtgctatggaaggtgcccaataattgtaaccagcagagctctgtaagtggtctgagtttaaagcccatttgcttctgaagtgtttgttgctgctgataatttgaagaatggcatcagcactgccattattgctttaaggaacagatatgggccccaaggtgccaagccaagaccctctcccagcattcccaggctaaagggacagtcctcagaaaatgtgactctctgaccatgacttgtctgaggtcagccccgacacttcctctgggcaacttctcagaagttaactcatccagcaccttcagtcttgtgtgtaccttggatttcctttggaccttgtattctttatgggttatactttcttgtattcttttatttttcatgtttgactaccctgtgtttagttagacagaagaatgtggttctgagtccagactctcacttactgcctggtgtattggacaaaccatttaatcgttgctagttactagtctcccatgcagtgtagttgtgaggtttccttgaggacgagtgagtgtagaagcacctggctcagtgcaggtgcaggaagaaagcttcccttcttgcgttcttgttccctcccctgtaggaacagcatccatttactaatgagatgaccaggttcaggagcaccacattttttctggctcttgcgagtgcctactgttcatttatgcaaccactgtgtatgagggcacagtatctccagtccctgttctagcagctggggttactttgtggagtaagaaggatgatctgcacacacccctatccccagcatcctggagctgacactatagtggggaggagagaaggggcaggttaataagcaaacaaagaaaataaatgctgtatatagttggatgtagatactctctgtcagctcactcattcattcattcacccattatttcaacgaacagttctaaatacacattatgttcccagcattatgctaagcatggacatgtgaaattggataacgtctgttagcccaggaattatttcaacagaaaaaaaaagtctggaaaatatagatcactctcttgtgttcttcccttttgaacatcctaactctttagggttaaatactcatttgagcaagtacaagcttctaaatatacccactcctcaagccccccgccccactgtccagcaggttttcctgttgataggacagtggacgtatgagtttgagtgtttggcagatgtttgcatgattcttagatcagtgcttctcaaacatccctgtgcgtaagagttgcctgggaggctggttaaattcagattcaggtgcctcactcctaaatattctgattcactgggtctgggttggtgccagttgtctgagcttttagcctgcagtgcaggtgaattggttgcaggtggtctgtgaaccacacatggatgaaacagtgtcatattcacaccaggctggaagaatgtttaacctcttcagtttaaggaggaaactatttcccagggagtggaggggctctgaaattcgaagctacagtgacaagatgggccaggacttttgaacagaacagatctgggatctcatcctgtctccacatctcctaaacctggtcatctcctcagtaaatggatgctgttcctacaggggagggaagaagaacgcaagaggggaagactccttcctgagtgcacaccatgcactgagccaggtgcttctacactcgctgttcctcaagaaacctcatgcaggcagccttgaataggtcatccggtaacatccctttcctcatcagcctgccttgctaggtgggtaatgctgagagatatggttggaaagacccaggcagagtataggatagagactctagggctaggttttggtccatgctaaaaaataacatacaaattggtttcccaaattcctgatggattatttgaatgtgagttgagtcgctgcatatataccctgtgatttctctctctttctttttttttttttttcacaaaaatacactataaccgcaaaaaagacagtcaaacaaaagagggaaaaaattcatccagaactagctcagtaccctaacacaactgttttcattttaacttttagcccttgtctgtatgcaggcatgtttctctgtatctgtaatcatatgtaggctcaattttgtattctgctcttttcagtaaaccttaagtaaatgctttccaaatggttatgtagtcttcaagatgatttttaatgatcttacaatctatcatcccacaggctgaatttacttaaccattcatctactgttggacatctagatttttttttttctgtagttctgtgctattataagtaatactttgggatatggccttgtgcttattgtggattttttccttagggtgaattcccaggagcaggatttctgggttaaagggcacaattatttttttggctctcaatggatattgctaaattgctttccaaaagggttgtaccagtttatgatgccaccagcagtgcgtgaaggtaccaatttcagcatcttggcttgcactagatagtataatttttacaaaagtttggctcaatggtgcacatcgtttaattgatatttcttggattatgacaaggttgagtatggctttacttactatgttttgagattttacttagtatttttgttttcttacagtcaggacctagctgtggttgaggtcagattttctgtgtagagcttttcagactcttgaattttacagcgaaaaaacaaaccaaactaacaaaaaccaaacccagaattcatctgtaaaataaatactttggacatattttgtggttggattaactgttcgtgattttaacttccttataggtcataagttaatagggcggtatttggagagtagcggggcttttcctcttctccttagattctcctttgttctttccctctaccatccccccatttcctgtttccctcctcccctgtaagccctgttgttgtctttttggagataaaacataaaaggatcagcttttagtcatgctccttcaacttataaaatgtaggttgcctaaattatgtagtacagagtgaggataaagaaaatcacagtattgtaacacattgcctgtaactgctttgcaaaagcaaacgtctcccacgaaatcttagaaaggtgtgtttgagggtgtaatcttggcttgtggtgcaagggagcccaacttgtttttcaagttggtcttgaataagtttgttctttctggaatgctcgccatcctcagtatgacagagttcgcttgatgacaaactcttttactctcctatacataccatggccactgaactggtttgtttatttgcctggggtaaatgattgaaacacattcccctttgcagtggtgctcagcatttgatagatgattcttattccccaggctccttcatggtgatgccaagcccaagtctagccttccagtggcccctgaggccacactgtcccctccgcaacaaacactgagaaagacacacactctcttgggtgtgcacgtagtttattgagctcgtgggctctccgtaatgctgccccactatgcgcatagtaggagaatccgatattggcagaataactgggtctatgtacataaagtagaatgatcgaggctcgatttcaatttaatttgttaatgaaacaagatggatcacattttcccttcccgcacacctctcgggctgtttgagatgaggcacaattaatttatttgtactgtctgtggaggcgtatgccagctaatgtagtgcaagagcttttatctttatgtttgtaatgaagaggggcaggccgctggcaaattgacaaggagtgctgatgactcatcctctgaatgcgagtgctttcttctgaaatcataaaatgcgcgtgcacacgcaagcctagttcctgtttgaaatggacagaacccctttgggaaagttcaggtgcctttgaaacactgcaggggaaagaacaggccagtgaggctgtttctccggctccctggcctgtcttgagggcagaacctcctgctcagtgggggccctactctgggatgggaattcccatcctctccctgccctctcctcctcgcccctcctttccttggaaggctggctcctttgtactggtcttttgtgctccagtaggcagccttccccacctgccaggccaggtgcctggttcacctggcgaggcctgtgcttccggggctgctccctaaccttgatcctgggcagtgccctggggctttgctttatgaggctgtggattctggggcctggttgattttagcctgggagtacacatgggattcctctggcctttgcttgagttccccaggcctgggcttggtggtggctgtgttgtcactctgttgatatgcctcagaagaaatagtttacacagtaactaaagttggtttggccctttacagtgtgtaaggctttctggcattaaaacaactctgaattggatatattgttaccccactttatggatgaggaaatcgaggtgcacagaggttaaatggaatgtccatgatcaagcagctagccggtggaaaggtagtggggacaaaaccttggactttagagtctaaaacctgaccttacaatttctttataacattcattcattaaggacaaaatgaaactttttctgcataagaaatatataaattctcttcaagagtcatgtgagagtttgacagcggactagagtgactatggttaacaacaacgtattgtgtatttcaaagtaactaaaagaaaggacttgaattgttcccaacacataataatgataaatgctcagtgtgatggataccttaaattccctgacttgatcattacatattccatgcatgtaacaaaatatcacatgcacctcataaatacgtaaagtattacgtatcagttaaaaaaaaaattaaaaaatatgtgagtgaatatacagatttctgtagttcagtagaataacaggaaattcacaggatgctttctggagacttaaaagcaaaatgtttgcagtggtctgagaaagaaaccctgaagattgtggtctaagaagttttccttcctgtgtcagatgcctggtcgagctggttgtacaggaaggctaagtgcatatgtcccagtcagtcctgtcacccgggtgtaagcaacacaaatcactgtgcatggttttattgaatttcagagccagaaggaaccatggagattttacaaatgaggaaactatggcctagagtgagagattttgtgttgggaagaattccattcatttacccaaccatccttccacgcgtccaacaaatatttattgagccagttttgggctgggagataaggcttaggctgtgaatgaaacaggcacagtcctgtcttcaaggaacataaaatagcagatgacacggctgagcaggaatgagcatggcatggtaagggcagtgatgagtgaagtcagggtagcttgaggcacataggtggggcacataactattggagtgggagaaggtagttagggaaggtttccttgaaagagtggtacctctggtgagacttgaaggatgttgctgaatgtcattctaaaaatggagaggctgtgttggctgagaattgggacgtcataattctcaaatccaactgaagttggtaaaaggttgtatgtgcttggagaccgcagatactaggctctgagacttaaatgcatgtaagaagtggttgctctaggcctgtgctgtgcactgggggagtcaccaaccttgtgcgctattcagcactaggaaggtggctaatctgggttgggatgtgtcataagtaaacaatgaccactgaatttcaaagacttagtatggggggaaaaaaagtaaaacacatcatgaacaattttgggctgggcacggtggctcatgtctataattccagctctttgggaggctgaggctggccaattgcttgagcccagcaggggcaacatggcgaaacctcatctctacaaaaaatacaaaaattaaccaggcgtggtggcatgcgcctgtagtcccagctacttgggaggctgagcctggggaggttgaggctacagtgagctgagattgctccgctgcattacagcctgggtgacagagtgagactctgtttcaaaaaacaaatgtataattttgtttatattgattataagttggataatttttggatgtgttgagttaataagttattgaaattaatttcacctgtttctttttatgtctgagaatgagtcagctgggtgtggtggctcacaactgtaatcccagcactttgggagcctgaggcgggcagatcacttgaggtcaggagttcaagaccagccaggtcaacatggtgaaaccccgtctctactaaaaatacaaaaatcagctggacgtggtggtgcacgcctgtagtcccagctacttgggaagctgaggcaggagaattgcttgaacctgggaggcggaggttgcagtgagccgagatggcaccattgcactccagcctggcgacagaaacaaaaacaacaacaaaaaatgagtctactagaaactgtaaaatgacaactgtggttcacattatagttctgtgggtggggatgctggatggagagactgacgcaggagaggcagctccattgttggagtgagggggttttagaatgaagagctgtgaatcgggtcctgtgggccctggggcatagtctgtggtaggcgcttcgcatctctgaaccttgctgccctgtttctgacatccccttaactaacacccatcccacagtggggactgaggataaagtcagaatgcctaggaaaagcattttttaaaaatattaagtatgaagccattgtgatccatggttctctttgtaataaaaatttgggattaaggccatatataccatactctgtactgtataccgatagttcaaaagacagacaagaaacctggccagttataaaatagaaggtcgaagtgtgggaaatgcattcagcacagaatgaattacagagtgggagtggatctgtgtgagatgccgtagataagaaaattccttttctgttgcacttggcttgctctactctaggaattccctcacccttacatgcaagtttgtatccaggctttcatagtccttgttccttgttttgtttagtctccaaaggccaacaaggaatatccatatctttttttttttaaatcttcaagtatttcatattgtattcctgaaactccacactcattaaatgcttgaatgaattgccattataccactgtttcctgaaaacctgggtgtgtcaggcatctgctgggctggtaggatgatgatgggcaggacacagcccctgccctcaaggtgctctcagttgggaatgagacagaatgcagtgtgaccaagccgtagtagaggtgagcctgaggactgtgggagacctgaatagtgttcctaactgctaaacgtgatttaaaggatgactgagttaaagacagcaaaggagggagctaagggacagttgtagctgcctggagtgcactctgttgtgattctcttttggtcagtgagactgtggatctgagtttgcataggatcctgccagtccccaggggtctctaacaccgtggcaacattcgatattaatgttgcacctgtatattagttacacttttcattgctggtttatgtacttcaaaggtgtagcacacagatagccctccctgatagagaatgaccccggttagttggaaggctctcagaggaccagtggggcagagacaattcggcagcactgagcagggggtatctgaggggtataaggtagctgtgacctggcatagagttggcaggcagacagtcatttcagtgggagatagcatctgatactcatcccttcgggctagtcttgtaatagcggcagataaataagctgcctccagtgtgtttccagaatatctctgtctgcaaaatgtctttgaggagatgtttgacttgcaagcctgtggttgataaaataaatacattttaaaaatgtaaacctctctgaaagaggttttagtcttttctctccccagggaaaaataaggcccttctttaacctcttttcttccctaagtgtagaattcttgccatgctttataagaaaaaacattttttggaatgtagcacctgtagaaatataaaggggttgtgcccaaaccattggaccatggctattgtgtgggtggtttcttggatgttttgtgaagaggtatcagccctgacacctgcaaagctggaggagctggactttagaagtgcttacattgtttttagctgaattctgagggcaggcagctgtaatgagtgattctctctaatattagaggagccttgccattcagtgacatctgctagaacaggacttggtgcctggaaaagtacctcacacaatgtaggaacttcatatatagttattgaatgagtggataactgaataagtaagtgaatgagtgaatgactagggcccttttctgggctttcagatcatgtggacgagattccccaggcctctctcttgctgcttgagggtagtctgtgcaacagcagcgtcagcatcaccttgttagtgtttctgaatcctggacatcttgttaagcatgcagattctcattcagtggatctgggacagtgtctaagaatctgcatttctaagaaagtcccaggcaatgccatgctggtctatggactacacttgaagtagcaggggtctgttagggttcagtgagatcatcagtaagtctgtaataggtgctcagcgtgcactagggattgtggagaaagatggaaacctaggttctcttgttaaaacttgtaatcatggtgaaaaatcaagactcatccttataaactggagaaaatccattcattatattgtgtggtatgataaatggtcaggagaaagctagagagaggaatgaaggaccttgtggagatggtgcttgggccatggtgtagaatcatgagatgctagcattaaagttgtgtctgcttccaaccctgtgtgatctctaagcctccctgatggttggctatccgacttctgctgaaatgccctcacgatagagaatgcactgggtccctaattctcaaggcatgttgctctcctcatatcttatgagatgccctgaggaaagggtttgcccaggtgaataatgcctgcatgtgttgcttattccatccacacgctgcagattcacagcgcagcatattaaaggctttgcaatgcctggcactaagacagccagtttaactttgtattacctaaggtaactgggtctaacataggtgaccacaacttccctcctgttttattagtacttattaatacatgttagcaagcctgtatcaggaggttcatcatactgagttaatacaggactcatttatcactcataaaacatttattaaacggccatgacgtaccagtcgctgttcagggttatgcacggaggagtaaattgtctcttgcttgtatagcactttattgtttacaaaacactctcccaggctttgtcttgaattgtcagcagaaccttgtgaggttgtataaattttactgccatttcatagttgaggaaactgaggcttctagagattaaagtgacttgtttaagggtatattctttccagtggtgccattgggatttgaaacttttgattcccagttgagtgttttttttttttttttttttttttttcctaacggtattccatttggctccagtttggtgagagaaccgagagaggtaggtcttaaaaacttgattgagaattgaacttgtatgagagaaatagaggtgttgtggtttctagagcagcgatggctcaagcagtgctgaaggaattggagtatatagattagagggaactttaaaggtctttcaggaggagctaagcctgtactccatgactttatggaggcttgcctacagtgcttttctacatagctctttttttttttttttttttttttggagatagagtcttgccctgttgcacaggctggagtgcactagtgcaatcatggctcactgcaacctccaccttccagtttcaagtgattctcatgcctcagcctcccaagcagctggaactacaggcacacaccaccatgcccggctaattttagtattttttagtagagatggggtttcaccatgttggccaggctggtctcgaactcctggcctcaagtgatccgcccgcctcggcctctcaaagtgctgggattacaggcatgagctaccatgcccggcccctttcctacatagttctaacgcatcctggaggcacagatcttttgatgaggagcttactacagcaaaggccagtttatttcacttatacaccattctcttatgttgagcttagatagggtctcttagaatctttatccattaatctgaattccctacctctgctggaaccatacagcacaagcctaattctgcttttcatatgctagcccatttaggttttttcttttgaaaaatctaaaataatttttcttatcagatttgcagtatatgtccaatgtgaaacaatgagaaaatgtagagaagcaaaatacagagaagcaaaaactaaaatttagaactatccgtaatttcaccactcatagattattagtatcacactactacttagtcttccaaagtattttcagtagtttttgatgtgggtgtatattgtttttttgtatgtatgtttttttaaaaaactaaattaaccatatatttggggataatattttgtacttttctggtaggtggaattttattaatatctttaatatcaataaatacttactgcaattaataacaattttaaaataggatatataatttattcccgcttatcagatattttgtcagttccttctcattttttggcagttataaaccatgctgtaataaatatcctcataggttaatttctgccttagacttctttacctagactataagtcgaggtaaactgtttccattacctattcctagaaataaaaaagtaaagcctaagactccagcctgaaaatagctccatggccctcttactcattctctagcctcactgtccccatttctcttaggatatggctttgtgcccgtttgctgtcttaaaatctgctcactttaaaccatttatctctctacagtctctgggatccagattggagatcctttccttaccctgaatgccacatttctaatcaggatagcctgatagtgcgttaacttttacagggccttgtcacactgagtcattgagcttgtgggcaacccaatcccttaagtctctcatatgatcttctccatcctatacttgtgagttgatttttttttttcagccctaagtgcatgacttgacatctatccttattaaatttcgaccttattaaagtcagctggtcattatatcctttgagatagtatcaggaatagactctatcatccttcatagtcactatcccttccaactcccagtcacaggcaaattccagtgtcaaatgattcagcaaatcccagcaatcatttctatctctgtcttccttactggattgtaaattttttgaggccaagaccatatcctattaattctccttaaaaactagttcctacttccattttgtcacatgtgacatagcggatacccaggaaatgttgccatgtgaatatatatttttttgatttaactctggggatgagggcttggtggtggtgggtatcacagtggtgaagaatatagagaagtctaggctgggtctcttgaggagcttccagtgaggaggaagagacaaaaaactggccagaccatgggtaatggatgtagtaaagagaaatttaaatactcctctgagggtactcagttgactggaggcttgagctaattcttcagatgcatttcgatgtcctccagaaaggcagacagtggaggaattccttagtggacagttggtgaatgcccaaggctgtgaaaagtcagagttgggactaggggagtggaaaaggagatgatgtttgctgggagagttgaccagaaaccagccacccagcttttgagaattgtgttgaatagtgattgcatagaatggtcttatctgcttcttttctgcgagatatagaaaaaagattaccctctctttttctttttacattattgagcttgaggcttgcaaagctaatacctacttaggactgattactcttagatcagaggatgaactgaaaccagaattcaagagctctgatttcttctcactctgtgagtacctttaagccagattcatggtatgaaggcagcagcatagcacctccattgacccacatgggggcctgccttgggcttcatcagccctttggagtctcagatccctcacctgttaaaggagagtaatactacccacttacctttttgggttgttgtgaaacacacataagacagtattaggagaagtaaggtctgagggctgggctttggacccagcggcccctaggtagaggcctgttgaattggatgacagtgaactttgcagcatttcctaacctcagaagttcaagagcaggagcctgagtgttttaggtccctggtatggctgtggatttccaggcatgcagcagctctggggcccctgcttcctacccgccagtggttccagctctttgattaactgaaagggaaatttttcttgaggaagggaaggaggtttctttgtggcccaggtctagccatagggaatttgaacacctagagctctgtcccagtggccttgggaatttaacagcttcttcattggtggaaccttggttatttgtgaaaagtgagcttgcagggttctgaggtagacacttaattgatgtctcctgcctcctgcctgtgtgcatggtggtatctgtcacacttccatcagccacgagaaggtgagtttgtatttctatatagatgcatgcccttgtgcatgcttatttaaataacacttgtttgtgtgaatgtatgtacatatagtctagtgccatataatgatgtttcggtcaatgataatcatatgtacaatagtggtcactttataatggagcgaaaaattcctattgtctagtgacatctaatgatcctgactctgtgtaggcctaggctaatgtgtttgcttgtgtctttgtgtgtgcgtgggttccccacctcccccgccccctctaggaacagggtcttgctctgttgcccaggatggagtgtgatcatgtgataatagcttattgcagccttgaacttgtaggctcaagtgaccctcctgcttcagcctcccaagtagctgggactactggcatgcaccaccatgcctaatttttaaattttttgtggaggtaggatcttgccatgttgcccaggctggtcttgaactcctgggctcaagagatccttttgcctaggcctccggagtagctgggattacattgtgagcccctgtgcccagttatgtctttgtttttgaaaagtaaaaaataagaaaagaaaaaaaattttaagtagaaagcttatagaaaaagacataaaatatttttgtatagctgtacagtatgtttgtgtttttaagctaagtgttattacaaatgagtcaaaagttaaaaattaaaaaatgtgtaaagttgcagtgagctaaggttattttataattgaaaaaaaattaaaaataaatttagtgtggcataagaatacactgtttataaagtctacagtagcgtacagtaatatcctaggccttcacattcactcaccactcactcattgactcgcccagagcaacttccagttctgcaagcttcatttatgggaagtgccctatgcaggtgtaccattttaatcttttataccatatttttactgtaccttttctatgtgtagctatgtttagatacacaaatacttaccattgagttacaattgcctacagtattcagtatagtaatatgccgtacagatctgtattctagaaacaataggctataactgtaccaaatagcctagatgtgtagtaggatataccatgtaggtttgtgtaactgtgctctgtgatgttgatgtacgatgacgaaattgactgacaacacattttgttaagcaacatgtgactgcacataaacacctgtgcattcataggcaatcacaactgcatatactgaaacacacaaacacaccgccatatatatttttaaagaatttgaaagatctaagatgatattaaatgtagtttagtttacttttgtgttgatcaagtgttactaagctgtaattaatttagtaaaggaaattaaaatggggatgtggggaaaatgtgactctgcctaattgacaagaatctggggccgtccagaaaagcattagggccaggcagaagttgaaacctttgggaagtctggcccaggactttaaaaatgttttttccgggttagaaatactgagggtttccattctaaaggatgaaaaggatcttctcctttctccttagctagccagtagattctgtcttcctcttatgtcctccagttcctttttggttcattcactctgagtctcgtctgaataagcattaggggaagggcttcctggaggattcgagaagggcaaggaagaagtggaaaaaaagaaatcttatcccactgctgtggttctttgtcatccctggtccctgtccttggcagaatcacacagctacaaagtggtggaatgtgtattccaaccagacctctgtgtcatgctccctaccaaactcccaactctttgggctgatctctgcccgccctccttgtcgcctttcctggttcgattttttttttttttttttgggtgcttactgtgtgctatgcactgttctggattccggggttatagctgtgaccaaggcagacgtatgcttgacatatgttaaccatgaggcatgtatcccctggtcccaccaccactctgctccccatgatttctatacatatatctttctatcacaacagttactgggttgcattagagttatctcttggtgtatctgcctctctcactggactgtgaaatctttgagggaggagttagttacttttcttcatctctccatcacagaaccctgcctgaagttggctgcatgcttgtttaaggctaattgaacaaatgcttgcatgccttttatgacacacaactaaattgtgagcaatccaggtacctaccacttctgtgtctcagttggtccgacagaactagtacataataggccatgttttatcctccagctagacatctagagaagtaaataagccttcaagtgcttcatcactatgtgtgaattgtgaagaaaaacttttattaaaacgttaatatgattgtgacaattgtttactctggcaagtagtttgcctcttggattcctctctgtgaatctgcccataatgtcctgaaattccaaatgggtccttttctcttcctctcatttactatttctattcaaaactggaatatgtggacatgtgtacagccttttaagaccaaaggctttacgttttctagctttttgttttgttttgtttttgtcattgccctacctagaacaaacttcaggaaagataggtttgtacagtagtggtgtatcttaaggtaaaaatgaattcaattttttaaagaaaaaatagggatttaaaatgttatttgcatttaagcttttagatattttgctgaattcaaaaaattattgtaaagtgggatacaaataatcacctgtcctcctttgaagatgcaatttattagtgattgtctttaaatctaaaaaatgtgcgtctatgaatatttattgtattctaagtttcagttgcaggcataatccttaaagcttgtgaatgatgcttgaatatattaaatttaggatttatatgaaacttaatggccttatggagtgcagtaggctccagctggaacctaagcttttgattcttatccattcacaaagaaatacaggtaaagcagaaatttaaaaagcagagaatgtctccttgaaatggccaaatgaatcttctctttttactttaaaaatttacctgtaattttcttataggatctccttttgaaaagtgccttttaaaatagctgggcagaattgtaataccatctttttttattttgttagaaatagtcttcttctttggaaacaaaaatggtgttagaacatttgtatctatatgtatgtattaaatatagtcaataatactttatgggacttgaagaaaaatttaattcttgggcagtccagctgtaagccaggagtctacttgttctgttggacaggtgaatgaagtagaaatagaatattaatttactttgagagctatctaaaaacgtcatgtttcaactctcttgttttcagatgaggagacggaggcctaggtagggggaaaaaaggaattgctcagttacattattgttgtatcttatcttacctagcccaagttaaaacttctcagagtcagactgtgtgtttatacatccctatctttgcagttcacataagtccttaataaggatggtatgactaaaatcaatgaaagactaagcaaaaaaaaaaaaaagtaatcatctcaggtcctcagatatcttttacctgtgatatttcttggtgaatgagtaagactcaagaccttaggtttgtgcaaggactttgcttactgatggagaattcccagacagctcacaagcaagtgtgtgtcctctacttacaactgtcccttgtcatttcagcattacctgtttggagctgttccgcattgggtttgccctaaagctaaatttaagtcatgttggcagtcttttgtgcttttcagttgcagctctatattctggcagcttacagcttgtggggctcaagtctggatgtgcctagcttatgcatgccttttagtgtcactcttaccatttgcttggtaattggagggaaaaaaagaggaaacattttgctcagtagcaaatcaaaaattcttttctcctatgtgaaacataaaccaagagtaagggtggaggtgtatatagagaagcatcgtaagggtgatgtattagtccatttttacgctgctgataaaggcatacctgagactgggtaacttacaaagaaaaagaggtttaatggactcacagttccatgtggttggggaagcctcacagtcatgtcagaagacaaagggcagcatggcggcaggctagagagaatgagagccaagcaaaaggggaaaccccttatataaaaccgtcggatctcatgagacattcactaccacaagaacagtatgggggaaattgcccccatgattcacttatctccatctgggtccctcccacaacatgtgggaattatgggagctacgattcaagatgagatttgggtgggtacacagccaaaccatatcagatggttaagtaatttatatggcagaaatacatagaataagaaatactgtgcatgtaccagctgccttaaagcatggaaaatggagtaggggaagaaaatcaattactgccccgtaccttctgagctgacccctaagtattgataaaaatttagcatcaataaatatttagcagccttgaagaatgttttctaattttagcccaaagaataggtgtctgacaaattgatcaaattgcaatttaaacttctgttcctgtaaagaagaaaatactcctttgatatcaagagaatttgaagaggtggcgtgtctcagcccttgcatcatgtttgacacctgaatcttagccccgggataccagaaggcaggcacagaactttaactctgtacatgtgtagattctgcaaatcaccttgtccacatataggatctccctttttctagtagaggatgtggcaagaatcttcctgggactcatctgtagttggatgcttttcctttcagtttcagatgaaaaaatctttgaattttctgtatttacttgccttgctaatcactccttaagacagcctggcatgtgggctctgaaaatcagagcagtattccagcccctcccttttcatcagttaattaattaattctatatttattaaaggtgatgtgtgccaagccaggtcctaaagacacactccagtaagacaaggttgctgccttcatggagtttgacactggggagatagacttgttgatgggcagttggcagaggtgctctgatataagggcatggtgctgtggaaacaggcacagggcaactcagcctgacataggtatccaggaaggctccatggaggaagtgatagctctgttgaaatgagaagatggttggaaagatacaaggggtgactctgtgtatgtgtgaagcatctgttggaatatgagtgctccagcactgagagttatgtttaggttacactgtgagtataatttgacttggtctgattgctttgctttgaggtctcattctttctatctatctatctatctatctgtctatctatctatctatctatcagtcatctatctctgtcatctatctacaatctttttaattgtgataaagtacacataaaagttaccatcttcatttttaagtgtacagtttagtggtattaagtgcattgacattgttttgctatcgtcaccaccatccatgcacagaactctttttatctgcaaaactgaaaatgtctattaaacaagaactctccattccttcctcctcctagcccttgtcaaccaccattctactttctgtgaatttgactactctaggtaccgcatatgagtggaatcctactgtatttgtccttttgtgaccggcttaattcacttagcataatctccacaagatgtattcttgtcatgggtgtcagaattgccttccttttcaaggctggataatattcaaggtcccattttattaaaacctcaagcatatgtgaaatattcactgatcaacacattaacgagctctctattccctttactgataagtcattcatgcatttgtccctctctccctctgttactgattacatgttaggtgccagacatcgggctagttgctgcaaatacaaagaacacctgtatctactccccatcccaaatattggtccatcagggagagaagcccaatgaattattaaacagtattagtgaaagagtagttgtatgtataaagtactgtgggacttaacaggtaacacaaacaaaagcttcatgggaaagccaaataaggctttaccaaagaggtagctattgaatcggcctctgaagtatttgtgggaactttgtaggtggcgaggaaaggcatttcagataagaggaacagcataacagtggcttgggagtcttgtctgtacacataggcagtcttatgtggtggttatcaattaaactctggagtcagactgtctagatttaaatcctggctcttccacttctctgagtgatgaggcaatttattttcttaccgtgccttagtttcctcatctctaaaataggaataacagtagtacttttctcatagtattgttatgggtattaaatgagtcaggacatacaaagtgcttagaacagggttctctagaagtgttagctactgtgattgattattgctagtgtaatgttattgctagtgtaatgtttgagggaatatcaagtcatttggtctacgtaaaataggatataatgtgtgtatgtgaaaattgtcactagacataaagttggtgtattagtctgttttcatagtgctatgaagacatacctgaacgtgggtaatttataaagaaaagaggtttgtctcacagttctgcttggttagggaggcctcaggaaacttataatcatggtagaagacaaaacaggtacatcttacatggcggcaggagagagaagtgagtgccaagcaaagggggaagccccttataaaaccatcagatcttgtgagaactcattcactatcacaagaacagcatgagggtaactgccccctgccccgtgattcagttgcctcccaccaggtcactcccacgacacatggggatcatgggaactacaattcaaggtgagatttgggtggggacgcagccaaaccatatcagttggcggttgcctcggtggatcctgatgataaaggattcaagtatccccatatctgtgacttctaagctttcttcttgtattcaagggcttgaatgtctgaacttgtatctgatgtttacttaaattttctttttaaaaatattggaatcctttcttaaaaattgcaaaaacaatggaacattaaaaaaagtataagacagaaaactgcaatatcactgtcctaacttagtaactatttcctttttattttcattttgtgtagctacatgcataaaactggttataatcatgtaattttgctttgcttttaaaaattcatattctatgagaaattttcccttatgttttagttcattttaattattcttgtaaatgaatgcccagatttcctttgcattcatgtactgttttttttaagtcattctcttcttcatcatattatagttggttttataatctacatctttctgctcataatttttgtcttctaatgaattttctctttttgataaatttctagggttaggattgctaggtcaaaggatttaagccttttgaggctcccaataaaggtagctaattggatcttcacatccacaccaccagcagcatattttctatgtcatattcactagagatgtgattatagtctttaaagtcttgctgattaagaggtttaaaataaccccttgagtttgcttgaatttgccatttttctccctcctagtgatcatgcatattttcccatatgcttattctgctctgtaattgtctattcatctcctctttctggttgtgttcttgatattttccaatataaatctggattgtttatttaccttattagttctgtgttggagaaaaatgcaggttcaggatattaaagaggaggtcaaaaagtcttttttccccctgccttgcagtagcaaggctctcatccttgcagttgtggttctgggaaagcagaaagaagcacaagcttttgccgtgtgccagagctcctgggatcacagtggccagagtctgggctctccaacagccttgtttttcagctgccttgcttttcagcagaaaaatcatgtggctgtctgttacctcagctttaattgtgtttacactttgtttagagggcctggcctgctccttatgtcccacaagcacctgatacagagccagcacacagtaggcagtttcttttcacccaccatagatcagaggttggaatgcacctttcttgacatcttcatctgtctcctgtcccctttacagcatgactgttttaagaggtcttgtagctattctttgattacctctagtgatgggaggcttactgtctcacaaatacatttagactttgagttcaaggtgtgatgaacctgggtttgaatttcaccttgaccactgactagtgacatgattctggacaaataatatttctaaacttcattttatttatctgaataacagagatagtaatatttctacctcttgtaattgtgatgaggatgaagtgaaataataaaagtaaagttctggactctaaagaagtcaaactcataaaaagtagagtagaatggtggttaccagaggttttgggggtgagagggtgggtagggaaaggggagcttgatcaaagtgtgcaaagtttctcttaggaggaataaattctggtgcataacatggtgactgtagttaataataattatggtatatttcaaaatggcaaaaagaagaatttaaatgttcttatcacaaagaaatgatacctattgaaggtgatggatatgttaattcatcagattggatcattccacaatatatacatgtatggaaatatcacattgtaccccatgaacatatacaactattatttatcattcaaaaataaaactttaaaaaaggaaagtcttgactcctactcctcacatagtgtcaagtaaatattagctgtgaatattaattttatttactgatacaaggtgtatttccttaaacttttgccatctattagaatctcagtgatttggcaaagaagccatagctcagcctccagctcttataagtggcctggaatttggagtatattcttctgtaatggagatgtgggagggtattgtctttgagctgattccagagtggcccgtggtccagcggtggggctgggcagtgctgtaatacgtccaggctagcaccttcttggttttcagagtctgattatagagacctcttgtttgtccttctctttcttggctggtgttcttgccttggcatccctgatagaagatagacaaaaacatttagaagaaatgaaactctgatccacatactagttatctgttcccctccgcagaaaagggcttagtttagcaaagagaggtaaaggtagagatcatacttctaaattcaaagcaatatatgtcgagcttattgacagcactcaataaatgttgcttttattaatattacaggtaaaccaatacgagggtggcctgggcatagggtaggcaggacctaactcttctcttatccccagactttagtatttcagtatttttgatgagaatctgattaatgatctgaaagttcctcaaagtctcctgtgatttaagcagatagcttttatccttggggaaccaatataattagtattagaactaggttcatgaatcttaagattatggagttcatctttgtccagcccatctcactatgctttgtagagaataacttagcagaaacagccccctgctaggcatcttggtaattgcttcctaataactgttaatttttggtttcacaactaaaatattagggagtctggtgaatttaagaaatagtgttgaagtgatggcaattgagattttaaaagttgcctgtatgacaaatgaaacagatttaaggtgggggagaaggttacccatgaacggggtggtattgaaaatatttaacagccagtccagaagggcattggcacagtagaaactacactgcaggccccttgatttgccggacacctatccttgttgaatagtgaggagaccttgggacactacgaaggggacagagcattcactggggctttggagcactgactctttacacgctgttatggaagtatttcagtattttaaacaaccagtatagttgtaccagtcgggtactggaggtggtgtgggagagtgtctgaaactggcaggtgttcagaggtgttgatagattcttcacttgtcatctttaattcattgctgagaaaactttagttgcgctaggccagattatccccaaaggcgtttggacagtgtcacattagaatttagggctatttagaaagcactgagacatgtcctttttttcagaaaatactgtgtatacagtgtgagaggcgcacagcctctgtcttcatgaggtccccagtctatcggtggccttgaaatttttctgctctttgactgtaggctaggaatctgtccttgagaaatgattacaaggatgtttgctacaacagtgaaaagttgggcaaaatctaaatgtccaagcatgagaaaagagctaaataatagcatatccaccccccagaatattatgtacctcttaaaaatcacagacacagagaagttttcaggactcaggaactatttctgactgtgaaatgttaggtgggcaataaaaacctaaagctgtaaggaataattagtgtaagaaaggacatcaaaatgcatgggtagcactgattattatttgatggtggaatatgggtaaagttaattttctttgtggatgtttctatatgttccacttttggtcatctatgggtattaacttttataactagaggtgttccagaaatatttttaaaaacccgattaaaaatttaaaaattattgtataattagtgagtgggtgaacatgttggatttaaacttggagaagcacatttggaggttgtatttatctcttgtaaagaaagctgctgactcggtgggataaaaataagaggcctaggtcagcctcctcgcgttgaggcacctggctcccccaggcttccagactgcacgggttctgagaggccctaatgggcttgttgaaaggttctacttggcttcttattaatgtccctccctgagctgtgctctgctctgctggctaaccttgtcggaaggttacctgtggctctccagggctcggctaattttaaacctggtcagggagtgtggtggcattgctctgcagagacatgaacagctccctgggagacactgctggggaaagatgagtcgagtctacggttttttctcatcctcctgtaagtgaccaggcacgctgaacaagcaaagagagctgggataataatgagagcttttatggtaaaaaccaggattattaaagatcttttagcagtgtcaatgctggttgataattgcacggtgtgatgtgccctgcatgaactgtgtcaattctggccacactaggagtagcaaggtgaatgagatcctctcttctggaaactagactttggctgcttttaaagacagaatgaaactacagtgaatttcactacttattcggtattattttaaattttcaggactcacactccactggtgataagttcttctatgaaatttttgatcaatttgattgggagagggctgtttctgaaaagctaaaaaaaatttaaaaacacagaatcgctgcctgtctgcatgtcaactgctggtctggctgcctctaaaattgtcattttaaggggtttttttttttttttttggactgtttgcagtggagtcttgttcagaatacggctgtgtcttataatacgtgcaaccctgatattgtaaaatgaaatataaatcaataactgcaaaataaggtgacaattgagaaccttttccccatcaaaattaattgttaaaaaaaaaaacttagcccatatttttctgcttagaatttttttgtccatctacctttcaccaccttcaggttgggaatctaaatgtgcctgttagagttggctctgtcttctcctgccaaggcattcacagcttcttttgcacgtacgggattacagtgggaaacccattccacccagtggatggcctggtcttgaggcttacctgcctggcttaaggaagtgcatcttttcttgtagctgggcctgtacccacccactcataaaacagttgctaggagcaaattaaagaggcattgtgtgtggagtaaaccaggatgaaagaacaatggatggagaatcaataccctcctaactccctacagtgattgaagttaactttatttgaaatatccaggctgggccagagcacatcaagctagcagcattcttgcacgagagtagcacgggaatgaactttgatttcattttagggaagaagaaaaaataatgaataaatgctttttattagccttttccctccccttgaagtcctacctcttctacataaacctaattagcttcgacatgtttggatttagttttgagaaaattaaagctgagtaatattaggaatttgttcagtgggaatacttgttaaaaccttcattgacccaaatctgacttataaatggtattaaataagcaaactaaagaaaacttcatccccgtcttgtcctaaaataatatttttaaaagcatatttagagttaagtataatataaatatgttaccctgattaggtactaaatgaggtactgaagaagctgtagtggcggtattgagtgtagttatgaatttaatgttcttttcttaaaaaccaagtcctctttgacacatgttcaaaggtcttccttttttttcttctcctgagctgctctttctcacctctggggcacttccctcctacacttggcccgcatgcgtggtttaggcaggcccactgttatttttgtggtaacctgacactgggcccagcgcagccccctggctcttgtgggaggtgaactggctgagagccaggctgcgttctcccaggatgagctgctgctgaagcaggctgggctgagggctgtgggcaggctgcagcaggggctgggatgccacagaccaggcgggctgggggttcaccagtgaagacctcagactgtgcggctcagcaggtggcaggtcctgcctgaggttaaagaaaggtggagttggttgttgaggccacagaccaggtagtcagggtgtttggaaacctgaggaaggttttgaggccagtgagtctcttttatctcactctgtggttctagtctaaggtatgcctgaggctgtccttgtaattccttagacaaggatgaatttcttaagaatcatcaaaattgtattcacattttaagttaaaataaagcaaatggttatttgttgagctgggctagggggctggagtggggtgcagaaatgaatgggaaatagtgcctacctttgaaaatttgcagtatagcagggaagaaggtggatatattagcagtaattattattattttttaatttttaaaatttttgttttttatttattttttgagacgatgtcttgctatgtcatccaggctggagtgcagtggcacaatcttggctcactgcaactctgcctcccgggttcaagtgataatcctgcctcagcctcctgagtagctgggattataggcacccgccaccacacccatctaattttttgtatttttagtagagatgtggtttcactattttggcaaggctggtcttgaactcctgacctcaagtgatctgcctgcctaggtctctcagagtgctaggattacaggcgtgagccaccacgcctggcctattagttttgttgtcagctatttgagaacctacggtgtgtctggcacagttaagacatactacccatgctcatctctaagcatttagataatatatgcattgactgttgattgagatattctgttaatactttcatggatcatctcatttaatctttacatcaggtggctaataatgttccagttttcatgaaaagaaatgtaggcacaggtagtaagtggaggaatcaaaattcaaactctttgggattctaaaactcagtattctctttatgtatatataactgctctgccatatggattctccagatgtccaaggtgatccctgcaatttttttttttttgagacagagtcttgctctgttgcccaggctggagtgcagtggcgcgatcctggctcactgcaacctccacctcctgggttcaagtgattctcctgcttcagcctcccaagtagctgggactacaggcacccgtcaccacgcccggctaatttttgtattcttagtagtgatgaggtttcaccatattggccaggctggtctcaaactcctgacctcaggtgatgcacccgcctctgcctcccaaagtgctgggattacaggcgtgagccgctgcgcctggtctaatccctgcaattcttagaaatacctaccaaggacaatatcagcaaaagttttttgagttccaacaatctgtcaggtattgggagagccccaggcacctgaaggagtggagtaggtggccggctgtgtccaggcatcttggagtgcgtgtgcagctagaatgttggggttctggatgggtggctggaggagcaggctgagaacaggtgtgaaaggccaggggtctcataatgcacttcagtcctgagtgagtggggatctgctgaatgacttcaagtgagtgtatgatgaaagtcctatttgcattttaggaaaacctttctgactgcgggatagtgtaggagacactcgctaaaaatatgtctcctgggattctgattcaggatttctggcataaagctgggaatctctatgtttaagaagccacccatatcatctcgtataaccaggcttggggactaggttgttggcagtggcgagagtgtggggaggcgggggacagctcagctctggcagagggctgaggcagaaatggtgcggtcctttccttgagacaggagcaaagttagtggggtagagaggagcagaggggatccaggggaggcagggggactgggggtcaaatggacgttcttggtgatcatttagatcaggaggggaggaggggaacctaggataatggccctccttttgggttatgctccagccagtttacctgagaaacatcatctctgagaggaggcggtgggattctcccaggacctgggaatccttttggattttcatggggacttttacagatagatccttaatcagcaatgtgatgttgatggtgtcagggcccactgtgccagaactgtgtgtgtgtgaggatttgcgctggtttgttttgcctgtgggggacttttggcttctgaagtcacatcccctacgtagagtcacctttaggcagttggattgagagggaatctgcacctggaagtctccctgagagggagggctttagtggccatttgtacgtgtaattggaaatggattacattttaattaatctaaggggctgagagctcatcttgttcctctaccagggttaacagaatctgtagaaggatgtagtcttggaaggaaatatattccccctgcctgacactccgtccacctttttccctaaagaaatttgtgtgtgtgtgctggggacccgtagaaaatgtggatttaatcaaggtgtggcctttgcatattttactgaattcagcagactcattttgctggggtttgtcagaggggagggggaggagactgctggctggagagggctcacagcaccctgggccatggggaagtgaaggcaggagaaggcgcaggcctgatgtcagacatgagcgcatcagactttctgtccgtacctctcttggactgggcgtcttgcccccactgaatgcccttacagtgcttgtggacggcttagagtggtcttgtgcccacagcaggtgctccagtaatatttgttcatttgaatgagtggtttaattgaggggggaacagtagttactcacttatcctgcctcagcctgtcttcagctaaggtgccaagattctttctcttgctgaacttgaactggatgtaaaccaaggaccaggtttacattttgaggattgggatggggtgcgggtggggctttaattggcccctgaatttgcatctcaatgtgagagacctgttttgcatctgctccatcaccatgtcatcattaaatggaagattatatttgtcgtttaaagggtggggacttgcttgtgttggtgatcattgggacccagttgacatttgtgaaccggcagtgttgcgtgcttttggttaaattcatgcattagctcgtgtcggcattagttggtgttttcacattggccaaatgcagacgcatgtctctgtataagcatagcagcctggttcccatgttgggctcgagtgtgaccctgttgtcagctcacagcctctctttagggatgaggggagtatgttgagtgcttgaagacagtctgatgagcattcattagaatggctgagtgatcaggtaccgagcagagttaatcccatggctctgggttgtttaaacaaacacacctttataaacttggaacactgaagggagacgtcacattgtagtatttcagtttatctagagaactgtcctggccttggaccatactgaaaatacttttgatttaaaagttcagattccagatatataacattctctgttcttcaccctttatcttcccaagtagacagacagacagacagacacacacacgtacaccttcaggagttgctcacacactcctggtgtttctggtgttttcgtgctttttgtatgaaacagtccacctttcgtcatggcctatgaggccccctgtgattgactcagcttacattttcagcctctgctctagcctttctactttcttgcttggctctctcttccccacatctcctccactaatacttggcctgtgagtctggattagcctttcagaccagcctaaatgccacctccctgagaaactctcattgatccgagagacagaataaactcctccatcagcaccctattgattcctccattgcatcaggtgacatatttattcacctgttcatattcacccattgactcattatttccggcaaccattcagtcctgttttttggggagcagttgccatgtgctaggcattctgctgaatgccaaacatagaaaaatgactgggctgggtgaggtggttcatgcctgtagtcccagcacttcgggaagctgaggcaggagaatcgcttgaggccagcagtttgaaatgagcctgggcaacatagtgaggccaaaaaaccgaaataattagctgggcatggtagcatgtgcctgtagtcccagctacttgggaggctgaggcaggaggatggcttgagccctggaggctgaggctgcagtgagctgtgatcatgccactgtatgtactccaacctgactcaaaaaaaaaaaaaaaaaaggaaaaattactaaaggcatgggcccaaaccttaaagatctcacaaatcctcaaaggtgagagacgcataaacaaatcattcctatgcggtgagtgagttcagttcatttgtactggctggcaaaggtgctacctgtgggaacacagaggagtggggaaaggccaggtcaggcttcccagtggaggggcttgaagtcttgcaggtatgtgtacttatttgtctcgctgctggagagggtgcttgttgaggacagggaatgtggtatctttatctccatatccagtgcttgggacatatggctgaagggacaggggtgggaggggctctcagtaaatgcttttaccacattaaattgaaacagataattagaaaacagaaactttccctttcatatttataccctatcatgtttcagaatcattttaaggcagcatgcaagactgtaaaatagcataaatagaaggtgggagaaagaatggagaaaaagaagaggatagaggtgaagactaaatgtggacttaggaatgaaaccaaacttgccgaccaaaaccacctctgagcactctctgaggggcctgccagtgtggctcagtgcactttggtggctactgagtaaaggaaaggccaatggcttgaccacgaggtaaaaaacacattgtgttttgtttgctgtagaactttcctttgggatctttgtaaagatcagtctgtgtgacgtgatgagcagcgtcttccacatccttgcattcactctagagacaaatcccattggctgtttcttctaataacccttcatatgctgatggcagcacatcaaagcataattcaaaaaaggcaaatgtattcagagctcctggaataatctttctctaaggtaactggaatcagaaaggcactgaaacagggcagttttttttttttttttttttcatttctttctttttttttaaaataatttttattgaagtccaacttacatacagaaaagggcacacacatcatcaatattgagtcccttgtgtttttccatttgaatgcattggcatccagagccattgatctattgatctgcactgacatgaccagaacctcctaagcctccccacgctgccttccagtcagtactcccaaccctaaagggtggttgctaccctgacttctaataacgtagatgaatttcgttagtgtttgaacttggtatgaacggacgcagacagtatagtatatatttctttgtatcttttttttcctcaatattgcgttggtacaattcacccatgttgttacttgcagttgtcatttatttatattctattgctgtcccatagaactttctgtggctgtgaaatgatttttgtctgtgctgtatgacacagtagccattagccacttgtgaatattgagctcatgagatacaagtagtgtgactgaacaactgaatttttaatcttattaatttacatttaaattcacaaatgtgtctagtgcctactgcattggacagtacagctgtataccattctattttatgaatatgctacagtttttttttttttaagacagtgtctcacactctctcaggccagagtgcggtggcgtgatcacagctcactacagcttgaccgcctgggctcaggtgatcctcctacttcagcctctggggtagctgggactacaggcatgcgccaccaacacccagctaattttttttttttttttttgtagagatagggtctcactatgttgcccaggctgctctcaactcctgcgctgaagcaatctgcccatctcggcctcccaaagtgctggaattacagatgtgttccacagcgcccagcctgattatactatagtttatatgtcctattgttaataaaaatttggctgtttctgtctgttacaaacaatgaaaatataaacattcctatacctgtcttttggtgaacataggcatgcatttctttagcatctctacctgggatttggaattgctgaatcaggaggtatgcatataatcagttttggtatgtagatattgccaaagagttttccagaatgattgtaccaatttgcgctctcatcagttctttgagaattccatttactccatctccttgaaaatccttagtattagtctctttactgtagctcttctagtggctggatagaggtatcacattgttttaatttgcatttctttaataactaggcatgttgaacaccttttcatatgtttatgggccatttggttatgtttcataaaatacattagctttttacttttttttctattgggttgtctgatttcttattgtttggagttcctgtaggatgaaggatatgagtctctgttgaataaatgtgttgcaagtatctactttgtggcctgctttgattttcttaatggttctttcaagaaagcgagttctgagttgtgatttggtccagtttatcatgtttttccctcctgattagtgcttttgtgttcctttaaagtatcctcgactactttatggccatgtaggtaatctgctaagaatccttataaattctttactggtttttttactttcagatctaaagtctatttcagatggattgtaaactattgtgtgtggtggggtcaatttttatttttttcgtatggctatcaatcaacctggctcatgtatcaggaaaaaaatttctttactcagggtaatgcagtgtcacttttgttacaaatcaagtgaacgtatgtgtatgagtttgtttctagattctctaatctgattccttggcctattttcattatctttgtgccagtactatactattaatgactaagctttgcattgaggtttcatattgggcagtttaagtcgttcagctttgattttcttcctcaagattgcacaagagctgcatttattcaaacaggttcattttatttgttgttttatgttgtctcacttttatccagcatcccaatgttatttgacactgtcctaggttgtagaggtcacacaggctctgcctctgcctctgccccggaggagttttatgatcatgttttgggacttagaaatatccatgtgtgatttgggtatgctttgaggatctgtatgctcagatccattagaaatgggtaaaggcagaccagatctgacacccacacaagagaaagtgacagcctgatttctgatagtctagagactatcagacttctgcctgttacaaacaatgaaaatataaacagtgggaaggcaaacaatgtgatgaattgtggttttggttccttaggttgacaggaaagagttttttccttttgggcatgttagagcctagattttggatcctgatgtgagtgctgatgaaatccatttggatccattagatcctgagagcactgaatgtcaggagctgtggttgaaggaccagagcagggcttggccttcgcagtttagctctttaaaatgccatcctgattcaggttttccttgttgattggcttatgactcaatcaggagtgaagtgtggatttccctattgcttctctccccaacccccagaatgcctgtctcaataatttaggatagatggggcatggccagaatgagagaagcatccaaagtcatagaagctggtggagaaggccctggactacttttgtatgcaaagtagggagggccgtttctgatgcagcacaattagaattctgaatcagccaagggggccgcatctgggcagattgctgctgggacctggagtgaggccagtgccaacatatcatttaagttggctgtcaacagactgtgtaacattgggtgagtctcacctggcctttagtaagcagggatgactctccaggcatttacctatagacttccctcttagggagccatttctaatggtataagacccatttctaggcattccatcagtcatgcagctgaggggacttcttgaaatggtgtatatacttatatttatcttgtatgttaatgtctttttacttctacttttgatttttactttatgctcattgtcatttaaaataccgagttataataatcggatggtgaatcgtaccaactaagaaagtgatgtgatccataggttagtggctaaggagtgttgttttcctggtgttttctttatttttagtaagcattatggttggttagtctaccccaagtgtatgttgactccacaggctactggaattggggagttagtcttaaggttttctttgactgttactcctgggaaaaggcttatgagttttccttttgaaatactgacagctccttactgctaacagttgggacgtttgctctcttaaagcaggaaagaagcttctgtttctggggttgaaatgtgtttcccgaggttaagttgtccatttcccagggtgggagtgacttgggctacgagtcatgtcctctggttcacgctcactttgggcatgcactgtcttggtatcaggtctttgctttggaatggtcagataggatagattgcctgaaactgggtctgtggccttgtccttttgaaggagtccactgataaagaacaacaatgatcagcttgactggtggtagtgacgggagaaaggaaggggcaggatttctgttctcaatggctaacagattcattaaggggatggggtgggctattcccctaaaggctggtaatgcagagtggtcccatcagagctgcatagcatgaaatcaatcagagcttttcttgagctgtcacctgggcaagtacttagggctgatggagcggagaattaatcagggattctcaggagggtaatgctaagtcctctaatgggatgcttagcattggggcttggtgaagagatattggcttgttgatgggattctgttgacacggaagtgatttttgaaaacgagaaggagtaattatccactcctccctgctgaaattagagggaacctgttggcattggcaccaaggctcactggctgctgctgtcgttgtggcacatgttgcctcagttctcagcatcagcattcccattccctgagaattctgccctgtctctgacaatgacatactttctgtgcttccatctcttctgtggttgcctacaaaatccaggctgccaatcttcacttgtatttttctcaggccacttgttagcaaggttggctagtgtcttaaatggtaggaaaataataacacaacccactttacatatgcaaaagcaattaaccattattagtgtctgacattcctctcagctgcccacagcggtgagtcaggatcatcactattcattaggaattaattagactgtccttgatgatatcagtcatctacagagctaagaattcagcactgcctacatcctactgtctagtgagggtatagtgtatttgatattcccatagaatgtgcattctgtttggaaaatgactcctagattgaatctctgttaagtataggactttggacaacttatttaggtctctgaacctcacaaggtggggataatactaaagggggaagtgcagcgattaaataagatcctctaggcagaaactgctggcattatgcctgacacctagttctgggagaaggctgaatttggttttgaggtaccagttcactttggaagtaaagcaccttttttccccccagtctttttgttggaggggagcttttctcctatgagagaaatttggactttgactaagattacagtgaccttcaagccatcaaatgtttggttgagttgtccactataaataccattccaaccatgtgattctctttctagaaaccctgaagtggccctcacttctactgacttctctctcctcctgggctattagaaatcttttctcttagtgctcgtcccgttgccactgtctgtatgctgccctttgctcacctgctcactcaagtttgctttaccatttgtcacctcttcgaatttcttccttggccacctccttggcttctggtctttacaccctggctgctccgcctcccatatctctttccctgtagctgtcaccttttggtaattttcttctccagtcatcaaaagggaaagggaaatggagaaggtaaaatatattgtctcaaaagttaccattctcctcaaaataagatttactgatgataaaagattacctcttaaaggactcaaatcttatttgtccctctaacacagaaggactattagttgccaataattgtgattaagaaattggatcagccacccaactcttcgttatttacactgtgcctggcttacagtctgtctccttgtgtcctcctaatttggcgattttctctgggtctcttactactcattggaaccttggccagagtcaggaatgtgaaagtagctgaaacacttccttttcttgtggaaactttgggtgttaatctcagtcatgttgttatcaaagaatatttgtgttttctggttgttggttcattctttttttattttttatttattaatttttttgagacagagtcttgttctgtcactcagactggagtgcagtggcctgatcttggctcactgctatctctgcctcccaaattcaagtgattcgtctgtctcagcctcccaagtagctgggattacaggcgcctgccaccacgcctgactaatttttgtatttttagtagagacggagtttcactgtgttgatcaggctggtcttgaactcctgacctcaggtgatcctcccaccttggcctcccaaagtgctaggcattataggcgtgaactgccatgcctggaggttcattctttctttcattgactatttatatgtcaggtatggtactggcgctagggacagtgtaaatgttacatagtctctgccctcagggagggacactggggtgcaaatgggaggagcaatgacaaaccaactcactaagtttttgttttgtttttttttttttaattttttttttgtgatggagtctcactctgttgcccaggctggagtgcagtggcacaatcttggctcactgtgacctccgcctcctgggtttgagtaatcctcctgcctcagcctcctgagcagctggttataggcacctgtcatcacgcccagctagtttttttttttttttttttttttgaggtggagtatcactctgtcgcctaggctggagtgcagtggcgcaatctcagcttactgcaagctccacctcccaggttcacgccattctcccacctcagcctcctgagtagctgggactacaggcgcctgccaccacgcctggctaattttgtttttgtgtttttagtagagacggggtttcatcacgttagccaggatggtcttgatctcctgacctcgtgatctgcccgcctcggcctcccaaagtgctgggattacaggcgtgggccaccctacctggccatttttttaaatagaggcaaggtttcaccatgttggccaggctggtctcaaactcctgacctcaaatgatccacctgcctcagcctcccaaagtgctgggattagaggcctcacctcatcaagttctgttataggtaaagtctgtgggatcacatggtgaagaatgaataagttggcttcctccagggttaatggtggaaactgaggcatactggagctacaggtgctgtgtggtcctgtgttactcagggggacagagccctaacttcatcccagctcttctcctgtgacctcatagaatattgagacactggcaaaaacaagccataatgatttttttttttggtgatcgttgtgttcaatggcatttcattaattatgaggattagttaaaatcaacccttttacttaagagcctttaaataatctgaagatgggtgagaaactgacattatgagagacccacaggaattaagatgaagggagcagcaaattcctgtgtcctatctcatctcttgttggatagagttggtgtcagagcacctgcattggactgtcttatcccggtcatcccccaggcttttataataaaatgtgtattggttgaatacacatgtgatatctccactgtactcatgttactctttttgaagcctcagtaggttatagtgaaggaattacacatttagggaatgtggttgttgaggcagttaccaggatatttggattcatagagtttgtttttggagtttattggagtgtgtttgggaaaaagttcaggaataaaggatctttcagaaaagtgtttatgatggaaactgaggcacatgggggctacaaagtatacatatttttaaaagtatttccagctgggcgcggtggctcacgcctgtaatcccagcactttgggagtccaaggtgggcggattatgaggtcaggagttcgagaccagcctggccaacatggtgaaaccctgtctctactaaaaaatacaaaaattagctgagcgtggtggtgaatgcctgtaatcccagctacttggaaggctgaggcaggagaattgcttgaacctgggaggaggaggttgcagtgagctgagatcgtgccactgcactccagcctgggcaatagagtgagactccatctcaaaagcaaaaaaaattatctccaacaaagaagacttttctattctctttccttgaaggcattctgtgaaaacggttactaccctgaaccacactgcccataagaatctgaaagctgttgaacccgtgaataaattcagaattagatgagtgttagaaataaaggtgttgtcaccaatttacattttctatgcagtcatttgaagaccttgaagaagaggtcctttgtaaatcagtttcccaaagtaaaccattagaggaagctctctcatttcttcaccatccatcagaaggtacatagcattgtctagagaggatggacttggacataaatgaacatctgttcatagttttacagatgacagagcgccttcactcatgatcttactaaatctttatggcaacccagtagaatagagtccctccatcccttaatcatttttctgtattgggatgaaatttaatttgttatttgcatttaacaaatgaaaacctgagcttctgagagagttattaggttggcacaaaagtagttgcggtagtttgagttccatggcttaagggcgagtaggtttgaaacccacatctgttggagtcttcatatattcccctcccttcctctcctacctcttgccccagtactgtgttctttatttactgaatttagtgaaagctgactccttcacttaaaggatatatatgtatggggaggtaaagatatcagctctgcaggtacagacattgtgtgcataattcactcatttagattttaatattgattataatcaagtgcttgttgctatagattcagaatcgaggtaatttgcgtgacagttggccaattccacacatttttagggttctcctacagcgtggttgatactctcagagcctgtagatacaaggccagtttccaggatgaggtggagtttgagctggactggaaggaacctgggggatggagtgccaggatggttattttggtatccagtatggggagcatttctcagccagccccagtcttgtgttaggaaattctctgcccatatgtaaagtcttcatcttatgatggggttgtaaaaccagaggcctgtataactctgtggattatgtatctggtagtttctggggctgtgtcctggcccattgctagataggtaattccatcctgctgaagtctagttgacgaaaaatggcaagagtctggatacacagggtcttttcctttgcagtaaacgaataaaaacgtgagcatttaaaactggctgtacttactaagtggatagatcaattaatgctagttaatactacattcccccaaacaaccaggaagttgtgattcatacctatagaaataataagaagaggttgtctgcaagactctgctgcctgtctgctagaacagcctgccccttgtggagcagttcaagtagcagaaatttttttcttatattgagttggaatattctttggaacttcccaaagtggatctacatccttcccatgtgacagacagctcttcagaggttgtttagtgtcttagacactaagtgtgcagttatgattcagaagaatcttcccatctttgggctgtgggctgaggctaaaaatgatagaattcaataggaataaatacaaacgcctgcttttagctctgacaccagttgcacaaaagacagtattcagggacaacctctgaggggcaggagcttagaagtttaatggaaagtaagtccacctctgagtgccatttattgggggccactaaatgcattcatgagggtgggcagagggatgatggtttctagtctggaagacaattaggatcctggaggctgcttctgtcatacctaaatgggtatcttaggagagatttgctcccctgaaggatggggtatactctcaaggaatggatgtgtagatgttaaccaggagatgggttttcgcctgataaatggaagcatttcaacatgtcagtatgaagcggggtagtactgagaaggtaatgagttccctgctgttagtggtgttcaagggtagactgtgaccagttgagtagattttgaggggactttaagcactgaatgggggtggttggtgtgttttggtctggagactctggggcttacagttatatgagaacattcttttaaggcagtcgaaggtccctcagtcccttcagccatcccccactgtcctagatcccattccctgctatcctgactgagcactgggcataactactatttatcttaaagtgtggctcctcggagtaaattcatactgctgtgaactgcccagagctcaaggactggcctgtggttttgtgcatgtgtgttgttttggtttgtttttgtctttttttgttgttgtttggtgggtatggtggagaggaagaaggtgggctagccactgctcaaagaattcattcttattctcataatttatctaataaactactttggagcgagaacagactctagagtatagttcagtttgaatttcataagactcttagatcgtaacgaaaaagataatagtttgaattcaaaaggcccacaccgcaggcatagtcaagttcatctggaggtcagtcacaaaatgctttcttgtggcgtaatttataccttcacatttggcaattttgaaagtcctgtgtaaatgtacatatgttggtaagaggtagtaaatattttgctgacaagttctttgaatgatggctcagtagcagcatttaaaggcagacaatcagagggttttttgtgtattttttttttaaatccaggtgctgccaagtctacaaagctggaagggaagaagccaaaagtgcccactagttatagttataccattaattatataatattcatgtgcctcagagtttctgcacctggcatctgttgatatacacaggtgggggaggacaggggcacaggatacagttgggagagagcagggaggaagacagggtgcttgctgtcaggtaacggccctggaatatggagcagtccctggtgccaggtgtggccaccagcacctgcttccctcctgggtgtccgtgttgtaatactgcctggatttgatggggtgagaaggggaggaactgtggccacatgaaaccctccctactcaggcccttggcctcctcttttcgatcaatcctttctctctcatttttgggaggcctttgaattaatgatcctataccttttcaacaaaggaatattgatatgttagtgtgccagacagcagggagtactggattagatcattttcacattgacgttatgccagtttgacatttgtttggaaagcttatccttttatgaccataggttatatacataatttaaggggaataaatctttcagagattttttttggttctgtgatcttcagtgctacagaaaaagaaatgaaatactcccccacagttttcatgtgatcaggaattcagcataggctataagacggagtgctccatgtcaatagagaatatttccacaggtgtgctaggcacttgtggtagatgttgcagggaagtcaggactggggacagcttggtccctacttcaaggttacagtctaggagctgagagtggcaaagtgacctgattctacagggtaaaagccccagagataaatgacataggtccaggtcagccagcattgctgtctcagtagaatgagtatgtgtgataccaaaataatcttcctccttccctccttgatcctgccaccatcttgcatcttgatgatctcatattgggatagtgacactaacagagtttccgagttatgatgccacttgccatggtgaagtggacattttaaaaaactttattttcttataaattacttgttctgctttggagatttgatgatcatttagcaaagtgcccctggtagatagtaggcactcagtaaatggttttcgtatgaatcactgcaaacttgcaactccgagtgagtaccattcttccatataaatttcctctcgtctgtgaagattatccagcttctgcccaccattgcatttctgtgtgggtgcttaatatgatacttagataataaagccacttggatctcaaaattccatattctccagtaggagttatccaagcaaagctggtgactgaaccaaaatcaccactaaagaacttaaccgtgtaacccaaaaccatgtgtatccccaaaaagactgaaataataaaatgaaatgaaaaaagctggtgactgaagaacttgcactagagctagcaagagcattatgtttgtggttaccacatccttatactgtttttggttttctcttctaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaagtggcctggaacactcctttgaaatactacaacctgcagttgtggtaggggatagattgtagctggtcttccagcaagagctgttcattgtatggggttgagtgatatttgtagaattttagtgggtcatccaaaggactcaccctaaactaaaaaggagagtcaataaaggacctttgggaaaaagaaaaggacccctgggcttttcttcttctacatgtgtagtggcattacatcagaagctccaggggtccaggcaggaacataaatagttgcagtggcatgtacagacaccagatggtggggaggaggtcttctgaacacagaccagatcacaaggaaatactgccacttacctctaggtaactgatgtcactaggaatgggggcctggtgctcccgaatcccttgattgcccccagcccccttgaggaagagccagcattctagatgcttatatgaaatctactctttttaaaaagccagcacttttttttttttaaaacaactctgtacaggccagagaaaacatgtatgtgcatgggcttgatcagcctctgaaccaccaatttgctactttgctgccagtttgcagttgaatggtcagacaaggcattagcaccctgggtcactgtcaccatctccccttctttgggggttgccttgaaaggcattctgaaggaaacaccaagagtgccaaggagagagagacctgttaactatttggctctggatgcctagggcagcagcaaggatccacctgccggtctggggcttgcttgctgggtttgggcaccccctaacttccttccataaatgcttccagctgcagacctgtactttttggctgcttaccttttgggaagcagatggcaggtgtagttgcttgaacattctgcttgtctaattgagcacgttgagttgacagagttcgcactgtagctgagtctaaaaagatgcaaacacaaataacctaacctcaaagagaactggctcagtattttacctgaggttgttaacttctcatgggagtgattatttctgaacaattggaagtcttttttgtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcctcttcgtatctggtgaaatggactggggatgaaatatctcagctactatgggaagagtgtttcagggccctagattttctctatgtctggatctttcctggtctcttcatctcagcctggctatttgctttgtgggtcttattttcatacctgaaaatgcagctccctttcttaaaggcagagaaaagcattttaatctttgaagcttctttgaagatgattttattatgggtagtgaagggtagccttgggacactaccttgtacaactctcatttgcttacccaaaaatggtttcaatttaaaacaaaggcatagtattagaaatcccaatggggcataaccactgcacttcatttcccacaggaaatactgggaaaggtcctgtcctttcaggaataaggttttggggctgagaacataattcaaagcacaagttaacttttgtcaactccaattttgtattgttctccattgagattttagtttatagacagcagccctggtggatttaaccaatttgcctataattcaattatataaatatttttatgtgaaaataattgtataagagctcttgttggtaattgggtctcagaggcagcaggctaagaagaacaaagagaagctttggatgtgagtagctgtatcaacaatgaacttgaagattttacccttggtcttggtctcagttttcttctgtgtaaaataagatagtaaagtagttgatgatgtccatgggtcctttggactcttccattttgtgatgctatggttttgtttcttgtcactgagcaagagggtcagttttgacaaatgtggtgctgcttgggagcctagcctgtcttgggtacccagtgtaacttaaattctgagtgcttcctgagtgtgcatggttttgatgtatggattcttttctccttaactcagcagcacatttagtgaccgtgttggtggctaacctgatttaaaatgggacagtccttttgagcaagcagcattaggaattttaactcatttggaagaacaatcttactggttgtgggtttttcagcaagtggagtatacagcctgggagagtgtgtatcctaattggggctcagaagatgcgttggatgcactgtcctgcagccacccccacctccaggcagctgccttggggaggaaacatcccccctgaactccctgtctctggtcgacatgaggagctttgcttctactgctaccttggaagggaaccatggtggttaatgggactattggtggtggagactggaccccttaagaggaactgccctggttgactgggagctgcctctgacctgcctgtgacttggaggatgagagacagttgacttgggagtctccctgttgaggccccagccactcgagaactgaatcatatgagcagtgtggggccagagctactgtcctgggcttttggcctgttccccatcttaccatacatgaattgggacacaaaccagaccaggagtcagggtttcttaaggccttaaagagcatactttttttctaagggttctgaaaatgaaaacatttaaagcatttttgaattccatgcagtaaaataaaaacggtttagtcttttagtgaaataccgagtgttttttacttgaaagggttatggttattccaatatttcagagcatttgtagagtgctttgtgatgtcactaatcctgagccattggagaaacaaggtcaagtgatttattttggtaatgaaattttgttcgtggttggcagtagggcaaatgcagtcttataaaggagaaaaaaggacaactctatgatgaggtttttggccaccggaggaggtggcttcattcgctttctgctaacttggtctttggggagctgagactttatgtgtttgggctgtgtgtggataggtggcttctgctgtgggcacccttatgtgtaggcagtcgtttttatggattactagaaggggtacgagatgtcctttgacctggttcctaagggcatgtgtgctcagtccctggggctctctctttctctgtgcttgtctttttcattttttgtttttacacagctacgtgtgactcttttcctggtagatcatgggagaggagatagatagcaggaggacaagatgagagggaagttcttgatcaacaaacttatccagaattggatttcagaggagcaggctgtagtttaaaacaaaacaaaatagatagcaaaccacgggaacacctgaatttgttacttttgcaactgaaaatcccagtcagatagaccccataatcaaatagggcagggacaggaactaaccttcactggttgcttgctgtagaggcagagaagtatataacacttaacagtctggactctataaataatatgaatcctggccctgcacttctagatatcagatttttatcgagttaccttacttctctgtctcaatttcctcaactgaaaaggaggattagatagatcttactgtgtaggattattagaagaattaaatgaactaattgttatctggaacaccaccaccccctgcaatgtttgaactgtatctagcatatagtgagaggtatgtaagtgcttatgaactgaaaacaaagaagtgctctctgccaagcactatgctaaaggctccacatacaattctgtctaatgctcttaacaatgctttgaagctggtattatcatcctcactgtatagacaggaagctgagtctgagaggggtaaaatggcttgcacatggccaatataaatggtatagctagcaggtttcaaattcagggctgtctgactctacatcttggacttttctactgagcttttgttccttccttggtagagaccgttatacataaatccagtgaatcagtattgagccccagcgcagctgtattccagccctgtgctaggggttgtcagggatactgtagtgaaccagacagacatggtccctgccctcatggagctatctcaagttcatttgcaggaaactgacctgaggtcaggactgtgtgccaaagctttctgagaagtttgagagccctttgaagatggtcaccttccacttagccttttgaagcctattcttggctaccaaggtcgagggcacctggcctgttgctggcaggaagaaatcatctcaaataacatagcggagaggatcccagatcacaagcctggcctcggtagtggccaggaggatgtctggaagattctagtgccctaggatcctataagcagtctgggcagagctgttgcttccagacatcttcctggccactattgactttctccttttgcaagcagatgtcttcaggatccttgcttaggtcagctccaaggaaggaccctttcttactgggataccaggactactggtcagccccagagacctgaattgtgaggaccagcgaagatgagggggagggtgtctctagtcagtcctcccccgctgctgacctgtgccctgcccaccaggacagcataggacttaggattgcatctttctttacttcataggagcagaagtcagaagaggaaagagggctttttaaatgaggtagtggcagaactgacaagggggtatcagaatgagagtgcacacaagtaagtgggagtatgtattgattagtcagtacagcaaagagactgaaacctgtggtcgctacactcctctggatgcagaggactggtcaaaaaattgcagaatcatccttttataagatagtatgttctcataacagctctttgaggatcagggaggtaggctttgtcagtggaggccccagagccctggtgtggaaatggccatagactcccagccctggagggtctccaggccttggcaaagtgttcttctcggagctccatatgaacatcatgtggcatctttgatttcctctttcggacctctgattcagggtgttatttcaagttaattggttagaagcgtgaaacaaacagctatgtggtagaacaggctagaagctcccaaagccgggaccccaccgatcacaggatgtatttcaaggcctggaatatagaaggtgtcagtaatgtttgctgaataaatgcttatgggagatgaattatggttcaaacagagaacgtaggtgattaagcctgtaagccctgagggcctctcctgtgggaggaagtggctagaaaaaaagaaggaaaaaaagaggaagatgtttatttaatgatcttagattgagaaagaagaagccctattttttatgttggcaaatgttagttgaagagatagaaaagatttctgcacaaaatatggacaatagcagagcaagggttaattctggaatgctcagaacagatgagtaatggggaatttttgaaatagtttggttcctgtgagaatagcagggccagcgtcatcagcattttgattgggaagcttaatgtgtggggggtatgcaaaagtgtatgcacaaggtgtgagctcatgtgcaatccgggtacaaagtagctaattaaagatggctcaagaattggtcataagggaggtagaaggaaaagaacatgaaagtattaccaagttatgctttccaacagcttttctgtggcagtggatgagccctgggattcaggaagatgtggattcataaatcatttattgagggcctgcactgtgctttgaatgtgatggggacaacagacataaaataacttaaaaagctgacctgtgtgagcagttaacataccaggcactttcccattgctataggatgtgcgatcttgattattcctcaaaaacaacccaataatataggtactgtaattatgcccattttgctgctgaggaaagtgaggtccagcaaggtcaagttatttgcttgaggtcacatagtaaataagctgtggagctgacatttacaaccaagccagtcaatacaaatgactccaatattgatatggaaggaagtatattctgtactagagatatacctggtttagtagtggagcagcacaaagtgtgatcatttatgattggggaattgacttgtatatgtttgagaatgaaagagagcatgagacagacagacttagctaactttgaactttgggaaaaagatcatgtagcggtttttaaacttattttggattatagattattttggatttccaccccttggagaatctgtggaaagctatggaccctttcccccagaaaaatcacatatttgtatgtagttttaggactgttgcatgtaacttcaggcaagttctggagcacaggttcagacttgccccattggggaaaaggagaagggaagggcattctggctgaaggaacatgtgataaaggcatggaggcctggaagggcacagccctgatgtgcttagaaatgaaaatatctcctgggggaggggtacaggagccagcattgtgtcgttgcgggtccgagtgccatgccaaggtgcctggcactcatcctgggggcagacggaagccattacatttttttcaggagagatgacatgtctcagcctgtgtttgacaaaactagatctgaaggcgtgaagacaagttagatggctgttacagtagtccggtaggagagcctgaggcctgcactaggatgcaggcggtgctggtaggaggagggagtttcagagataaaaccaacagaattggctgatgggatgagatttgtgaaaaagaaggagtttgatttcaggttccacttctggctcattgggaggatggtggtactgttaagcgagatggggagtggaggcaggagaagcaggtttgtagagaagagaggaatgaggagttaagttttgtcatatgcttgatgtactggatgaccatccagatggagatgacctgtaaggagttggaaattcctgcctagagctcagtcagattgaagttgcaggggtagtttggagcctcatcatcagagaagtgatctgataatggcctgtgatgcccaggctcacaatttatcaagggcaaaactggcatggatattaaatggaatgtctgtagcactgggagagtaaagtgattgcctttttcagaaaagggaagacagattagtggttcccaaggctcactatcaacagaaacactcaaagagcttaaaagacaaaacaactactgactaagaatatctgggagtatggcctgggaaactgtatttctaaatgctccctgagtcatttgggtgatcagccaggtttgagagctgctgggctagctgcagtctgggtccaagaagacaggaccacatttttagagtgataaacaagtgagcagagaatgaggctaacatttgaagcagtctttatgaggttttggtgcaggaaatgaatgacgctagtttcattcttcagtttatgttcactttctacctagagggaacattaccatgaccaggtcttcagagagtttgaccatgcatggaaggagacacggtatcctgaagggcagaacaaattaagagaagactttttctaggacaggggagacacttggccatttggttagttggggaaaagaatttatgagttgaggatgtatttgatggagcaaaacccagaagagactttaaagggaaaggagcctcttttcctctgatgcagaatggaggaggatggggggagggccgagagggggcctcattgcttctctcaaatgaaggttattgtgggcttttgaaaagtagagcaagcttagtacagatgtacagtatagatgttatcattgacagacagggatgattaaaagaactactcagcagtgagtattagcagagagtattactttcttttttatttgaaatttttgttgagatactgtagattcacatgcaatggtaagaaataatacccaaagggatcctttatgcatgttgcccatttccccccaatatggttacattttgcaaaactggagtgtaatattgcaacaagcgggatattggcatccacacaacccagtgatacgactcagattttcccagttttacttgaactcgtttgtgtgtgcgtactaagttgtgtacactacttgttgtgtgttagtcttgtgcaggttcatgtctccaccgccacaatcagaatacagaacagctccaacaccacaggacccgggttgcccttctccctaactgctggcaaccaccgatctgtcctctgtttataaaattttgtcatttcaaacatgttatataaatggaatcagactacatgaaccttttgggattggctttttttcaactcagcttaattcccgggagattcatccaggttgtgtgtatcaagtttgttcctttttatcattgagtagtattctgtggtgtgtatgtaccacagtttgtttaaccattctgctgttcaagggcatctgggctgattccagtgttcaggcatttcaaatccactgtgaacatacacgtataggtctttgtatgaaactaagtattcacttacatgggataaatgcccacgagtgtcatttgctggctcatatggtatttgtacattcagtatttttttcttttaaactgcccaagtgttttccagagtagttgtaccactttacattctcacctgcaatctagtttctctgcatcctcaccagcatttggtgtcatcaccattgtttattttcattgtgataggtgtgtaattgatacctcatgtggttttaatttgcatttccttaaagactaacgatgttgaacatcttttcatgtgcttatttgccatctgtatatcctcttcagtgaaatgtctgttcatgtcttttgttcgttttctaattggagggtttatgttgttactgttgtgtttttggaattcttttttctagatacaactcccttttttggatatgtggtttgcaaagattttctccttatctgtagcttatcttttcatcttttctcatgggcaaagcaaaagaacttttagcagagcaaaacttttaacagcgaaagttttaattttgatgaggtcttatttattagtttttccttttgtgagtcatgcttttggtgttgagtctgagaactcattgcctagccctaggtcctgaaaattttctcctgtgtcttgttctaagagtttatagttgtatgttttaaatgtaggtctgtgatgcatattacttgtgagggaacccattgtcatgattctgtgattttctttacaagaaggttattgggtttattcatattttgacagttgttatggcttggtcgtaggagtctaagttgggaaagtgacagggtgaagctggaggggctggtaggccatgaggcatgctgttcagaggctctggtgcatgtaggagaggaggcaggacaggaggctctggtcatgcatgggagaggcagcactgagattagagatggaaagatttcaggggatgagtttcgaggtgtggccacaaatacggtcaactgatgtgaatgtgggcgatggacatgggagatgaggaagcaaggcactgtgaagctcatccacagtgacttgattaatcacttagatgctgaacttcacagtggtaaagtgtgcatttttaaagaaggtaccgaagtaaaccaggtgctgagggatttctttgaggagtacatggccccatggatatgcatggaaagatgttgatagagtgtaagtggtgtctaaaagcagagagcagaacagtgggacaggaggtatatcaaggtcagaagaaaatgccaacatttctaccttcctcttcccaaattcttcagttggtccaaaactatacctgtttgtgatgtatagttatagttacatgggccagccatacaagctctttgagccttgttgccatcaccagtagaatggggctggtaagtcagcatgtttctttctacctctcagcaatgttgagagaaaatgtaattatgtatgaagaagttctttgaattcttaaaattaatggtttaattaatttaaacagaaaaccaaatatcgcatgttctcacttgtaagagagagctaaataaggagaacacatggacaccgacacatagatgagagcaatagacacggggcctgatggagggtaggaggagggagaggattgggaaaaataacgaatgggtaccaggcttaatacctgggcaacaaaataatctgtacaacaaactcccatcacacgactttacccatataacaaacctgcacatgtacccctgaacttaaaagtcaaaaaaaaggaagttatatcatattttaaaaaagtaatgcttttagaagttaagcctgttcaggacttgttggaaaagtaggaaagaacactatggaaccatcaaacagagttaagcatccctagttcagttagagggctgtgtggttaagggagaaattgagctgagccctcctttcttagggtttctgtcaaagaacagggggacggggagctccagggcagacttttagagatcagagccacaaatgatggaagggactgttgctgggcagaggttcatcaggcctccctcacagtggccctccgcagcatcagagggaagtagagagtgggtggacatttgtgttcttagcagcacaggcctggattcaacgatgtttctctgttctcatccccaccggacccccacctctagagcttcagttcctcactcatctgctgctgtggccttccattttacgtgaaagcgtgtctctgatttattattgttgttatgtattttatcccgttccagtgatagtatgtgtttaaagtggtctttttaaaataaatgatcattattgatggtagtgttctgttggtctctcactaaaggtgctattttagagactgttcaacttgataaatctaaatatagaagtgtgttcgttgggaggatcctagaaaaaaatctggaggaatttacagtctactaatagtggttgccacagggagatgggattataggagactcggtttctattatgtttctgtattaatgggattttttcaatcgcaaacatatgttacttttggaatcagaagaaaaaagataattgtgtcaagtttattttttcctctggttctgagtaaaggatattcattaaagaaaaatgtggaaaatagcaagagttagaaagcaaaccatattgcctgggtccactgtggtgtggtgtttactggcggcggggggttcacccggggaagttacggcagggtcacagtgggcagggaggggtgcaggggtgtttggagagcatctctcccttccacttgtgggtggctgaggtatcaagctcaggggacaggtggtcagagagtggcagtgctagggcgggggaggagaacagggcattcttattataggttttaggacattggtccgggacttcaacaggtgccctggccacttgagtgtgtcagtcagctggcccagctcagagacgcataattccaacattcatgtattatggtaagatggtgatgggagagagaaaggaagacgtccacatccattccttgaatgtgcataggctcacaccgcaaatagaatgaacgggatccacatctctgctgagtatttttcgttcagcttgtacatgagagtagacgtggtttattcctagagggttgggggcttctctctgccagtaatgtttttgatggccatgttatcctttgtaatagattcctggcaagtaatcttgtatttgtgctgcctttggacagaggtgggtagattttagagaacaaaaacactgggtactttacagtgtgctacagattctcatttaattataatttttaattataataaaataaacttgcaatccgaatgtgtttgatcggcttgatagtgacctgctatgcataccctgcagataattctgtctgcctaccttccctttcctcatgtttcagttctagctaaataataaaatcaaatttgttcttcaaagcccatttggatatttattattattattattattattattattattattattattatcattattattatttttgagatggagttttgcttttgttgcccaggctggagtgcaatggcaccatctcactgcaacctccacctcccgggttcaagtgattctcctgcctcagcctccgcagtggctgggattacaggcatgcaccaccatgctcggctaattttgtattttagtagagatggggtttcactgtgttggccaggctggtctctaactcccgacctcaggtgatcctcctgccttggactcccaaagtgctaggattacaggcgtgaaccaccgcacccagccttatttttttttaaagtttgttcttgtgtcaatgtactctcctctccctcttagccttttagaacacagtcttaaaggtgtgatagcgaaacctgctgcccaggatgtttaatttgtttaaaaaattttttctttattgcattgtagtccccccgcctttgggggaaatatttgtcaccccaaagttttacagcttctggggtaatatttaacatatgttaataagctgagtttttttggccatttacaaaggtcccaattgctcactgtatgcctaccctcttccctgggtctgcctctgtgctctgtgacttgcccgatattttgttgagacgggctttggcaactgtctcttagatgaatggttctattacaaacacagtagcttccatgaccgcttagaagagattgttgtttatgacagcttttattgagagaggtttggtgcatgataatgtcctgataaggacatttgtacctataaagtagccacagccttaaacatatttgattgtcagtaaaatattggggatgatgacatgccagatgtgaggtatcggattgcatgtttattcaactgttactgcaatctctgtactaagatgtgcccttgtattttctgtctcacagcaacacacaaaatgcaatggtgatatgatcctgattatgaaagatgctatttaggttacttggattgtaaaccatgtgtattaggaagcattctctcagtccccatatgtccttagacagcaaccacaaacagttgttaggtgaagggaattgtcaagtgggttgaacatacgcattgtgatagggaccttttgaaatgtatgaatcttagtaaggcctggactgaccagggcaggtgatgtgacagtcaaaataataataatgaatatttgttcttgcaatgaatttttgcaataatgaatatttatgcttgcaatgtgccaggtactgttctgaacacttagcattaacccatttaaaccttctaacaagtcttatgaatagctactattatcttacattacagatgaggaaaccatggcctagagaggtttagtaagttgccctgggtcagattctcatttgattgtaatcgttgattatatttaatcatgaaagtagtggttaagagctcaggctctggggttcctatcctggctccagtcctggatgttcttactgctgcctggctagggtggaagagagttttggttccaggtaaacaatagaaaagaaagaatgggctttcctggtgtctgggataccgttcatcctgttttttgctttgtaaactcctactggtcgttaaaaaacactccatcctctctgaagccttccttaatctccacaggcagagctaatttttccctctcttatgtttccaaagcacatgacttttaactgtccattaaaggcctcatcagactctttttttttttttttttttttaaactgtagtaagcactgtcaggctctgtttctgtgggtctgtacccactgagaactcttcaagggccagtgctgctcagcctccagtatggtccctggcacacattaggcccccaaaaaatgtttgaattagtgaaagttgttggtaataaaattccatcttgtgcctctcaagagttttctttcctacattcttggcatttttatgacatttacaacattttaatgaaacaacaagggcaagaattttgatttcataaataagaaactgaagcacagagaccaggatgttttctgttagattgttttatcttgagaaaccacctggtgaaacaaaacttaggagaattaagtcatttgcaagaccccactcccctgtttacacttttccatcataaccatattgatcttacacctgagatgttgtgaactagagtaatttgttcacagtagtaaagcataatcctagaaaagttagtctttgaccatttcttttccctggtgtatactggacataatatgtttgtaagcttatttgagatgtttctaagtggtaggggtgtgtgtgtgtgtaaatgttacttttttcagatcgactgtgggtttagttttagttgtctgaaaatcacttccaccactgattattctaagatgacattgttgatcttgaatgatacagttaccgggagcaatgaactaagtaaactctcactgtagagttcagaagggtgttgagttagggtgagtttccaggatacaaaatctggttagctcattggctgatttataaggggcttattagcctatgggagtaagttcttcattggtggtggtaaagggcacagggttgggaataagggttgttggggtttaaatcctggctttgccacttcactggctgtgtaaccatgactaatattgctaaacctccatatcctcatctggtcaatgggaccaatattggcaccccatctcacaacttcagtgtgaagattaaattagataatacattaaaatacttagaatacccagttcattctttgagagcactattaccctgacagctaaatcagacaaagatatcatgagaaaataactaatatcccttatgaatatagatataaaactcctccacaaaatatgaacccattcagcaacatataaaaaggttaatatacagtgaccaagtgggatttatcccaggaatgcaaggtcagtttaacatctgaaaatcaattaacgtaacacaccatatcaatagagtgaagaaaaaaccacatttttatctcaacagatacagaaaaaggatttcacaaaatccttcatgatgtaaataatcagcaaactaggattagaagagagcctctcacctgctaaagggcatctgtgaaaaatctaagcaaatgtatgtaatagtaaaagactgaatgctttccttctaagatcaggagcgagacaaggatgtctgcttttactccttcccttcaatattatactggagtaagagcaattgtacaaggaaatgaaataaaaattactcagattgggaagggagaagtcaaactatactgtctctatttgatcttgtatgtagctaaaaaagtaaaacaacactattaaagttcataaacaattgtagcaaggtttctggatacaagataaatacataaaaatataaaactcaattgtaaattttttttttttttttttgagatggagtttcgctcttgtcacctaggctggactgcagtggtgcgatcttggctcactacaacctccgcctcccaggttcaagcgattctcctggctcagcctcccgagtaactgggattacaggtgcctgccaccatacccagctaagttttgtatttttagtagagacatggtttcaccacattggccaggctggtctcgaactcctgacctcaggtgatgcgcctgcctcggtctcccaaagtgccaggattacaggtgtgagccactgtgcctgccactcgattgtatttctgtacttaacagcaaacaacctgaaaatgaaataaagcaattttattcatcatagtgtgaaaaagaacaacatacacaggaataaatgtgacaaaagagcaaaaaacatttacctccaaaactacaaaatattgtttaaataaattaaataaccgaataaattggaagacattctgtgttcatgggttggaagacttaacattgctaagacagcagtacctacaaattgatctacagattcagtgaaatccttatcagaatcccaggatcccatgacttctttgacaagttgattctaaaatttatatggaaattcaagacccagaatagccaaaacaatcttgaaaaagaagaacaaagttggaggactcacactttgtgatttcaaaacttactacagagctacagtctgaatcaagacagtgtggtactgggataaattagacatatcatcaatggagtagaatcacaagtccagaaataaacccttatatttattgtcaattgattttcaacagatataccaagacaattcaataggaaataatagacttttcaacaaatgatgctgagacatgcgaagagtgaagtcggatcccttcctcacatatcatatatcataattaactagaaaatgatcatagatgtaaaagctatgattatgaaactccagaaggaaatacaggaatgagtctttctgactttggattaggcaaagccttagatgtgacaacaaaagtataagtggtaaagtaaaaatagagaaaattcatgaaaattaaaaaactttcctgcttcaaaggatatcatcaagaaaatgaaaaggcaatccagagaacaggagaagatattttcaaatcataaatctagtaagcaacttgtatctagaatatataaaggacttttgccattaataaaaagataactatccagttaaagaatggacagaggatctgactggacctttccttaaaaaagacatacgttgaaaaacacaccaaagatgctcaaaaccattagctagcagggaaatgcaaattaaaactacactgcgatatcactttatatctcttaggatggctatcattaaaaaaaaaaaaacagacaataacaagtgttagggaggatgtagagaaatgggaaccctcacaggtcactggtgggtttataaagatggcataaccactctggaaacagtctggaagttctttaaaagactcaccatagagttattataggacccaaaagaaatgaaaacagatgtccatacaaacacttgtacattaggggtaggtgtgttggctcccagcactttgagaggcctaggtgggcagatcgtgtgagtctaggagttagaatccagcctgggcaacatggtgaaacctcgtctgtacaaaaaaaaaaaaaaaaaaaagaaagaaaaaaagaaaaagaaaaaaaaaattagccaagcgtggtagtgcacacctgtagcccctgctactcagctggctgaggtgggaggatcacctgagcctgggaggtggaggttgcagtgagcagagatctccccacggcactccagcctgtctcaaaaaacaaaacaaacttgtacatggatatttatagcagcattatttctaataatcagaaagtggaaacaacccaaatgtttatcagctgatgactgcgtaaataaaatgtggtaatagctatacaatggaatattatttggcaataaaaaggaatgaagtcttaatatgtaccacaatatggatgacacttgaaaactgtgctaaatgaaaagaagattcatgaaagaccacatattgtacgattccatttatacatggaatcatatgaatcatacgaaatgcccggaataggtcagtctacagaagcaggaagcagattagtggttacctgagactggaggatttgagagaaaatagggagtaactgcaaatgggtatggagttctttctggggtgattaagatgttctaaaactagttacggtaatgcttacacaactctgtgaatgtagtaaaaacttgaattgtacacttaaaatgggtgagctgtatgaaatatgaattatatcacaataaaggtagtatcagtgtatatgctcagcatcatgcttggccttgataaattggtaaatgttagctaccaatgtaatagtaactctctgacttcatgtgcagagcacgtttatagtagcaaagatggaaagaaaggaaaatgctgagagagtagatgaacatacaagttaactcagataccaggtgagggagaaggtgactgaatctgtggcagccgtatggtaggagctgagtgctgcttttggagaaggtgaatgaagttatgtggtgcaagagcctgataccctaaaagtgtctagtaaacctgaatgtagttacccttaaaatgtggttgaacttgggtctggggatccagatgtcactaaacagtatcttcttcacaaaagagtaatcaccgtcagtgtgataaaagccagagtttttgtgtctagaagtcactaaaccaggtaagggtttgtgtgtgtgtgtgtgtgtgtgtgtgtgtgtgtgtgcgcgcactttctttttaaatcactgtatgacaaaggccagagttttagtttttgtgccttttttttttttttttttttaaggcagtgtctgggggaacttatcttcccacagtcagcccatggctgaccagctttgatttttgcagggtgtctttgggcctgaatgtttgagcctccctacaggagatggctagagcctagccctcatgctctggaagttagttctggtaaaagctttgcagttggcgctgtggatgccctgtgctacttaacagtggttcctcctttagaacttggaagacacgtgccaatagggaggaaggttctctgctaagatgcatttatttgtgaacacctctcacagtgtttttttcaaggatatacctgtggagggaatttcccatttcagttttgggggaaacctggtgagttgcttctcagatgtttaggtcacacactgacactcaaggtcgaatggctactgcgtggtggagctgtgattccaagaaaccttccatgtctgattgctaagacagctcacagtcttaaccactaggctgaattttccctcagggatggacaaagtggaagagagagaaagctgaaggcagagagatgtgaaaatacagtgttttcaggagtagtaaggaggctggtaagcatgtgggatgtctagaagggtggatggagtgtggggtggcttgtaagctgagaggttacgggagtgaagtgccaggcaaggatgttcgaacagtaagattagaggttctcaacttttctgtgtatgcagcatatacacaggaaggggggatgggagcccttgtttttaggatattcaacaagtgtttgaggagaattattctggaggctctatctcccataaggaggctgacactacaacacttctggtaggagatgaggagggcttgaactaggtcagaggttatgggagtgacaaggaggggatggatgggaaggacattttacatcagtatattagagattaggcatttagattaggtgtattagagatgagagggctctgtagggttttctgatgagggagaagatgaagatttttcatctgcatggatggcagtgccatttatagacacagttgtacagcaggggagacaagttgtaagggccagagttggggtaatgagttttgagttgtatggagtttgcagtgctttggggcacttcatggggagggcgccagcaggcactgggcaattcagcattctggatttgagaacagtttggaaaacatcatcacagggtttggagttgagaccctggaagtggataagcttgtctaggagacagagggaaaggacagaaaggaagaaaggctaggatagaatccattggaagcattaagagtcattgtcttgagtaagcatcttccatgtcatatgaaaccttacagatgcaggagcaggggagtctgaattcacgtatgtttactaagtgtgctgaagtatttgtctcctggtggtgtgttgatggaagcagatgattttcttgcaagttccaggggtgctgatgtcttggcatgttcctttctgtggccccctagggtgagttaatgggtcagcccaggatcctagttcctccttccctttccttaagtcaaagctggcctacgctccatgtgtgatctccttcttcccagcctccctgggagtgttgctgagctccgtttggagtttcagttgcaaggctttagccacccatgttaactgtagctcctatcgcttgagaagtgcagggtgaggggatcctggagaatcagctcccttttgaaatctgctccagcttgctctcttggggtcagcatgagtgtggagaagactggagaaaacccagagatggtaggcatgacctgccagatgcagcaagccctgccctctctctgtgtcagatcaaagactgactcttcagtcatttgacaccctaatgtgaggatgtttctgagccagggcccgggctcctggtggcctgtgcctgggagccgtggggaacgtgtgggcctgcatgtgctctgggtaagtgggggtaggagagtaggacaagtaacttcccagctgctctcttagacacagagctggagggatctggagagatcagcccagcctcctcagttttcagattggaagctgctgcccagagatgcccttttcccggttccagttctgagggcgagttggcccagcttggttgcagctgctcctgcatggctctttcctcctgtcccacaggtcctgggttccagggcacagaggttgttcccagtttggctggtgcctataatgaccatatcatttaatgttcagactacgacacttcagagaataaatgggggcaatgttaacaatgacaccaggaaaacagaaataaaccttaggcaaaccaggatatataatcttccttcctgtgccttcacttttggctcaattcttattcctatgccaggtgatattccctcatcccctaccgtcctggtcctatggcccacatgactttaggttccgggaacttacagatcttggtctttggaggtttggtctgtggatcttggtatctagaggttagaaacctcagggatctcccatgttggagggtccaggagatggaaaacctgggaataacatcgtgagcatatctctgacaatccatgactattcagaacctagatccaggaactttgattttcagtagctagggtgggtatgtcataatttactaacttagtttttttttccaacatacatttgtctcttgcacgtagcgtaagatggcatgctggtaacatacaaatcacgagagcagcatcctactctgcaaacctgtagccccagatagagctcagcaactcagccatgcaatcttctgccttggaggtggaggggagccaaggccctgggctcctgacaggtgtgtgacggagcagggcatagttacttgtctcccaggtgtccacagtcacagcacagggtgggaggggacatgagcagctgggctttgctgagaccaagccaaatggggatttaggcagagaaggtgttctttatttgagagtagagcaggtggagatgaatgctctgcctggtagctttctcggactgcactggcttgtttttctatctaaagctggcagaacccagaccaccatggatcctcaatgacaaaggccagaggagaggaaatggttcttcactgggtcttctggctgtgtccttggacctctgcctctcccagctgaccagagtggtctggatttgcccattctctcactggagttaggagtaggattgccggacctggcaaatagaagtacgggaggcccagttaaattggaattgcagataaacaaaaagttattttttagtatgagtatatcccatgccgtggttatattttatatagcaactctacttagtaaggactggcctgattttgcttacctctggggcatggtttcacagtgcctctttcattcagtagatgcttattgagtgccaaggatatgtcagatgccactctaggcactggggatattgcagtgagcaacaacagacaagagttggtgaactcatggagcttacattctagtgggggcgatagacaataaggaagatatgtaagtatgttaggtggtggaagtgataaagaggaaaataaagcagggaaggaagatagggaggattcaaacctgaagaagatgagggattgaggggataagccagacagacatttgcagaagagtcttctaggcagagagcaccacagacatcaaagctcgggcatgcctcatgtgtttgaggactggtgggcctccgtggcttgagtggagtcagcagggaagaggatccagcatggaggtcagagctcagatcttgcaaagcctcatagccctctgtaaggatatgggctttcactctgagcgggagtgtgatctgattaggttttgaaaggatcaccggctgctgggtagtgaaagactgaaagcaagcctgggcccaggtctctcaccgtatcctcaggggtgggccatgggatttgagacctgcatgccatttggaataaaagggcatgccacctggacacagcatcaccttgcaggatctttgatttctttttgcctttttcttcctcatttaagggatacattcctactcaaaaaagggaaggatatgttgcagttatctacctcttttttgctaaccattgtatgatgcgcctggtttaagggacagttccctaatggttcctattaagctttggagaaagagtagtggtgtggtgggtgtcacatacctggagctttagagccttctgagaagataattcggtaaaaatacatcattttttgattggtgttgaaggaagttgtttttcgttgcacagattaaatttaaattgttcatgagagctaaagagcttgaaagcatttctttgttttctgatctttaaaagtagagaagagtgagctggctatataatatagaactttctcggctttactttaccaaagcagtctgatttaaaaacttaaagccaacatatttcacatttatagtttaagattataaaaactaaatatgcatttaatttcataaatttatgtacttaatttcataaaattatgttttttggagaaaaatactgaggctataaaatcttggcttgtaagtaaataaaattattttaaatgtcagccagttttgatgatgagagctataattctaatgagtggcaaatattttctagatatctttgaaatgatactctggtttctcttcagactgtataaatctttcactttttttttttttttttgagatggagttttgctcttgtcgctcaggctggagtgcaatgactcagtctcagctcactgcaacctccgcctccagagttcgggtgattttcctgcttcagcttcctgagtagctgggaccaccacaggcactcgccaccatgcccagctaattttgtcttttttttttttttttggacggagtctcgttctgttactcaggctggagtgcagtggcgcgaccttggctcactgcaacctccgcctcctgggttcaagcaattcccctgtctcaccctctctagtagctgggactacagagctaccgtgcccagcctaattttgtatttttagtagtgacggggtttcaccatgttggccaggctggtcttgaactcctgacctcaggtgatccgcccgcctcggcctcccaaagtgctaggattacaggcatgagccaccgtgcctggccaaatcttccaccttttactaaatatctttgacaagccttttgacttagtatactggtaaattagctttggtaatattattaacagatttgtaaatttttggtatatccacaaaattcatttgaaaagaagcaaaaatgaaacctttaaaaaagtataatgtacacattccaaatatgaaaatgtactacttcaccagagttgtgaagcatgtaagacgtggtccatatttaagaacaaagcagactttttaaagggactgtcttgtacaacatcacgcccttgggcactgagaatatggaattacaggggtgatccctgtaaaaaatactgagtaaaatgcaatgtgtgctaaaatgcatctatatgtgtataatttaaaaggcaggcatttcagtttaaagttatttttagactagagattttagctgttttcttaagcagggattaaaaaccaatttaactgggggtttgggtttgttttgttttaagagatggggtttagagatggggcctggctgtgttgcccacgctggtctcaagcccctggcctcaagtgatcttcctgccttggcctcccaaagtgctgggattatagacctgagccactgcacctggcccaaaactgtcttaatgtaattgagactcttacacacataataaattgagatttttgtcatctcagtttggaattaacattgtaaaagtacatgcacttgagggttagatgtaacattactacctctagctgtatgactttgattttagtaagtctcctctgtaaaatggggacaatgaaacctaccccgaggactggttgtgccagttagatgaggtaacttgaattggttcctgagacagtacctgacacataagctctcagcacatagtgaccagtgtcattcttattggcattgcttttattatttatttttattatttttgctatattcataaaatgtatttgaaaagcaaaaatgaaatactttttaagaaagtacagtgacttgagtgagaccatacagtttatgttagctaatgatttccaaggccatccaagttcaagttttgagtgtgcaagccagcatcttttgaataccttgagagagggagcagacaagaaagagtttggctcagagaaggtaggcggtgggaacccagagtcctggtgagtgtgcctttacacccgacatctccctccagatggcttttcagccaggttgataattagcatcaacagatgcaagccgagagtctcctgggctgcatgtctccagcatggatatgtatggagagaagcatgcagcatgtggaagcccgagctcagttgggttgtacggctgggctcggctgggctcagctgggcctgtggaggcattgctccgagttgggcctgcctgagtctcagctggtacacagacactgccctacagcccaggacctgcccagggggctcagcgtaacagacccaccttggtggggggctgctgcttccagctgctttgcagcttctgtcaggccagggctgcttgagtccttgctctgctatttaaatctatcactcgttggtgacagctttctgcttaagcagtggcagcatgtatgctacaggtttcagctcattacctctgtagggctgttcctggactgctggctgggggaaaggccagccatacagactgaggcaccagccccaaactctgtattggatgttgctgagcctgggtggagagtggggccgtgctacctacagtgcctgctacctgtccttcagaggacctgtctgcagcagggccagagcctaaggttttgttttctcccagcctgatgggactgtgatacttggacatggacatcaaggagatgtgggctttgccactctgcttaagtgggcctgggcaagtcattttacctcttggggttcattttctctgttaataggtggtgaacttttcaagggtgattaacatgtcatctttatctccatatcccttggacacagtaggtactcagtaaatgatagcttaaatttgtaaaatgggaatgataggacccttatccctaatttgtactgggcagagacaatgaatataattctattaaactttgacaaatgggaataaagtgaaggaacccttgtatttccccaggttcatctcccatatccccagtattaaagaatctcagatgaatggggacttaaaaagttcatttgtgtatctttatttactgattcaaacttttactacctttgccagttgatctaaatagacatctctgtttaagcatcttctgtataaagaaggtgtataaatagtcaagaagcacatgaaaagatacttaacattagccattagggaaatgcaaattaaaaccccagtgagttaccacttcataccctcaggtgactatggtcagaaagacaataacaagtgttggtgaggggggtgaaaaatgggaagacttatgcattgctgatggtaatgtaaaatggtgcagcctctttggaaagcagcctggcagttcctcaaaatgttaaacgtagagcaattctatttctaggtatttacccaagagaaatgaaaacatatgtccacgcaaagacttgtatgcacatattcacattagcattatttttatatgtgcatctgaatgccctcatctccgttatggattggatgttaggacaccctatagaggagatttccagggatagctactcttgtgtttgtcttcttatatggggttcatgcataggaaatgccaagcttttggcctctctcatttataacttccagataacagcctaagtttggtctatgtttaaggaaattcaggagtcttttgcagggcttctgtagaaacctttatcaagtaaaagtatctggtgtttcccaggctttgctctcctgcattccttgtagtcagcagggaaggaccccttgttatgatgtgagttactctcaacatttcaggcttttgaagattaattcctgatctgagggaagattctggcagaactgggatatctctagaatgcactgataagggccttgtcagtttctggggtgggcaggtccttcttatagacggttttgtgactaagatacctgatcagtaggctttttttcctggctgtaactagtgatgggttgcaggtgggtgcgtgtggggatggaacatcttagagttgtctacaaagttaggcatcagagagcatgggtatcatggagagaactttttgattgagatttggggccaatttaagtcagttctctaatattttcttgcatttgagttataagctgttcctataagtaagtgataagggagtagtgggaaaatgcatccttaattaataggcagaataaagctaggtggccataggaaggccataaaaagcccaaggaagcagccctatttatttgtagaacataggtgaaatgtttattatatgcaaaacaagttaaaccaaaacatctaaatgcaccatagtatatgattacagaaacctgaaagatccaggagtaacaataacaaaggaacaaatgaactacacatgaacactaatcttccctggaactaaggataggtgggcacttagaagtgcttctgggatgggaggtcaggctgcagggtgatggacattgggcatgtgcttgggacactccttgaggcacatggagactatttgagatcacctctctgatcagaaagttgtttggtgagtaccaaaataagacaaaaatgagtaagtgtttttaagggagatttccctcaagctgtgtttggtagataactaataactctctgttctgggatattttctctctaggccactgtcattgacctctcaaatgcttgggggtgagaagggtaaagataatataaaaatatcaagaaaaggaaagtaaagggaaaatagtaaaaaaaaaaaaaaaaaaagtcctatatagtcctatgaagaaagttttgacctagatataaaaatataggcaagtctgaaatcttgttgcttttctctttagtttgccttcgttgatataagtctgtttattcatgtctgtatgctaaccgctgacacttaaatgtgaaattgttctcaggactctgctgcattgtcctactagtagaagtcctggttttagaacataaggtctggatatgtacagcctagcttttggatgagcaactctgtgcaagttccccaacctctgttcaacttcaaaataagggcagttatactgaacgcctgtatgggtgctatgaggattacatgagatatatagtaaagctagccaaaaaacattggttatgggccaggtcccaaaatgttacaaaatgagctgggcatggtgactcatacctgtaatcccagtggtttgggcagctgagacaagaggattgtttgatgccaagagtttgagaccagcctgggcaacatagcaagaccccatctctacaaaaaattaaaaaattagccgggaatgatggctcatgactgtagtcagctactcagaggctgaggcaggaggattgcttgagccaggagtttggggctgtagtatgccatgctcacacctgtatagccacctcattccagcttgggctgttagcgagaccttgtctctttaaaaaaacaaaacaaaacaaaaaagatttttgcatatcattgaaaatctatgaagtggttttttttttttaatttataaatatacgttattcaaccggttgcctatttttgagcaattaaagtgggttttccctactacaagtaactacagtgaatgtccttgagtgagatacataattatttctttaggaccaattccaagaagtggaatggcacagttaaaggatagatattttttttaagaactatgataatatttccaaataccaatgtctgctctactaaaaaagtagtgagaatggtcatttcctcagtctgtgatcagtgctggatatttaggtttttaaatatctttgctattttagaggtagaaaatatcttatagtttttttgatttttatttctggtaacagctgagcttaaataatggtatattttattatgtactgtgtttctttcatacaatattgtttaattttgttcagtttttcctttagagtattgtctgtcttattagtttgtaggacattgactgttttcacttttgttgcagatacctcaagtttggcattccattcattcaaaaaacccaccgtttttagataacccactgacatggtgaagtaaggacattgttaggaaaaaggcatgtaggatgtggaacatgaatcaaaagagaactatcctggatgatctctttgttgttaagcccagtgattgtctgagggagtgggattggtggggatctcactgagtgctgactgtccagaactcactttctcattgtgatctgactccagttgttcaaaagccgttccttactgggagaagtcagagcatgggatatcccttgagagtatatgtgaaatgcattactttgaagaattggttttggaacactaaagtggataatggaagcagctatttcattcttacagctctggagtaaaatggcgatgatctttggtctaccccaaaactgtcttaaatttcgcttgctttggctaactctgataggaaatagctatgggagagtaggaagggaatggggcttagagcccataattcaaaccctactaccacttctaggtatgagctgtgtaaccctgcacaggttacttatctccgttttctagattttatgcggtccatttggcatgtcctaagcacccagtacatgttcattaattattttttctcttctcaccaggtctggtctatgtcatgttcatctctatcctcattagcgtgatagtctctttgagattatttgatgaccaaattaatggggctggagtgtaacagcttaagagcaggtacattctgaagagtgagaataaactttgtctgtgtattatttactgtttaagaaaaaagaaaaaaacagccctcatggtgttgatggattttgggtaatcaagggagatttggaatatccctctcttttcgacatgtgacagcctgtctaggtgagggccagggtcacaatgatggttctgattgttcctctccaggagggcccctgaactttgacatcatctcctaacgcagttctgccggaggccttcctgtcagagcctcctgggccagaatgggcctctgtggcgagccgggcctgtaactgttcccactcataatgagcagagctgctcctgcaacccggcaggagcacccgagtgggtgtgcatgcacataatgggcccagctgctgtggctgcagcctgtgaatgccttccaagaggccagatgcctggacacatctctcagcagctacttttcctttaagggggatgataactccctggcgcttatccctagtacctctgacaaggaaaggaaatccatcctgccctgaacagcagggtgagcaccttcacctgattcagtctcatgcatctcagcaagggagatgctagtatctaattgtcttagtttcctagggctgccataacacaatagtgtaaactaggtgacctaaaacaacaggcatttattttctcacagttctggaggtgagaagctggaggttgaggggttggcagggccatgttttctcaagtctttaggggaggatgtgttctgtgcctttctcttaaaggctactgtgttgccatcaatgcttggctttccttatctcacagctgttaatttcagtctctaactttgttgtctcatggtattctctcctagggttgtcgttgcattatcttcttgtaaggacaattgtcatattgaactaagggatcgccctactccagtatgaccttgactgatcatatcttcaatgacaccatctctgaataaggtcaaatttgaggtgtactgagggttaacacttcaacaaatctttttggggcatgcaattcaacccataactctcatgttgcatacatgggtgcaggtttaaagaggatcagtaatttgggtatggtcacaattaggcagtgttgggaccaggattggaactcaggccagcctgtccaaagccacttctctttctactaaactttggtgtgtcagaatcacttggagggctgataagaaagactggggcccaggctttatacccttgctcctccacctgtggtccatggaccaactggcaacatcagcatcacctgagagctttttttggaaatgcagagtctcaggtcccaccacatacatatttttaacaagatccccaggtgatttgggtgtgcagtcagtttgatgaagcacctgaatcgggtatacgctgcttctcagtcctgattgcatattagattgcttgagaacagtaaaagacaaaacacaaataacagtgatggcagccttaccccacgccattgaatcagatctctgatgaggcactgacgtttatattttttaaaagctgcccagattattctgattcacagtataagttgaggaccactgtggggctggaggtcctcatttctggaatatccagacttcaatattgaggttgagaattctttttgcacaggttcttctttttatttccacagtagtgcagaaactgggccaggaggggggctagtgtacggaatttatttcagagaaggcagaatattatatagcaaaggagaccacagtgcattttttttctgactttacctcttacagatactaagtgttgggtagcaacctatttgtccaccccaggagcttgggagaacatgaaaggtggtgtggagatagcatatagtgggcagtcagtgcttgttgaattaaattgaataacaaaaaccataggaaatcagcgttgttggtctcactgaaacatatcatttatagagatgctattgtgttacttttggggtacaaggaagagttgcagaagactgcacagatgcttacgatgtttagcaattcttaggctacgtgggatggcttatgcttgtaatcccagcactttgggaggctgaggcgggcggatcacttgagtttaggagtttgagaccagcctgggcaatgtggtgaaaccagtctccacaaaaaatacaaaaattagctgggtgtgatgtcacacacctgtagtctcagctacttgggaggctgagatgggaggatcacctgagcccaaggaggttgaggcttcagtgagccatgatcgcaccactgcactgcagcctgggcaacagagctagatcctgactcaaaaaaaaaaaaaatttagcaattcttgttatatcaataaacatggaagagttattggaagttttgagaataaagtgggagcaccccttaatatctacagatgtggccgggtgcggtagctcatgcttgtaatcccagcactttgggaggccgaggtgggcggatcacgaggtcaggagatcgagaacatcctggctaacacggtgaaaccccatctctactaaaaaatacaaaaaaattagctgggtgtggtggcgggcacctgtaatcccagctactgaggaggctgaggcaggagaatggcgtgaacccgggaggcggagcttgcagtgagccaagattgcgccactgctctccagcctgggaaacagcaagactccatctcaaaacacaaaaaacctacagatgtattttccgttgtaggttttgtggtgaggggaagcactagtatcccagatggtgacctcttaacttttaattcttcaacatagacttgaagaaggatggtgattgtgttcagaccatcttgccctactgttccctcaaactctgtcccatcagtccttctcctcttagctgatcttttggacaatcacagaatgtggggaaggggctcatttcagtctggggtcttgatgtagcatgcatttggtcctcagactagggctttcacagacggttggcaccctatccaatgacaattctagtgtccttttctcattcctggacttcttgacgtttgtgcttttgtaccccctggtgtgccacccaccccatcccatctgaaaatccttggtacagcccttaagtcttggatgtgcatgctgtccctctctttttttttttttaaactaacctttcttcctcttcctgactccactaagtagtggttatctttaaggttttatttatcccctcttttttgtaggggtttcctccactctgccaattttactgtcctatctgtgcagaggatcaccatttctcttccaaatggttgtcccttcatcaccaaaacatcccatacattgaaaatggaattctccaacttctcttgttttctggcttgcttttttatgtcagtgtatcctatctactatttttcaaagccccttgtctttgaaacctcctatttgatttaccctgtagggactgatcagtcccttactcttccattctcctttgggacatcttttgtatgttcatttttcctttggataattctcattatccaaactcttaattgcctgatacctggatgagtctctagctatgctttccatccctgcaatggaaattaaactttttattaaagccgtttgtgtaacatatcaactctacctgtatttccacttttatgttgcagtactgccctggtggcctcagctccagctacactattgtttttacctttcccatagttgcctcctgcacacatgctctgtggttggcccccgttgctgactgctgattggagatgacgtgtacccatcctctagacagtctgtgcttttcctgtctttggagcttccagttccacccccatcagtttttttctgaccactccatcttgccttatttctctctctttccttttgactggaagagtactcatcttttctaacatcttttcataaactgttttgatttcacttatattgatttttaacgtataatgtgctggtgttctatttcctcagttagatcagaaggcccctaaagacagggctccattggtgttaaactgccatcttcaaggtctgggacttgatttctctttttttacctccacaacaaggcactcctctgcacccagtcggaattcagtgcctgtggtcaagtaaatgcatgaaggaagttggaacccgtggtgggtatgtttatttaaatgtgtaaaccaagaatgccttatggtgtgtatgccagaagtgaagttctcatctgtaattaccaatgaagaaaacaccttgtatttacggttgagtttggcaccaaatcagcactggtctttccttccatggtacaaatgttgtaaaactctgaatgctgcgtttccataaaaggagcatgcatttctgtggaggtggtgattgatgttggatgcctttaggcggtgccatcctactcatgagggaagcagtgctgttctaggctcagtccacgaattggtttgccttttctcctttcccaactctgccacctggaaaacaaaacaaaagcaacaacaaaaccccccccaggcattctgcctgctggcaccctgttagaataaaaagattagaacacttggtatctgttcactcactcaggtgaagtttgagatgtcctactgggcttttctatctgtagacccatgaaaatctcattgaagaggtgttgtggaaacatgagaaatacatgtttatcatcatttgtttgtttatttacctacctgtctaccaaattagaaaagttccaggcgtttatctcagtgttttacaaatattaacttgtttaatttaaatttcataaccaccctgagaattgagtggtatgttttcattatcccacttcacagataaggaatctgggcacagagcactgaaggcgcttgttaatagtcacatgcaatctttttcctatttcttggcttccagtaatttttcaggtaactaaatgcctgtgattcccaattaggtgtcgagttctatggcttttatttctataaatcattctggtttctttttatggtcatggctgtacttgtgtttccctctgaaattggcagaagatgagtgtgtgtgtgtcagcgtttttaacacccactaaaaataaatctcctacagtgctttacagtttataattgctttttcagatattatcttccttagtccagcaatgctggtaagaagagttattatttatttccatttaacaaatgaagtaagtggcttagagaggttaagagactgaacatatccttaatgtgattagtaccttggaatttgaacccaagtcctcttaatcctttgctcttccaagctgttacgctgcttgtaaattgggaaaccctatagtctgtttttcttgaagttctttgtttttctaacctccgtcaaaataatgtagtgttttgcttttttttaaacttatatcccaagcctgtatggtagaagatgtgaaagtaggggggttgagaatgcagtttttttgaaagagaggagtttatcagatgccacaagaaatacttttttctgtttttctttgatagcaaaagagtaaaaattttgcaaggcttttcttgatatttttggagtccaggggaataagtgcataatggtaataattaaatacagtttccagtaagggagttttctcaggtttagctgcacaggcttagaaagttgggtgagagaaggctttgaggagagattagaagttggagagcccatctgtcgtgccagtatacaaaaatgtccgtggatgatgactgcttgcacctccagagctagtctcctctaggaaaaatcaacagtcaccagtgcaggagaatgaatgagtcagagctctgggtcctgagccggttttacctcttagctttgtgatcttgcataaattatccaaaggatctggactgcagtttagttcagtgtagcaagctttgatcaaacagctatgtgccaggtactgtggtaggtgctctggagagaaatacaaattagataaggcttctgctcttggatagttctcataccagctggggagactgacaggaaacacagcgatggttcctgctgtgttagagatacgttcagagggctgataagggagggggacgcaaagcatatcaatcagggaattctactaaggtgctgattcaaggtcagcttccctcctcctgaccgctgtacttagcacagcacgtagaggggactgtagggaatgcaatgaaagtgaatggtgacaaaaaaatgaaaaagagcctcaaggcaggagccatggttttctcctctggggtgggaattttcttcaatctgggaatactgtggtggggcctctcatcttcctttcctcccttctctgcccccaagcaccatgtctttttcctagcacaaggctagtctcatagatttctaagagtcctatatagctgtctttatcttaggcactagcctaagtaccccttgtgaatggggttggttgcatctttgtgttctcagtgtcagcaccatgcctggcacagaattggtggtttaaaaattctgttgaatgcatggatggatggggattgctggaagcacagcctggaaggagcagaggaaggagagattgaaacgagaagagtgagatgtccctgggcaatggctgatgaaatttaacccaggcagggaggggcttgggctgaaagccttattaaaaagctgccatctgcaaagcaagaatttaactccttggtttcacaagaaaagagtaagtgtagcctagaaattggggctggatttgaaaattagccccaattctgcaattttcaccgcaataaaagcttctccagttatacatggtgattggtcttgatgggctattgtggacagaggagggtgctaggttggggtggacggggccacagctcagactaaaaatccccttttctctcttcatgagcttggctgcagatgtagaaactagagctaacagcagttttacctcatcttaaagaaaagtagtaaattaatggaggctttaattaattgctgtggtctgttgagtacttactataggctaagggctgtagggaacactttaattcactgaataatgtcagtaactctgtgaaatagatattagtgacctattttgcagatgcacaaactgaagctcaaaggggttttcacagatagtgcaatactaagttggagccttggtttgaacctgagcgtgtctgcttccaaagcccatgctcttaggtggattttcagtgatgccagaagatggttggactttcctgaagatgtttatgtgcattgtcgccacagagtcaaaccaagaattgtatggttgtatttcattcagaatcataacatgcttaatccagatgatgcctcagatgatgaaggtgggttgcccacaggctgtattgattggtgattcttaagagtgtaaaaaaaggaaatcacttgattttgttgtggggaggcagaatgtatcacacaatagcttggttgagtttggcttaatgtagatatgtttaatataattagactgagggctgaaatgggcaccttcaggtcactgtggaatgagacagagccctcactagatttttgagtcacttgaggtggttatgccaagccctgttcacatttcacacttgagtttaagtatttgtgaagggaatatagatctttggtttgaactagatatagctcaaaggttacccattcagaacagagcatttcagcctcagggcacctacttagcctctaagatgagaccacatctgaaccagccaagtcagcctgggatgaggttggaggagaaaaattcatgtgataagtcagattacaattaacttttttgttattactttttgagtgaccacaatgtgtgtgggacttcgaaatatggaataatgatgggttttattatttctttttgagaaaaatccagtcactttttttttaacccgaggaagttgaatcctgaagaaggggagatttatctctgccctttgaacttaaagcccataaagtaaaatatatagtttaaaacaattacatgttccccccatctcaccgccgcccgacccttcacagatagtgtttgacaaaacactatttaggaaagtgcctgactggtggtggaggggccttgcttcctgtgaatctgcattccctgtgccacttgcttccttccctgagaggttctggtggccaggtgttatgaatccaggtcaagatgaagaaaacacacttttgtcatttcttcaggcatgtggccgacccgaccgggtctcaggtattccagatatgagcgatgtgccgattgcgcaaggctggaagcattgctcactcggagataccgaggcctgcttgccccgagccctttgttctcctggttgaaagcagttaattagcaactgtctccatagcaacaccctcatagtccaaaaacattgtctagtttttcagtttagcttatcacactgtttacctgaagggcttttcactgctctgagtctcatttgagttggcggcatgcctgttggggaagtgaattgtcaagatagaaaaaaacaccatggtagcaagaagccgaggagacttctctctacccagcccaacccgggccctggattctgggaaaacagaagttgcgcctgcctaacattttcacctgtattttttttttttgttttgccataaaactgctgttctctccaccaagccctgaattgtgaggatttttcccccctttccccgagaggctttctaagctctttaatattccctgtttatagtacatttccatgattagtcatcttgaaaccccgagtgttctcagcccctgtacattcgaggaaattttgcttccctgagggtcttggcatttgcaaaggcccttggatgaaggattatgagtctgaatgtgaattagtcagagcagctttgtttttaggcataatgaggaaaggcttctctttcttggtttaagttcattgtttgtgggaagaaggcaacttcaggtggcttgttggtaaaataggaaaggaaactgtagcttttttataagccatgcaatgaagataattttcatagctttcatggactgagtgcagtctgtgtggccctccatgccagctgtgtggccctctgtgcctgctgtgtggctcatggcgccagctgtgtggctctccgtgctgggacgcttaggagctttttatctcacatctgcaatgggaagacaggaggcagatgggaaagaagactgcatttcctgaatgcctaccacatttcagttgctgagccagactttcacaaaatgaggtctcctgtatccttcacagcaaacctgctaacgaggccctattaagtattttaaagatgggaaactggggttccaaggagtcgttgcctgcccaaggttgtggaattctaatctagacctgttggtttataggacgccaacacttgtcctgaagcagcgttgtggatttggtggtggagttaggcggtacgtatcacagattgcagggctctgggagacttttgctaaggaggttagttagaatttggtggtgtacatgtgtaattagatgcctaagtatgtctcaggaaatcatgaagcttaggtccagtgataaaatagtagaatttaattttgaggcacgtgtgccagagcttatttacccaaacaaatgtaattctctttgaagtattaacttggaaagactgtgctttgtgatatttccattcttcagacctttttaaggaaactttatgggagcaagtgctttcccagcttgcaaaatacggctttgaatgcattcagcagaccattcttgagcattgaactccccttaatatgggcagagaagtatggcttttccctagcggtggtccctgggacctagcatgggttcaccaagaacgagccaccccaggctagcttcgcttctttctctgaaaaccttattaagcagaaaactatagtttatacaatgcataaatgagacctttgatctgctttttaattttatctactgtgttgaaaacagagacatagtctgagctgaatgcaagaactatggtctgaactgccccttagttaatacctaagagtgacaaacatgtgttgtaatgggagatcagtactatgtgatttttgttgactgtgcgatcacagtaagtttgtgatgtggcttctgcagaagcgagtgttacctcggagtgtgcagatagaggaggatgcataccatgttagaacacacttggagccaggggttctgttttccttccttcgctccctgcctctctccactatactgtatgccaggtacctttctatgtgttgggatgcaaaggtggacaaaagaaagcccctttagagagaacgtaaaaactagggtttcttcagagggcagcaccccagatgataaagagaagaaaccacatgtcacacaaaatcattcaaaggatggggtggatgtgggagtggtagtatttgccctgacttagaaaagactctgcagagacatgggtgaagaagcagcacatttgtccagtagactctagttataatcttaaaaggcagtcacattttggctcaattataaaaaagatattcttcacagtcctgcaaaggtggactgggcttctgctttaggatatagcgagaagtattgaagcagggatcaaaagaccatttggtggcttactgtgaaggtcaacaatataatgaatctcctttaaaatttccagtcatgaaaattgtataagtgagcaggcatgtcatctgcctgcaagacacatgctagtaatgaaggaagatgtatatcacaatgaacatgcctgctttatattgtttatttatttctttgggggcagctgaatatgatcaatttagagatgttagaacatttgtaactatagtttgtgagatgggcaattttaactgcaggaagtcttcagaatcacagcacaggttcaattcactgtggttgttatgtcataattatatattgtggatgtctaattccttttcaaacctagaagtaaagatcatgtaacatatcctagccaatattaaagcaatattattataaaaatgatctctgatgtagaaccactagaattagggccttaggtctacccatattgagtttgccctttttatttgcaaaatgcttgatcccagattgctatgagagatagacataatagtgatctttctgcttttgatagttaggtatcatagttttaagacagcccatggagttttagaaattgtgtctgtgtctacagaatcatgtgtgtgattagataaagattagtaggtacagaaactagctgaagcattgattgatacaccttgtaccttccaaagaattgatctgtttaaatcaagttagttttacagctccgtttgttgcttctctagattgattaggtggttttatgatgtttcttttatttttttcactaggaattttgctgagtatttttaatacctgaattgacagactggtttatcggtgttgggggtctgtgtgagcttctcattagtccatttacaatggcagcactttcatgtttaaatgtagacaaacctgtccctaatatttatggagcctgaggcaaagagtgtcagtggaagctcatgtactctatgttgaaatatttaaaggaaaattcgagttaatacactgttaaataacattttctcacctcctactttgacaaatttactttaataataacttggaacccaggttcaaatttagaggcctgcccccttctcttcccactccagctgtatgttgtaacatgttcatatggatgctgcagattgcacaagcaaaccttcttctccttcctcctgctaacagctgttcccaggccactccttgcagtgaagcatactcacacctgtgacacaatctgcccttttgagaacagattcagggaagtggcctacacagaccttggaagtggaaaagggttattggcttgagagttccaaagtcttgggtccttggtcgatggtctaaaaggtgagggtgttaggtgaagtgtcctcttgatcctcaaaggctcctcaccctgggaggaggaggaagatggccagaagaagaccagagcaagaccctctaaagtctagggcccaagttgggccctctggccgaggtctaaggactgtacagaatatggataaaagcatgactaacttccaactgcctttcatacttcagagcttgaaaccgagtagtttcaaccaagtagttgggttggcctaagtagctttgccatttaacctcgtaaatgatctaaacatcaacatagtctgagagttgaataaaaaataagtgaagtagttgttcattgtcaggtcaggtttgaattctctcatacttgaaatccctgcaactgtgaaattgcctgtaggaattgcaggttgtgctaaacaatcaaacgaattggtaggttggctcccataggcaaaatcttgaggctgtttggggcaaaaaaaattacaaaatataactagtaataagtgggatgcaataagaatcaaatgtgatccaattttctggggaagcaaattgcattgcactttgttttattttaaaaaatgatgtgaaaatacagagcatcacagcacagacaaatatcttacaccagttttcacaataaaatccccaaatgtgaaagctctccctttttgcaaaggcactttggaagcaataatgtttgtgtgcatagttgagtttatcagagtatactgattttttatcccatgaggttttcaaggaaagtgcagctggtcaacctttagtgttttctttgccacagggtatagttctgtttctgtccgctcaaatacagtctttcaggaaacgaattctctgtaggataccttaaaatgtctttgtgttgtaacacagggtagggggcagtatgtttaataggttagtgtggatacgtgggtcctgaaatcacagtcctgctttttgctcctggctctgccacttctagttacttgtgtaaccttgagcaagttacttaaccttctctaagtttcagttttctcatcagtaaagtgggttgaataatagtgcctttgttaaaaggtaggtatgaggattgaaaagtataggtaaaggggttagcacatagttaacattcaataaatgcaaactattaatcactattagctcacttgtgtaaggaaggcctatgggtttatagaaaggtaacattttgtggtaagagaacctctccaggggaacctctgtaaactccagagggctgcacggaaaattccactgtggatgatgggccttctcccggagtttacctgttaaggtgaagtaggtcgtgctttgaagtgcttggcagtggccagacctggacaggtactgagagttgcactgggtgctgtggttgctgtgtccccgccttccatcctaggtagcagatggtagtccttactcatctctgaagagtcctaagtagcccgagtcctagatgtaatttgttgcttatccgcaaagtggttttgaaggatatggtttttcttctttgggtatgaaacataagaggatgaaggaaaaatgagaagttttgtttctaaatgaatatagtacacagcctcagaaaatatggggaaaagatgagaaggaaaattatttttatttctaaatgcactattcatttcattttccaagtaacttgtggctatcattatttttagtgatttatgcttaaatagtcttccttgggaataatcaaatactggcttcaaatatagacagggaaattataggtcatagtaggctcataaaataacgcttagaatgaacttgggatgggacgtggaacagggcagcagactttccaccaggcgccattcctgtgttctcagctctacccttgagccttctctagtggggccccaaatgcaccaccatgatgtaagggtctgaccaactacttagtttctagcagcccagagtgaaggcacctctctgtgccttcctcttcgctaagcctcagtttttttgtttttgtttttttcccttgcaaaaattgagacagtagtgtccaatttgcagagggtctctgagaatgaaatcagaggcacgtagcaactgcctggacagtgccagcactccacctgccacccctccccactgccctctatttgtggagaggtggatgattttgctagtcacaaagcctgtcttctttgagacagtagggaaaaagcaaccactgtgattcacagaatttcctgaataggcacagctgcaatttctctgcctttactcatcaccataaacatactttaaagttgtcagttatgttttctttctcatttttggtgttgaaaaaaattaacctttgagtttcagtttccttttctgtaaaatggggagaagaatagctcccattccataaggtggctgtgagaatgtgagaatacaggtgacaggctgcataattctcgcaaaatgctgttggagtccctagaaggggaggaggggagctgtgaaatccggtttggaattgggaattttcatcctgagcttgtgttaaggaaaggaatgaggcccatcccaaagtagaaaccaaaaacgttcttactgaatatggcacaagcactggttttctttcctaatgagtgtggtcattattagagttaagcctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtccccattgacagggagcatgttaagggtaagatgctgcatttcactcattgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtctaaaggagggggcaaaacgtagcgtcctgtgcttcaccactgggggctggctgggccactgttaaggtctgtggagacttctgtttgcaggagaggttgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattcttttttttttttttttttttttttgagatggagcctccctctgtcgtccaggctgtagtgcagttgtgcaatcttagctcactgcaagctccacctcctgggttcaagcagttctcctgactcagccttccgagtagttgggactataggcgcacaccaccacgcctggctaatttttgtatatttagtagagacagggtttcaccatgttggtcaggctagtcttgaactcttgacctcgtgatccgcccacctcaacctcccaaagtgctgggattaaaggcttgagccactgcgcccttcctctttccccattcttaagtacctagtaacaggtctgagctgtttagaggtgtaagggagcttgcgaagttgggaagtgtccggatgtatggacgctggagcattttccccatgagggtctaagcctgggaaaatggccagattctactcagagacattctcccattttcttaaactaggggtgtgctgggagaactctgggctccttgcccacaggacagccgagaagcttttgtcttcccctctcttgctgagacacatcctccctctgaacttcccaccttagtcttcggagtcgttttagactcgagattgctagtgacttgaaggttctggtctttctgctatgattgggatctgtgctgcacccctgggtctggcagtgtccccagcagtgggatgctgcccagcagtaggtctttcatgctgacgagcacagtggctgatgtcattgtgggggagttccttctgtggccatagaggtcttggtctttaacgctatatctcctcctccctggccctgaaataaattcctttgggctgctaactctccttcctttagtggctgctgttagttaatagtccttttcctagactggtgagatggttgctttcatctcagcctgtgaggctgggagtcatttggatggaggtggccagaagctacttgaatgctccacggctatagaggacattcagcatccattctgtttttcttaccaaatgcatagaggccagccctctcactggctcattgtatgattcaggtgggatgacgtcccttgcaactctggaagtagaccgtgattgatataagcctaaaacagctatgtccacggcgattgattgagggatggtgcctgaccagtcacatccagtgagatagaggagatatctttctggggctgctgggaaagtaaagctttctttcgctgaagctttcagaagagaatcacacatcctgtggatggtgtagggtgaggacatgagttctatatgggagcagttttctttcataagaatcccacacatgtgcaggactggttactggttggaaccactaagtaacctattgggaggcagattggtaatgatgccatctaagctgttggaacaagacttcttagttaaataagccactaagccccctccattgcttaaaagccagtttgatcattgtttcttagaacatagtgacctgatatgcagaccttcctcttgtgaatttgttgaggacttttcctacaaggtcttctccaaggtctgtgtgagggttcggcattagcatctgggaagccagggatcctcatgctaaggcagaacaaaaacaggagtcagggctggagaggggcgtctgtggtctctggggcaaggcagcttgaggtgggacccagaagtccagggaatcagagaggaacagtgggttggagtagatctgtgggttggaataggtctgtgagaggtcttaggggagtggtcttgcccacagtggagtggccccgaatccactgaggatcccgggatgggggtgcaggccttcggttatcatagactgtatatgtgtatctgggtgggggtgggggtgggggtagggtggtgtgtctaagttctttcatgtctggggtggtgttgtagatcgaacttctcccaaacaggctcagccacaccggtaggacgtagtctcttcctgttttgctttatgatgttcctgtctcttaagctgaaaagagcccctgaaagccactatttagttgcctatactgacacacacctgcgattggatggatcgtctcacacagagagttatgcaccattcatagctaacctcagggccggggtggtgctcagaaacactgtctttatgatatacatgggcttttgagctcgtggcttgtggttgtggactgagaaaattgcttcctgggtttatagagatggtaggggaaatgaccctcttgccaccacttattcagtgatggcttcctggtgtgatgcttggggatggatgtgactgaaaggatttcaggagttaattggaagagtacatcatagcatgcatgattgatccctatgtggtattatcattattagaatcccaaaaaggtgatggttaaaagagtacttaactatttgctggtcactggagagatggaaacactgaacatgtttgtccttatcctgcaagagctcagagcctaatatggacagcagatctgtaataaatattgtaggggatggtagagggacagattcacattgacacaaatttttaaaaagtaaatatttaaaagtaaactttttccctccagaatattactggtattcatcttcttccagatagaatatctaatataaaacctatgaaatttatcaagagaaggcttaatacaggagatgctggaagcgcatagattttcctcaaatccctcttggtacatgtgaatccactacatccagaatcaggccatgcatcttcaccaaatcattccctttggggaagtcgtggctcagtgctcttctggttcaggaacactgagccagagtaaatcacccctaatggtcctctctgcagccagtgagatttctaatacagcaagaattcaatagaacaatacctttctaaggtactagctagactgttaagaggggctaatgtggtagcagcctcctggcacaaaggcaagggtctgtggttagtgactgtcgtgtctgtctgagcagggagaatgtccgtgagcagaatagctggtgtccagatgctcctagtgaacttttatcagtgagcagacgtggcctgggagggcaagccagacagtccagccggcttggagctggaagggaggagttcagtcttaggtcaagatactgtgctgagggaggtggagctgtagaggcagtgggcaaactgggggctccctgggagccctggaagcagcttccaccactttggatatttggcaattggaggtggaaggatgccagggaaggtgtttgggtttcttttctctgtgaagttatggcagtgccatcttccaatcagccatcaagagagccacctttaagagtgcctcaagtgagccaaattaggggatcgccgggacagaaaagctgctgaggtgggatgagcactgtggatcatcttctgcccttctggaagtctttgtgggctggacatcccaaatgtgggcctgggaaaataacatttcccatacttcatgtgtgtatgtttcattttttacagtggtgcttttgataagcagtgtaacatcaaagccaagaactgtgctttccatttctggaaatatgaggagcccagaggcttctctttgagataagagctgtgtgactgtgtgagctacttaatttctccaaacttcagtgtgcaccttctttgcagggctgtataaggattcattgagatgctaaccatgacacacttggctcacagtgggtacttagtccttgtcagctttcctgcccgtctgcaggggtggcagtggtgccagggggtggcgtgctgaactgcaagttcatctgggatctcctggttgtgtttggatttagctggggtgtgtcctctcctcctacaccttgagtcaccagccaaggtggaggagagaggatggggtgtagcctgtgtccagctctctcttggacatggttgggaggtgctgaccacaagtccgaggccctgaaaagaagtgctgcaaggaggatgtttctttccccattggcacagcatcaaggttctcaacagctggacacaaacaagctgttctgggagccgtgtctcattccccttcacctcctgcttgctgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaagggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagacatgttaggaagcttgtcacaccgtaagcaagacagccaggaattctgatctcaagtccagccacccctgaccatcgcagagctctgtgtgtgtgtgtgtgtgtgtgtgtgtgtgtgtgtgtgtgtgtgtgtgtgtgtgtgtgtgtgtccccgtccgtcccgagctgtgtgtgtgtgtctgtgtgtgtgtgcacgcgtcccggagcgcacgcacccatcagtgaatgctgcctccacgtgggcaaggcatatgcgtttttctttcattattctcagaaacaggcatccagtgcagaacgggcctgtaatggttgctgactaagtgcttaatggagatgtttctgctgataagcctcagttgaaaagggaaagacgcaggcaagctggccaacatcaaagccgggctttgtttatagataagggtaggtttcattctgtgggttccagagcccctgtccccaaatctcagagggggtgagttttaaacagaaactgtgtttatctcccgcagtgggctggaagacaggcctgctgggactcagaagcttccctccctcccatcctcccttccttcctttttccctttcttcttccctccctcccttcccagatagctagccactgccctcatttataacataacataaataatgctctctctgccccagctgtttccgtttggtttttgttcttcacatattttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagtatagaaattcaacagttttaagggcatttgtgatatatgtgtatgtgttacttatgtgttcttcaggacacagatggggccaaaggacaaattttctgtgttttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttgggcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgccccaggagccccttttcttctgcacgctctttttccaggggatttcagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgactctccagtgctagggacagggatctcaagatgagtaagacctggttcctgctcttaagatgctcatggtttagtggaggggacaaagtgggacacaggtgatgatggcattacaatgagaatgtagagaacctacaactgctgcacccctccctgttcttcaagatgccttctctggccatcagggcagcatgtgcagaggcccgctggtttggaatagtgtttctttccatgtgtgatgcagcgttccctcaaagccgaggcgaggtttatgcacactgcccaattgaaatgtgtctcatgttcactcgctgctggatcagcagaacctcgcgcagggcactccttgggctcacgctagctactttgcctttgtttcttcaggccttgcgctgcttggattgaattggattctgccacgctgatattattatctcacgcctttaaagccagaatttgtaataaactactaatgttcttggaataaaggcacttcagagcatgcgtagcttgaaataattcttctaacacctagaaattagccaattttacttttgaaggagatgagaataaacatttagtggtcagccagacggagaataaatggccagcatttgagattttcctgctcctgtttatggagagagactggcatgtacctaattcccaacttgttgatctgttgtaccctattttaattattttgccagatgtaaacattttcccttttttgtgaacggagtgtttacaccatctatcacatttaatgtattcggtgcctgtgagtgccgacctcttcaaaatttgtcgacttcatcatccgtgtgctgtccagaaatgagatcttgatgccccccaaatgaattatgaaaagcttttcatagtaatataattgatccactgttggccacacttataaaaaaatcaatgttaacgtgttaatatttcatgagtacccacgttgccagctccttgcaatgggaccaaactataaagaatgagaattgtttcacagtagcccagcacatggacagagtgccaagaaagggagttcagggttgacttgaaagtttgaagcgcaacagggccattgaaacacagtcctctgactcatgtcagattgttataattatttaatgcccacaatgcagctttgtccccacggatttatactggagaggtttcttacccacacattgtggttattagctgcaaagaaagcggcgtttgtttataatgacatggggtatatctggatggcaaagaaaacactgcagattctgtcttcttaggaaggaggcaggaatttggcagataacctataggaaattgggagacatgctgtcattacttttcatatatgtgggtggttgcagccaataaccattagacaccttttagttttcacctttgtcccaaactcttgagagaatggaattgcatgcttacttttcatctatatgacgttatacagctggtatgcccagagtgtatctcaacttaatctttttaaatgtgtctcccaaaatccctttctcaaggttctacatcctgcctccatgaaatttggtgtcaccaacattgtcttacagaaccactgttactatttttataaagagtttataaatatgttttgaaaagttctcatgtggctagatctcatcaagggattttttttcagacttgaaaaataaagttaaagaagtaaggctttggggcctccctggggacatgtctggtttggagatcagtggtggtgctaatggccctgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgtgaaattgtccgcaggtacttacaagctggggtgtgcagatgcaatttataattgcaccggaaatacttgtaacctttatcatgcttagtggtggaaataagaaaatctatgtgagtcagcttagtactaacttgggaccaatatgaagcaactgaatcctcttaggttttgcaagagagctacaaatagaaagcagacacaaaacataggctagagtaacagtaaatgtatctggagcctcaaatcaggactcatatattcaattccttattttttgttttctggttcaacaggaagtctgggagatctataggaatttgaattacctttaatggtttatggggaccagagaacctaaactttagaattgggattgtcctggaaaatctggaacacatattgacccagatccagacagtgggttatggaatatgatgcagatgatgagccaattaagagaaaggtttgcatttaagcatcttcctcttgtactggtgactgagtgactccaaggtggcaccattatcaccggtgcttgtgcagaggtgatttttttttttttttttacactttgctgtctgaaatgctttaaatgattcttttaattaaaaaaattagttacctatataaatattcacttggtaaccccttcatttaaacagtccatttatgccttatgcacttgtatgtgtgtgtgtgttgtgtttcacggtaacaaagttttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccaccaagcccggccggtaacaaagtcttaaaagcggtcttattctgtaatacgttggccagttttaaaccatttgcagtaatgcatttaaaagatgttatttcatagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcgttctccttctcacccaaaccatgatctcagatcttaggagttacaggtcagacatgtcacggagcctgtttgagatcagttgtctacgttggtgatgaaattataacaccctaaaagaagactttggagtaggaacttgccagggtcatcagacatggttgggttgagagaggaaatgcgattatacaaaaaacgtagaatacaaagtagtgcttattctgtgatcatggctactgtttcaggggacaggactagaagggaacccggacaaagaaaaacccttggcctgtgcaggctgtggggttgtgagtgctgtttccccaaattaaaatatctttattattgtcatgattttgttgtgccattgaggtacattaacttaaataaatcaaagcgaacaattttaagatgacgagtaagtctggagaaaaacctaggaccccagaaagaaggcatattgtacatcccagtctgctgtaacttccggagctgctgctgatgacaaagggctttaaggcaagggaagtgtttgcagcactttgggggctctatgcctgtctgcatgcttgtttagtttttgccatggcctgttcaccagcctgtctgccctgaaactgggaaaggtggatccagctgctgtccaggccttcaagaagcagagccccattcaattgtccacttctctgttgctgcccagagccagatcctgtgtgggatacttggcttttcaagggcctgtgtatggtgtgttgttgagtagaaatgtctgagatgctcctttagtagcacctgattcttttggatcagtgatttgccatttcttatatgaaaacgagaagttcagagttttgaattctggccccagttccatcactttcttgccctgtgaccctgttctcctcccaaaacctttctgagtcttcatcattaataatgtttaattggatcacatgaaatgatacaggtgaaagcatttagaaatggaaagcactgtgggggaatatttttgttcataattgtatcataatgtggacatggagagttaacctttgtcagcgcttagtttctcagcctttttatctattaaatgggagtacaaatgataccttcattgggggttccctgagcatgcagtcggaaactatgacctcttctggaggaccatgacttttattttttgactctatagtgtaggaacatcttaattaaagattatggaaaaaaatgaaaaatgggtttataaaaaaatgcccagatccaatttcatgtatttgtaaactattgatcaacaacctgtgtggaacctatggccggatatgaattatccagtattagcattgatatgaatgcttttatcaatagagcattgataaggcatttcatggaacacacatgtcagctcgttctctcactttacctacctcctccgctgtctgcctcccctctgccttagatcttctccctccccttttctctttcctcttttcctatactctctctcctttttctcttttccttttttttttttttttttttgagacagagtctctctctgtcacccaggctggagtgcagtggcgcgatctccgctcactgcaagctccgcctcccaggttcacaccattctcctgcctcagcctcctgagtagctgggactacaggcacccaccaccatgcccggctaattttttgtatttttagtagagacagggtttcaccatgttggccaggatggtctcgatctcctgacccattatccgcccgcctcggcctcccgaagtgttgggattacaggcgtgagccaccggcagttgtgctgcaactgtagagaaactagaggtctaatttctcaaatactggtcctctgtgaattgaaatatagatcctccctcacagatatagattcggtgactgaaataattattttgaaggaaccattgcatacgtgacatacttactgtcagataaagtctttggagggagatgggatagtgtgtggtgtccaccctgtcacttctgccagggcgagggctcacataatttattctaagcttcccatcctcagcttctgcgcaggagtacaatggaagatggggggtggaggccttgcctgtggagccttgactgggagaaggacaaagaaggcatgtagctggagaggtccagtgctttttccagggctggaggctgggaggtgtcctcatgcactcctataagctaagcagaagccagagagctttccctagtcatgcagctcacaggatagtgtgcagtagagctctgctaaaggaccttcagttttaagagcgccttcactccgtagtatcacagataaaattagcatccatattagtaagcccaacccagagaaccatgcaattatctcatgattttatttaatgactgtgctcttttcacagcttatcagggtaatctttggagcatgtcctgattacatgttgtacagaccataaaataagtgaacttaaaaagcaattcaaagctagctctaatttaatttataatttttacatctcaagacaacatttttagtagataattgtccagtatttggttttgtttttttgttttttacatatgtcaatttttacttgtcttgcagtttccattcccccagcacatctcatctttgctcatagcagcgaagaagagagagcatctgtcctggttctccttcaccttgctaatcaggctatccccctcagctcttcagggaatgtataatgacaaattagaccttgtaggacttgtgcatggagcttcagggtcttttctaaatggcaaaccaaagtggccaacacttgctagctgtgtgatcttgagtaagttacttgacttctgagctctgatttcttgcctttaaaatgttcccacttcataggtagtggttgattcacaaggttgccatgaatcaacaacgtacctcagtgaggtacctacctgtgagaagtgcctagtccctgaaggcgtttggaagtcatttcccagggcaggtcagatactgaggcttcccaggctgctgtacaggtgggcatgctggggaccttctcagacaccctggcctctttttctttccatctggcacaagagatgctttttctagttgggacatgcaggaggaaagagagagcaggtgcttccttgatgtgaataatttatttttccttcagatcattctgataatgcaccaacctttggatgggaaaaggtgcaaagctgggatatgcactagtgttacatcactggagttatgttggggatatgtccagtgtcagatttttttgtccaaaatcccattagcagaggaaaggaagaagatacatttccttggcaactattatgtcccaggcacagagattacagaggcaggagtgacagttgttgagggatacagtgggtatgagagggagggatgtaaactgaagagttcccatcataaaatgtggtagaatgttcacaaaggctcacctaccctaccccagggagacatttattctaattttgggggagactaagtgattggggctattcacttctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagccgttgtctgcagacttgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagataagagactgttgtgtgaaaattgctgagtgagagctcccactggaggctccttgtcttccaggccattaccagtttactcctagctgggtgatgggggtgagggttggggccagattgctagagccccattcctgccagttcctcccagtcctgaactctggggtgagtagaaggtagagagggttgatggggccgggctcctggcctggcagaaccgtgctgacctggagcctgttcggaagctggcagtgattgcagtctctcccggactgttgctgcccttgtttgccctcccttctgtttccttctctctacttcgagcattcattacatgagatggtgctgttttttcatatatttgttatgagtaattttatctttcatctattagatgacatttttgattctgttcttaatttaaaacacacactcattttttaaagtttctaagtacgttttttatttgtatgtgatcatggttcatcagtataagaaaatatttagccagttctgtttcgtaaagtcttcaagaaagataatagcttgggtggactgcttcttcatgcactttattaatgtggcttcctgttaagatctgaagccaggcagagatgtccacttttgctacttatatttaaaattgtactgcaggttcagaaatcaaaggcatccggattgggaagaaagaaagaaaactctctttattttcagatgaattgagcctgtactagaaaacctaaaggaacacatgcccaatcccgattcccccaaagtacgaaccgactaatgagttcagcaaccttacaggataaaagattagtatacaaaaatcaattgtatttttacatactagcaccaagcaatctgaaacccacattatgaacacaattctgaggaataaatttaataaaatcagtgcaagactagtttattgctaaatgagagttatcccatgttcatggattggaagactcaatattgttaaatcttcctaaaatgatttgtagattcagtgcaatccttatacaattttagtatgcatctttttaaaaaaaattgtcaagctgtttctaacagtatagaaatgtagatgacctagaataaacaaaacaattcggaaagggaagaaaaaaagattaggggtcttatatttcttagtttcaaaacttactacaaagctatactattcaaatcagtgtgttactggtgtaaggatagacagtggtgtaagcatagataatggtacagaattgagagtctagaaataaaccattacattattgtcaattgatttctctacagaggtaccaaagcaattcaaaagcaattcaattcaatagtcttttcaatgaatagtgctaggacaattggatatccacatgcaaaaaaggtaaatttaaattcttaccgcacacggtacatagaatttaactcaaaatggatcctaggctaaagtgtagaaggttaagctaaatcttttagcacaacataataaaaagtcttcatgaccttgagttaggcaaagagttcttagatattaaactggaagcacagcatgtcaaattacttttcgagaaggtttgctagctcattcagtgggtgaaaatgggtgaaaagtgagcacattatttaactatattctcttgttcctagttaggttgaacatatttttacttaccactcaaaaatattaccactttctgggctcttgtaggtctctgtcacatcttcgaactcaccaaacctttcaggagaaaatagttccttggagaagtacataaagttgtgggactttgtaccttggattacactttccctgtcaactctgggtcctccatagtggggaatccatagtggtttttgtcctgcaaataaaacagtgtgactaagtaattttccagaaatgaacagcagagtgggaaatagacataagtgagagtaatataacaatcacggtgtgataaattagcatgggatttgaaatcaacctgtttgggttcaaatcatggttcacctcttaccggttttgcaaaccttgggtcagttacttaactccatcaaatccttcacttcatctgcaaaatagagataagaaaattccttttctcttagtgttgctttgagcatcaaatgaaaaaatgtgtgtaaatgtttagtgctttgtacctagcatataggaacccattattaagtaatattacagtttggatttcagacctgtgagcttagggctcagactctagaggttcctgaactaggttttcctaggcattgcatgtagagtcttatcttaaaaaagttttaattgaaagattggcagcaaattcttcttgtcacttcagacatgatttcctttggggctcttgtactcccatggtttgaattcatagagtaactcaagggcaatagggaattcctctcaactctctgtctccaagaatacctctgggtgctggagagatgccacttatcaattctgttgttattgtttttagggctgtaagccttctggatagaactcagtggattttcctgagtagtgaagaattaagtgagatgagggaaaagcattgagagtaattatcagcagtggactatgcctgagtttttgttagccctgaacttacatatcctgactttactagtccatgagttcttcatagtcaggaactgtaccttttaattctctgcatctcctaggggctttctcagtgctaagcaaatagtaaatattcatgagatactgggattgtgcccagcattttctgagttttcaaatagatgaagttatagaatcatattcatatcaaaggaagttcctgtgtataatctcatttcattctgtcaacaaccctaggcttggggtgggtgtgttggtgtggatgagaacacttagtatccctattttacaagtaggaaaagtaagacccagataagttaatgacttgctaaaaatgatacagctcttgagagacagcagacatttgaatcccatctactgattctaggtcctatggtcattcctttgctttatgttgcctgttttgcagactgtcaaacgcatcagacacttccagtggtttttcagtgggtttttgtcctagtgacagtccacacatcctgctctcctattatcacatttgcaggaggaagtgagacatcttttgacactggtgatatgggagaaggagaaaaatcctagaatcaaagatacttactccttgcttccctctactcatactctctggaaagaaacgtttagggacttcttgtgttgtgcctgttgtgccaggacagctcaaatggatgcttttgtcacagcccctccacctttagcagaagttgttgtattcctagccaatgcaaaaataaacaagtgagggaaaatgacatttcctggtaatggaaagtagcagttggtgagactttagacaagaagcgggtgttccagccaatgagcagtgaccacagtggagctagttgtcggtttacttggctgaagaatatgtttgcctgcatcctgattgtcaataaagacgtttaaaaaccccagcttgactctggcgggctgagggtgctgccgtgccactgctgcaggatggagctctcttcctggtggagacttgattcacaaggacgctaattattcattcttcctccgtgcagcccgctgaaacaattgctgtgcttgttcggtgcacagtgtggcgtcggacagtcaggcctttttatgtaactgatggcgctgtatgttcatattgttctttatgtacttattttatagcttatgcagcagacattcgagtcaattagcttcttgtcttgcaaactgggcactgctgttctagaaccaagttagaagggtgtgttgagggcgacccgggcagacctctctcctttctttttgtgctgtgtgggttggtttcaagttacagcatttttattggctcttgtttgctgaaccttggtttcaaaagctgatgtttgagttgaatttcttaaagatacagcttttgttttcacaaaactgaagtcaggcaatatgcatagcccttgggagtgtgggttttttttttttttaactgagtgattttttttttttttaaatggtacctattaaccaaaaaatctaagcgaatggtttcctaactcacttttccttaactggcgtcagcatggagtccttgtttcttattgatttgcatttttttttttttctgtatagccttactcctgactcttttgtcctgaattttttttttttttaccccgtatttcttgaaacctgcctgttttggggacaagttggagtttaaataaattagttaaattctgttgtgtatatttctgcagatgataatgtttatgaagcatagattcactgttttgtgaggatttttaaatatcggaaagaaaatttcctgcttcctctttccatctccttttctgtggttttagccccctcgcccttaagagccatcggtttgttattgctgattgaggtagtggtggtggaagcagaggctctgatccagagaaactccccaagacggaagtgcagcaggcaggatttttatccagcggattttgacccagtagaccctaaagaaggtgcatgacagagactcatatttaccataccattgaattctcagagctttccgtggtggctggcccaaggcaattgttcaaaacatacgtgagagaatgaatgaacaaatgaccttgcctaccaaacgtctccctccctctgtgtaagcatcccttaaactctcccaacccaggtggccttgacatatcccatgctcacccaggaccctgaagtatgcctcggagcaactggtttctcctgaccagttagtgtcaactgagactaatgcagaaaacattgcttaccctaatgtttgcctttagaagtaaaatccaaactgaaggaaaggaccttgaatttgttttttattcttgctgacttggaacattgataatgctcatactgatcctctggctaaacatttttcttcctttatccatgtatttattgagctctccactgttagcatgaaaggtggagaagcaggaatacatggtgtgtgcttctgctagccttttactgtccagttgtagagagtaggcccagtgaactcagtcaggtgtttataagattgagcaattgagcagttgctgtatcctgaagactgtatctggtgctttactcttgtataattcttgagacaggaatacctgggtgttggcatcaaggggctgttgaggccatctttatttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagcccccgagccattgggaaatagaggagcttagccttgctaagaggagagaattcagagagccatgaggtgattgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacacgcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttcagttccactgaagcaactgctttggcagacgaagctctctctgcctgaaatttcttactttcttccttctttggttcccatttcaccactccatggttcctcctccaggaagccttccttgtctggttttcttccttctaactctccccagccctgtctaaatcttacccttcttcagagcccatctcaaattttgtttcttccatgaattctttcctatagagcttgtccttctcctgccccctctgccagctgagggctttcttctttccctgaattcccccagtgccctgagctgatcttagatctgccttgtttgccattaattgaggagtacatattccccccaaactccttgagggcagatgctctgccttattgtctttgtgtcttaaaaatcttgctcttgtatagtcaagaaattattgtttgaaatggtttttaaaaatagggttctagaggtgtttttgttgttgttgttgtgttttttgtttgtttgttttaccaaaggaaaatattccacctggctgatatagtgagaccttatctctacaaacaattttaaaaattagccaagtgtggtgacgtgtgcctgtagtcccagctactcaggaggctgaggtgggaggattacttgagcctgggtggcagaggttgcaacaagccgagatcatcatgctgctgtactctagcctggtgacagagtgagacgctgtctcaaaaaaaaaaaaaaaatgtagagtctcagtttgcctataatatttatattgcacaataatacatttacttattttttacttattgaaatatgccacttgtttttaaatagcatgtaagatgcagatatttgcacttttaattgatatgccaggcaggagatttactgctctcaacaggtattaagaggtaggaaagctgccccccggcaagtttcttagcactgtggaactgatcctagtgccatggtgagtaagtggcagacctcagattcacaccacgtctctgactcccaataaaccacactgtccccccacccccaaccctcatggtgattaaaatgattactatgtacacacaaaatatattaggttacaggttttttgtttacaattctaagcttctaagctctgttcatttgtatcttcataatttgggggcctatgaaggattgtttatccctaaattgaaagcaagcaaactaacaaaaaatgagatcaaacattgtcagagacggttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacattcttggtaagaccttatttttctcctctttccattaagtttaaggtttccttctgcttcttgcactaatcattaataactatactgttgtcacagctcaaaactttcctattgacacttcagtcatttttaaagatcttgaatgttcaacctctatgaagctaaccttttgcactctattaaaatttaagaaccatttgattctcagtgaatgccccagctactggatcatgaaagcattaccttgtgccaagggcatgatgcagaacactcattcctttttaacaaataagaagaagtttgacttttcatttacacatcctgccaattgctaacaagtttccatctcgttcaaacaccagattgatcctaagaaattgaaaatattgatttaaccctctgtctgatttgtactgcaggcacctgctagtgcagtcttagcacattacaattgcttggctgtaattcctcaggggaccactaataactaccacatctgtcttttcatcttccgaaattatgctagcagttgtccaagtcaattgtgattcatttgatactgctctccttcaagacatattgcaaccaaatagacttgctcaccagtaatatatctgatgacatagttagttcttgttaattgacagaatgattcaggcttttatggatggcattaattggtcccttgtgtccatgcaataattgaccagacagagaaggcagcattttctttcaccaagtcaggagagttttgaggtgagataaatgtagtaaggatgacaaaatgtctatatttttaatcaagactttatcaatgagttgaaaaaagaagatttggggggaattcagatcatcttaattatgaacattgcattgcagcctgcagagatgtgctgaaatgcaggtctgccttctctttggcctccttgtgctgaatattttaatgcagggtacaacatgaatctaatatatgcaaagcagaagagtgctgtacctgaactaagataatgaaaaaggagaactataagtagctttgtttttcttttgacattcatcattagtgacccaatagactgggcatgtaaaatctgaaaatgtggaatttgcattacctcctgcttgctgagagagccagaacgttagttacatttactcctgttgccatgctactaaaaaaaaaagcgttggttccttttttcctacaggataaagttttcatatataacaattttcacaaactgcctccaccatttattcttccttcccatttggtcacacagaattaatatttccaagttatggtaccattttgtcccttttttgtacttagtatgctctttctttaattagtcattttatagattcccactcattcttcaagaatcccataggtgcctcccgaatttctcaaaccaaattagctgccccctccttgtgtttactcatttggttgcttatttccccaactagaccttgagcttgccttgggcgtgggctgtgtctgtttgcttgacacaggcagttatgtaaggacttaataaatgtttatggaattgagttgcaattgttgcattttgaggaatgagaatttaagatttgaatccgagagagatgacttggatcaaactagatgtcaagcaacctgtacttccaatgtgaataagtggctgacgaccagccctggggaataattataatttggtgtaaaacaaaccatttgaggtgtggaagatgaattagtcagttgacgtttgtagaggggagggtgagatatgagttatgtggaatagattttctggtgtttgatttacttagactattctttttaaatcatttgtcacataggatagacagtggctgtaacagatatccatggaaactttggacttgtgaacatctgacatgacctccttttaagggcagtgcaatctgacagacctgggctgaaatcccagtgctaccatttattagatttgtgttttgagtgagctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacagaggttcacacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgacaatatatatcactttcatggggttcagagcttcttgttatagctcaggaagttacagagggagattgggagctaatgcaccaaaaccggcagtgagtatgtgtaatggggtcaaaccttgttggttttttttagctacaaagcagcagatcggccactgtgatagaatttgatttttactggtttgggatagattcctggtgatgctgatagtttattacccaatgtaggtctagaatttatacttgcagagcattttcatatttgtgggagaataaatttatttggctctgaggttggttggttggttggtttgagaaggagtgttgctccgtcacccaggctggagtgcagtggcgcagtctcggtcactgcagcttcagcctcccaagtaggtggaattataggctcgtgccagcacacccggctaattttttttttttttttgtatttttagtagagtaggggtttcgcaatgttgaccaggctggtctcaactcctggcctcatgtgatccgcccgccttggcctcccaaagtgttgggattataggcgtgagccaccgtacccggtggctctgaggtttttaaatggtaacacttaagtaaacaaactctagtttctttctaacatatggctggcctagaagaatgtgttattttttcataatctacaggtagagaaatagaagaagagaacttctattcaaagaggcaaactcagggattctgaatgccttaatgctgctatttggagttttatttgaaagcattaatattttctttttgggggtggatggagaaaggagaggtcttagtcaacgggtacaaagtttcagttaggaggaataagttctagtgatctcttgcacagcatagtgactatagttaataataatgtggcgtatatttcaaaattgccaaaagactaggttttaaatgttctcgtcacaaagaaatgataagaatatgaggtggcagatgtgttaattagcctgatttaatgattctgcaatgtatacatatatgataacatcatatgatatcacaaatttatctgtcagttagaagcaaaattaaaaaaagatcttttaggccgggtgtggtggctcacgcctgtaatcccagcgcttcaggaggccgaggtgggtggatcatgaggtcaggagatgaagaccatcccggctaacacggtgaaaccctgtctctactaaaaatacaaaaaattagccgggcgtggtggcgggcgcctgtagtcccagctactcgggaggctgaggcaggagaatggcgtgaaccgggcaggcggagcttgcagtgagtcaagattgcaccactgccgtctagcctgggtgacagagcgagactccgtctcaaaaaaaaaaaaaaaaattgttgcttttcccgcgatgatgaataaaggggtcacttagtgtagtgtggatgagttcaactagactgcttcctcctaaccccaaactggaatcgttatgttgcgagcatgagactttagcttggaggagagagcgggtttggtaattttggaacctggtaaactttaggggccttagtaaatttcaaatatatgctacaggattgctaattatagtcaacttgctgtatattaaagctccagaatgtatttatttttgtgccacctttcagtttctgatttcagtccctggaaaaccacccattcttgtgctgactattccaccaactagtttatctgccttagaggttattttggtaaactttcactgcatcacggacttagcagggtaaaagtcggagagtaatggtacatttgtcataacaagaaaaagcggatctatttttctttggcaaagatcacctttggaaagtgttgtattatgaaatgcagagttaaatacaactaactcagctttgatgtgtcctttgttaacgttcagcctctaagcgcaagttgattaatgatgcacatcccacagtgactttttctcaagcccagcaaactcatatataccctagtgtataaaagcaaacaacttaattaacttactcttcatccataattatcttgaaattaactacttataatgtccaaaagtttatgctgcaagcatatttaaaaatctgttgagagtaaaagggacggtataattggttaccctcttcctttcttgcccacttagctattaatatgaaaagtagctactcccctcatactctttggctgtgtgcttaaaattattattattttaatttctgcaaacaagaaaagggctttctgttattttttcattgagcccctgccctgggccaggcatcgggtcctcagtaacggacagggcagttttggctactgttctcaatgagattagagtctctttggaagctacagataggttatactagtctggtagggctgccataatagaatactgggtggattaaacaacagaaattaattttctcccagttctgcagcctggaagcccaagagatcaaggtattaacaggtttagttactcctggtacctctctccttggcttgtagatggccgtcttctcattgtgtcctcacacggcctttcctttgtgttcacgcatctctggtctctctttctctccttcttcttccttcttccttctttctcccttctcccttctcccttctcccttctccttctccttcttcttctcctcctccttcttcttcctcctcttcctcttcttcttccttctcttcctcttcttccttctttcttccttcttcttttttttttttttgagactgagttttgcccttgttgcccaggctagagtgcaatggcgcgatctcatctcagtgaaacctctgcctccagagttcaagcgattctcctgcctcagcctcccaagcagctggtgcctgccaccacgcccgctaatttttttgtatttttttagtagagactggttttcaccatgttggccaggctggtctcgaactcctgacctcagatgatctgccctcctgggactcccaaagtgctgggattacaggtgtgagccaccgtgcccagcctaatctatgggattttgaagacaatactgtcacttaatgacttacaacacatcctcatgagacctaataacagaagttctgggttctgtgttaatacgggacttccttttgtgaaacttgtaatacactcaggagaaatgtgtgacaaataggattctactttttaggggcatttggagcactgtattgtccttgggtaataatgcttaatgtggacgatgctacatggcctccaagaatatccctaggcccttgatcctttaagggagaaaaccaacctttacttttcgattgtgtaattgtgatcagaatagcctctgagatataaattccaaatatatctgaattggttttctttaattaagaatacttttggattcaaatcatactggcagcaaattaaagacatgtttcatgtgtttactaaatgttaatgatgggattactttgaagataaattttaacattttaagtaaaacgttcatgtaaaacaaaagtttattatagattggttttaaaatgagcactgcttcagagtcaggatattcttagtaaacccacaagtgttgtggccttgtgcacgtcttttggtttctttttgctttcattttgtcatcagcaaaattgaaattgttagatgaaattgtctctaaagtgttttctagagccaaacatttctgattctctaatattaaagtctctaagagagtttctctaagcccaggcagtacagttaaaaatattttcgttgtttgcttgttggttatagagtgataatattttgcaattaggaagcttggatgagaaaccacacacgtgacataaaatggtttctcaacagaaaatctgtgccgctcaaactggggaaacagacttataaattccttttgacaaaagacacgtcaccacacaagcaagttaggacagaactctgagcattgtttttcatagacttgggacaattcccaaatattcttttttctcaaaacaatatttttcattccaatttacttattaaaaaaaaaaactgggagccgggcatggtggcttacgcctataatcttagcactttgggaggcagaggccagtggatcacctgaggtcaggagtttgagaccagcctggctaacatagtgaaacaccgtctctactaaaaatacaaaaattagccgggtgtggtaatgcacgcctgtagtcccagctgctcgggaggctgagacaggagaattgcttgaacctgggaagtggaggctgcagtgagtcaagagcgtgacactgtactccagcctcggtgacagagtgagattctgtctcaaaacaaaacaaacaaacaaaaaacaaagctctttttgaagatcacgagcttcagaaagaaatactgcatccactctgtccacatgtttctggcctgtccattcagttaacagttattatgtcccaggtgctaggctgtgtcctggggactgaggtaacagaaattacaggataaagctcctgccgtgtagtagtactttagggagtagtagagatgttggttgggaaagaagtgatgccagaatgtggcgggggttatcagagcaggttcagaacgtaaggagcacgaccagggaatcactaacttcgcgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcggtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaaaaagaccagaaacgaaatcgggccaaggcaagaagggtggaaggtggatgagtctgagagatggatgttttcactatggaatggttgtgtaaggatggggagtcagaagaagccatgagaagcttgtgagagttaagaggccatattcagtgttgtgctggtaaatataacctcctataattaaattgtaaagaggtcagtccaaattcatgtactggggttgatcgtttctgcgtaatagtctttcacttaacttttactcattttcactttcacgaaataaatggccgtgtcttagcctgggggcctaggtctggggttcggctgtgtgctcttcctgcagtttggaagtgccgtctatgttaatagatattcccaactctgcagatcttctctcgaggctgaaggggccccattcctatcagaagcctctcatttttctctgaggtagaaaaactaaggcatagacttcatagggaagtttatatgcaaatggtggctttctgcacgggcccctgtgagtggagtgggatgagatacccagtggctttcagagttctggtggatatttgattgctctccattggtagtaactttattgcttttatagggagagttgtactggaaatttgccctccctgtccttcagctggtttgttcccaagccagacctgtctgaaaattgaaatggaatactttttctcatctcaagttatcagttgtagctgtcaggaatttgttactgtctgctaaagccttttaacatgaaaatacgctaagggcagtgcatgtgtgagtcatgtgggaagttacattattttatggatgcagagagggacacagacccagatttattcataggtgaaaggggaaaaggaacagaatttaaaagggaaatcctgaaaaatatgtagcctctgtggctctgcctcttttcctacctgcgtctcttatacaccatggatagaatgtaagctcagtgggtacagaagagctgtcttttttccctcctttggtcttcttagctgtccccaccaggccatgcctataatcggtgcttagcaagctactggcttaagagagtctctgtctgctgtgagtgcagctcctgagatggtggggatggatgctggttaggaagtgtgttcgctgccttagcataaagaataagtacagtttttctcgattatttttctccaagggaaactcaatggggaatgtcggtttcatgctgttcttggaggggttggtttagaattctctctggcttttctgagaatccctccacattccccctccaggctgctgtcatggtagctgcccttctttcagctacttgcattttttgggagatatgccatcttccttcagtttgcaccctggtagcttagctccttcagtgtttagagggaaatgggagatggagaatcgaagcacactagtgctttctggtgttctctgcatgtgtttggaaggaatgtaaaagtagctagggcttatcgtggtatcatagcattatagggtatgagacctttggggaaactgaggctcacaaaggctgataactttacctagagtcagtgactgctaatggcagactcctagcgtctgtacttttccacacttacccgttcatatgaaatagtctgggaaggtctcttttaaaatgtatcgtgacctctcctataaacctcaaggttacatatgttaaagaaatgtagtcggctttcctcatgtgccgaattctgaatcaagcttacccaaacccccaaatcatttccacagagcagaggaaaaaaacaaaacaaaacaaaacaaaacaggcaaatgtgaatcatgggaacctattataatgatatatagcttgtcataacacattataatattacagcaaatgtatttaactcactgaacgttctcagggggctcttagctccctttaaaagtgttctccaaatctctgcagcaagatggagctgcctagtccacctcacttttgaccaaaccaccgttacgagaatacctattgaaaacccttacactgttgctgtttccctgggcttaaaagtatgtttggttttgtcagtacctggaaacaggaagttgagatttgaggagaaatctttggcagttgtgcactaagcttgcgggagttaggagtctgttgccacggaaaccacactgctgcctcatttattaatggaggcttggtgaacttccggagatactcttagcctgtcctgtaaattcattctagagaaatgcagggtgacttttaagagatttctctgtcgtttctcaagcattctctcctgggtcttcatgagctccagaaaattgcttgtatgcaggttcagaaccactgatttttatctggcaagcatgtctgaaggccgtttcctttttttcatgcttaaatcgtgtttatgcctgcctgccttgtccaataagtgaatttttttttattatgctgcctttaagaattacatggatttcaaatgaaggaagaaggaatacaaaaatgaactaagtaaatatattgaaaaccttctgacactaactttaagagagttataagcatcaaagccttttctaacttttaaaattctaaacttaaaaaatctaaaatgaatggtttatttcttctaattccagtgagatactttaagaacatttgtctgagacattttcaaattttgttctaatttcactaaactaactctattctgctaggcagagtaacagcattggaagttgcttccaggaaaaaaaaaattttttttctagctaattgtttatctgggaggatgcaaatggtggttttaagtcctttaagtcatccatcatgcctggcagcctctattgtctcattgttggatttgagccaagtcaggccctttcttggtcttgggagggtgcacatagatcttgctctgccaaatctgtgttcacaaggagtccgagcccagctctaagggtaggtaatgttgtcagatctatagatcccctcagattggaaaagatcatgcatcctcgttccttatgtcacactaaagtagaaagtagcactctattcaaagtagaagtgacaggacttgttccctcagttcttccagtgtctacgaattactgttagtttttaaacgcatttttgtggatgtaataaaatactgtttatagtcagctacgaagtaagtaattacaatgcgggaaatgaaattcaatatagctttgttgtggttttttgaattttaattaaaccagtcttagagtaaattataaatgctgctgcttttgttgtgacaagtgacattgacaaaatattaatctaatggattgttattcacaaaagctaaatcttttcaaatctgcagggtttggttgtttattttgttttacttttcagtttgtgttttaaaaagtctagagaaaagaataaagttttaaaaccacatgaaataactccatgtatggaatatttcattgttgatgtcttgccagccataattgcatgcatctcatttatggcgctgaaaacttgttctttttaaaaatcagatgtttctgtggtcacttttttgttattaaaactggagccgggttaaataaccaaccattgaccacgaagcctaatattaaaggaataatcagcccatgttcctattagatcatttccgttttcttttactttataaattaccttgttgcttaaaaatgacattttgttggttgtgaagtcctcttatagctaaattattcaagttattttctttggagattcttttaacttgaatttatataaactgtaaagaatgtacattaaatattcagaaacttttctttatgccagtttcttattttcacccatcatgacttaaagcttttttttgttttagcattttaatgtttaaataaatgtaaataatttagttacaaggtctttatggtagtgccgccattgtttttaagaagacaaattttaatccaaggttaaaaacttcacatttgcttatctctttttcctcttaagaactaagagtccagagattagagtaaaatcaccttttcctcatagttttttctttcaacgtgttagaaattcctgtttgaaaaggaaagccagttcctccccctttttatgtttgaggggatgatggtaaaatcacattattcagtcagtttccacatgtgatttgttgcctatattttttaatccagggattaaattgttgccaccaccagcatcaaatcattggggggcaggggtggggaaggtgcgagacagttggttatagacatccaaatatgacgacagaaaaatctccacagcaatatggcagtggagcatttgctgacttcagagtgccagatcaaccccaatatttttttcagggatgctaaacctcttgtaactgctaaattggatttgttactgaatgaagtatcagctgctgttggacaagaccataaaagccagccggctggccctttgtaggcagggcttacccaacgattgatatgttttagcacttttgggattattgtgattaagaggaaaccattctgaatgagtgagcaaagggggtaaggacacacagcccacagctggtgagcagcatgtgttggctccaaggaagtcaccattatggctttctcctggttcctgccctgattgacgtgtatgaaatcttttttttttttttttttttttttggagacagggtctcgcctgtcgcccaggctaaagtgcagtggcgcaatcttggctcactgcaacctctgcctcctggattcaagcaattctctgcctcagcctcctgagtagctgggactacaggcacccactaccatgcccggctaatttttgtatttttagtagacacggggtttcaccatcttggccaggctgttgttgaactcctgacctcaagtgatccaccctcggcctctgaaattgctgggattacaggcatgagccactgtgccgggcctagaatttttatatgaggaagtggtgtccttattttctccagttgcagctctctctgcagggaaagagacatttggaatgttgtggacttgagaactctgaatgctttcaaagcactatcgtgtgtgtgtgcgcacacgcacacacagtagctagaagtgttagtctagcacaggagttaattgagttaatgtgtagggaattcagtaataacaacagagcgtcctctttcatttcccagatccaaagctctgtgacatgcattaacaatatacctccatgtagtttgtgtctcagtctgtgtacacgtgtgtgatggctaaatgggaactgcacagccagtggatttgtgaacttgagcacttgcacctggctaagggtttattaagtgtggaaaccgtactgttgttgtaaaacagttttcatctcaagaaccacctgccccttttagcggtggccttttgcacgtgtcttgcactagccaagacaagtctatccaagagggagcttgtggagtaggttggtgtttgaatctttcccagtactcccaaatgcacatagaattggtcgcctctctgggtgtcccagggggctgtgccccgctcatgttcagagtttgctcagcataccacacaggaaagaggccggcttgccaggtcctgcggagcgcctttccaagcctgtgaaaggcacgaatcatccagcagccgagcatgcttacagctggccctttgctagctttgatctgcgaatcaggccacaccatgaatgcacttattgtcatgttatgtgtacacagtgtgtgaattattgaaaatagggaggcctgagcctcatctggtagagattacagtgcaggcatgctgggcgaaggtctgtaattgaaaatccccagatgctgtttatttggcctttgtcacatgacctgctgcaggaagattgtctgaacaaaatgttgcctgcatggagagtggagcccgccctcccccaccccccagagcctccacaggctcagtctgtgcacagcttaaacacctgcccaaaggatttttaaaggcttaaaatagattcactcatagcatttaaatagagggcatcttgcttgttggtttaaactgcttaagcggttgttgacttgtggaaccttctatccacacaagggtttgctggataatttcactctgagatatctttacaaagcaacattcagggcccgagccacataagtagtttgggctctgcctttttttttttagaagtcaaacttctgtgtggtgaatgagcttgcagataaagctgtgttgactgtatatattccttctgtctgtagaaaatattgtgggtactgagaataaggccctgagttagcatgtctgacttccgtttgtccagttcattcttacctattctgcctataaacaagttgaggtgtttcttagaaaatttgtttttctcaattaaatgctgaatgttatgctctctgtcagtggtggattgaagtaggatactaaatctgaaattgatgaagatcacaagaattaaaaacagggaagattgagctaattttgaagtaagaagggctttaagctttccaggttcattctgttagggaacaaaacagccacatgtcctctttcattgccagtctgtctcagctgtgcttgtggcttcctctttgatttcttggagcttaagaagaggaaagattcatgggtatttctgcattccataagcatccaacacgactgtgagctccttgaaggcaggagccctgttgcattcttctttgcatccccagtgcctgccaacacagtgctttctctgtcttcctgcggcttccccctccctttctgcctgcccattcaaagaagacagtcactgcgtcccatgagccatgatgtcatatattcagatattttttctttcagggagagactcaagtcaacagtagcaatatcattaagtagcacattcttcatgcagggccagaggttgggaggatggagtagttgggagtaggatgtgggtcctgccttcacaaagctcacaatctgccaaggaaaaagcaaaaacaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaaggaaatagcacccaacatgacaggaataaggatttttagagacagaagtgtgtgtagagagtggcaggagaaaagacaaaaactgatttgcccatgtaacgttttaattttttacggatagaatgtgttcatgtgttacctagatcattagaaatttattttattttattttagtttttagagacgggtcttgctctgttggccaggttgttcttgaactcctggcctcaagcagtcctcctgtcttggcctcccaaggtgctaggattataggcgtcagccactgtgcccagcctagaaatttaaaaggagaagaaaaaccaagcagctgtcctgaatctaagctcaactgaggaaggtgattttcttggtttgcttggtcatcatctccagtgggaaccctatatcataggccactgctttctctgtcgtgactagctggtatggggttacctctggctgcttctagttttgagataggtctgatgtggctagggcagtggggtcagtgagccagagcatggcaaccctaggaggaaacatctctgggcacctgtctcaggcccttcctgagtacatctatccatctaatcgttccgtctttgattaccattgtttggcttctagcctcatttctcttcctagaccataaactccttgagggcagagagtgtgtattattccagcgtgtttctcttctagagcctagcctaattccttttgtacagaaaatattctataaattttattgaatgggagaggaaagtgccttggggccagattatgtaggccttggatgcttagagagttgaggctttattcttctgtattgtggatgagaaattagagaactttaaagtgatgtgtgtacaattcagtccatttcatggctggattctgccgccatctaagattttgttctcattaaacacttaacagttggtctaatgttaaggattaaggaacttggaagacaaagctgggttcaaatcccgactccactgcttaattagtttgggaacttgggcaagtttcttaacttctttgaactgcagtttcagcatgtataaaatgctgagctaggtagaattaggtgaatgtgaaggttaaatttgtggtgtataagcacagtgctttggccaggtgcagtggcttatgcctgtaatcccagtactttgtgaggctgaagcaggaggattgcttgaggccagtagttcaaaaccagcatgggcaacacagtgagaccccatctctacaaaaaattaaaaaaaaaaatagctgcgtatagtggcacacgtctgtagtcctagctactcaggagactgaggtgggaggattgcttgaaaccaggaggtctaggtggcactgagtcatgatcacaccactgtactccagcctgggcaacagagtgagacgctgcctcaccaaaaaaataaaataaaaaaaagcacagtgctttgcatagtgctggtgcatagtagatacacagtgcatgtcattgcccaactttcttgctttttttttctttctttttattttgagatggaatctcgctctgttgcccaggctggagtgcagtggcactgtctgggctcactgcaacctccgcctctcggattcaagcgattctcctgcctcagcctcccgagtagctgggattagaagcacatgccaccgtgtccagctaatttttttgtatttttagtagagatgggattttgccatgttggccaggctggtctcaaactcctgacctcaagtgatccacctggacctcccaaaagtgctgggattacaggcttgagccaccgttccctgcaaaagcccaactttctatagcctcccaccatctctaaactccgcaatagtgtttcatttagcttattccctgaatttcaatttcttcagtttgagttcattttaaaaatgttattccttctcatcatgcttttcatatttttattagattactgagtgcctagacatttagatactccttcagcatgttttctaagcagcaagtcatccctgagcatgccattttgacttaatgcttgcataacttacctttgtgtagctattgttgtagtagcttcagaagttgatagaattcttctggtgatagttgtttttacaacaagaactaaatactggacgtccagtgagggacatgctgtttaatgcaacacctccagcctattcatagacttaattatacagtctgtcacaaattttaagaattttggctatacttaccttctggcaaaaacctcattcctgctatttattcagtggagaatctatttcaaattaaaagatttgtgccctcttaatgttaagatagtgccctcttaatgttaagatatcacaataagtgctctgtttacttggaaacaatttttaggaccatgtcattttgaaaattgaagaagatacaaagattggaaaagatgttcaatttcaacaacattagcaatagaagcatcatgggtttataccagatgccatgtagtacggtgtcctgaacagaaaacctttttcaacccttttaggaccctatatatcagttcaagcaacgaagacatataaacctggtgcagtgacattacattacagttaaagaactgggccaggtgtggtgacacatgcctataatcccagcactttcggaggccgaggcgtgtgtatcacctgaggtcaggagttcgagcccagcatgaccagcgtggggaaactctgtctctactaaataacaaacaattagcctggcgtggtggctcatgcctgtaatcccagctactcaggaggctgaggcaggagaacagcttgaacccgggaggcggaggctgcagtgagccaaggtcgtgccattgctctccagcctgggcaacaggagtgaaactccatctcaaaaagagttgaaggaccattttagagccccagaaggtgccagagccttcccattttctgttactaatgcatacagcagccctctagagtaggaactgttatttccattttacaggtaaggaaatagaggtctagagaagttgagcaagtttcccaagttcacacagctcataagtccagtttcctcagaagaatctaggcagtcatacctttgagtcaaaaaaccagaaatcggcagcattgcatcattaaagattcttcattataaactagcggtgtttagcacttcaaatgtgtggatttcacacttctctaaggccaaataattaataaatagagtgcttttagcaaaccttttcattaataagactttcttgggttaatgttaagattagctttttttggaccaggtctctatggctgtggcttggggaagtggcagggacatgggtatagggcatgaagaagcaatgagcatgcattggtcataagagacgagaacaaaggtctgaaaaattgtgccacttctcactgaaatagttgcaactttaaaaggatttacagatttcaggtgatattggcagtgctgtctaattttcataatctttttctagatcttttcttcggattttctttatacaaaagaggtgagctccttcattcatttattaaaaccatttattgagcgagacacggaaagaaaaaaactatttcatgatctcacttatacgtggaatcttaaaaaaaagtcatacatatacagagtagagaaaaaacaacaacagaggatactaagaaccagaggaggagagaggaaacggatatgtaggtcaaaagatacaaagtagcagatatgcgtctagaggtctaatgtacaacataaggactatagttagaattatgctagacacttttaggaggattttaactattgtcgtcacacacaaaaaattactatgcgatgatagctatgttaatctgtttcactatggtagccattttattatctatatgtatctcaatatcactttgtaaacttcaaatatatgcagtaaaatttattttttaaaaaaatggctgggcgcagtggctcacacctgtaatcccagcactttgggaggctgaggtggacagatcacctgaggtcaggagttcgagaccagcctggccaacattgtgaaacccccttgtgtctctactaaaaatacaaaaagttagccagacatggtggcgggcaactgtaatcccagctacttgggaagttgaggcaggagaatcacttgaacccaggaggcagaggtgagctgagatcattccactgcactccagactgggcaacagagcaagactccatctccaaaaaaaggaaaaaaaaaaaactatttattgagcacgtacttaatagctaccagatctggggtcacagagaaccagacaggtgctttaccatggagcagtcactattctaggaggtggatgaatagtctgtagataagtaatggcagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatctttggaaaagaatgacagtggtctggggaactctatgaagagccacattctagaatagaggagccctatacaggagtgggctcttagctttaggtaccagactaaggagtttgtgttttgcttgtagtggatgagaacctgttggtataggaaggcaacataactagatgtggaggtgaaagaaaagacaaatgcctgcaagatgagtggcaggacatggtgggcgcctgagagcctgtgggtagcagtctatttaggtcacagttgggggcagcaagttcaggctccattaaatctcatctttttttcctttttttttttttttcgagacagagtctcactctgttgcccaggctggagtgcagcggcgcgatcttggctcactgcaacctccgcccccttggttcaagcaattcccttgcctcagcctccctagtagctgggattacaggtgtgtgccaccacgtcaggctaatttttgtatttttagtagagacggggtttcaccatgttggccaggctggtctcaaactcctgacctcaagtgacccacccgccttggcctcccaaagtgctgggattacaggcatgagccaccatgcctggcctccattaaatctcatctacactttaagtgtatgggataccaagatgtgaaagacatggactgtaccttgaagaggcttgtagtctgttacacagggaactcagcagagtctgattgtgggcggttccctgacacatgaagtaaagaactatgagaccaggacagaatggtgaagctcatgctgcttgcctagttaagagtcaagccatcattcccctcatatactaagtgacttgtttttaattcatagtactttttgtttcactttataatattgtggtctttcccagttgctggtctggtgaagtgggctctgggcacctggctgtctggcttacccctcttcatacactccatgtctagcacatgtttcaggcacgtttcaggtgaggtttcttggaggggacatctgagctggacctggaaagattttccttggtggtcttaagggttattgcagctataataccttagcatggcagggtgggttcagggaactggaagcttggtaggtattttgatggtggtaaaatgaattgtggtggtggtcgtggtggtggtgtgtcatgaaaaatagttaggggccagatggtggggacaacactgaacaccatactaaagcagtttattcctttagatgtgggcagtaggagccttggaaggtcttataactgagaactgtgttttaggtagctgtgtagaggatggattagaaagaaaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacagtgttctatggagttgtcacatgataatgttatcagctgccgttgactgatacaaactcctgagaaggtgggacttgagttatcgccagacactcactggcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaagtagtaccagcccctgacaaccctgaatgggcggcctggctgtttctggtgattttccacattggtgctgatttctggtcaatgatttatattgaggattaactgagaacttcctcgttggatatgctgtgggactggttcagaggctgtttttcatgagcctgtccttacacctaatcttagcctgtgccccttctccctccctggctctccatccctctcactctgtcatttactccatcagtctgtagccactgaggacctgctgtgttctcagcactggatgcacagtgatgagcaaaacccagtttatgctctgggctcctgtggacttctctgtctggtagtagaggggtaggcacatgttcatcttatagtctcattcagataaatggaacacagtagctgtgctgtgtgctgtgaccgagaggcgtaggttcctgtgagagcacatgttagggtgatctgaccagttctcatgggttggagttcttccaaacaagacataagcacctccaaggcagagatggcgtgttttctttttctttctttttttagacagggtctcactctgttgtccaggctggagtacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgttccatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtgtccacagatacatacctcctagatcttcaggaagatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactctcctgcctcagccccccgagtagctgggattacaggcatgtgccaccacgcccagcttatttttgtatttttagtagagatggggtttcaccatattggccaggatggtcttgatctcctgactgcgtgatccacctgccttggcctcccaaagtgctgggattacaggcatgagccattgcgcctgaccaggttgttggctttcatatcctaaaatatttttttccttttgatgaaccccagctgatgaaaacagacttcatgggctaagcacagtagttcacgcctgtaatcccagcactttgggaggccaaggcaggaggatcacttgaggctaggagttcgagactagcctgggcagcatagtgagacctctgtctctacaaaaaaaaaatttaagaattagccaggtgtggtgtacctgcctgtggtcccagctacttgggaggctgaggtgggaggatcacttgagcccgggagatcaaggctacagtgagccatgatcatgccactgcactccagcctgggcaacagagctagaccttgtcttaaaaaaaaaaaaaaaggagtggtgggggcatatgactagaaggcagtttagcactgtcttgtagaatcttgcctgagaaatttctttgtaaaccactctccccatgctttgtgctgatgccggcatggggtctcctgtggaagacatctttctttgcttctttccactgggttatcttcttcctttttttttttttttaactttatgttcatgatctggtgccaaattgggactacagggatgtaggagcctcttttctgacctgaagaatgactcggtccataaatgttgagccacctgagaaagggaggcggagaagagatccatgtcattggttcttgttgccaaggactttatgacttggttgcaatcatgacatgtgctgaaatgatatcacataaggcagaaaaaaatacaagttaccagcaaagaagcccaggtcaaaggctgtgaatgtttagggaaaggggaggcctccaccagctggtaggttcatgaaggatgaggccttgggaaggtaggcagattccagacatgcagaaatgggcaaggacagtacaggccatgacagcagttgtgcacccaggtacaaagttcaaggtgttcacaggaaacattcgataatctagtagtactactgggctgagcggggtggggggatatgtagaagacccttgtttgatgtagctttggtctagcagtcaagggaaatgagttttctttctgattttccttgttttaatatggaagaacggggtggagaatcctcacacatccttcccagtgaagggaaagggccagcagatgtttccttagagaagccaagctagagcttcctaggcccagggcagtccagtccttcatgggtgtgagtttgccttaggactggccacggccagggaagagaagcattgcatttgttgcttctttcttggtggctccctgactccattcaattacaaagtggctcttacactgttaaagcttgagtgtctctgggctacaatttctagccacagaccttcatttgctgtgcctcaaacatgaccttgaggccacatcacattatatatacagcccacaacaacgttaaccagtcttctatctggtaaggcaagcgcagtgcaaactccatgcctttcttctgggatctctctctgtattgcccctttagcaggaaattccatggcaatccaagatgcaagagaagccaatgatgggctcatttcgaactgtgttatattatttaggaaaaagaaaataaaatgaaataaaaactagattacagtgcctggtgaggatcacagtgtaaaagtgacaggtcaggttgtgtttgtccttgctgcttatgtgcagccggtgggaaagacaagggcagctacaactacagcatctgaggcttaaagaggtgacatgttgtgcatttctaaaataatttttatgttgtagagaagctttatatctctctctgactcactggacaggcgtggtgtaaggcagaaaggaagacggtccccaggtgactgcaggattgttttaggaaaataataagtaacttaaagttagctttattgaaagtcatttttgtagcatcaggtttactgaatcaagcatctctctctctctgtctctgtgtgtgtgtgtgtgtgtgtgtgtgtgtgtgtgttagaagatcatggctgcaacaggactatgctgcatagcttggagacccactttcagttacatcagtgatggtgctgcttatcttctggcccttaggaaatgctgcgtcttagtaacatgatcaaaatccagggctgtggaatctgtgagctcacccctttggagggcagggctgtagaaatatacataggggccagtgcggtggctcatgcctgtaatttcagcattttaggaggccgaggtgggcggattgcttgagcgcaggagtttgagaccagcctgggcaacatgatgaaatcctgtctttacaaaaaaatacaaaagttggtctggtatggtggagcaggcctgtagtcccatgagctaccacagtcccgtgctacttggagagctaaggcagaaggatcacttgaacctgagaggttgaggctgcagtgagccgagatcgtgccactgcactccagccagggtgataaatgtgagaccctgtctaaaagaaataaaggaaatagagataggacttaggatgtcgtatcagggccgctgacaagactctcctcagaacctagttgatacaccatgcatatacaatcccaaacagccaaaaagatcttccaaaattgtttggaatggcatacttctgtaaatgggtaagtataattaaattctggaaagatttagaattaaacatataaaattttagtagaattagagccatagtgttaatgtttttgatttaaaggatttatgtatatttgatatttcaagtaattaaaagaaataatttggcctaggtaacagatcagcctgtatttccaaattaaaatgtacaatgaagtagctcatttagacatttgatttgggggaaggttgaaattgtactagttttataagcaacattttagtgcatttaagataatttattaggtttctaagacttgtttaagggaagattttataatttaaaaagcaggtagttctaatatttaaaagaaataattacttattcatggcttgaaacatagatgaaagaaagaacatgggtttttgaaaagtgagcttgctcatctgaaaagcaaggacatgagagtgaagatgagctttcaatgaaataatgactacagcgtaatgcccaggccacagtactcagtaaggacctgttgaagtcataatttttagaagtcactgaacaacaggatacgttctgagaaatacgtcatcaggtgattttagtcattgttagaaaatcgtcaagtgtacttacacaaacctagatggaatagccaactacacacctaggctgcaaacctgtctggtgttaactgtactgaatactgtaggccattgtaacacaatggtaagacttgggtatctaaacataatctaaacatagaaaagacagtaaaaacatgccattataattttatgggaccaccatcatgtatgcagctcattgttgaccaaaatgtcatcatgtggtgcatgattgtacttcagtcaaagtgtgagttgacactgtttaactccaaggggtgccatttgtataggctgtggtacacagtcaaatagggctgtcttggatattgattttattcattcaactccaagtgctgcaagaaattaaaagttagtcaggttatgtgtcacatctatcaaggtattctgtctgttttcccagaaaataaacaagtttgagggtaggagacatttttgtcatctggacaaggttcggacaaaattgtatgtaatacagagccctggatctatttcgccttggccgctcaaatagccctgaacaggatgcacagtgaggccccaggttggaggatgcttggcttgtctgcagacattgtcatttagctctggcttctcgtaattaggtactcctagctgggctctgttgtcagcgagccttcaagacaaattgcaaaatctgtacaaccatctgagagatggagaagtagatccaatgatactacaggggatattggtagttctcaaaagtttgaaagagaatgcttagaaaagcaatcctcaaaactgaatttagaggttcttgtcctgtggtaaaagggttcacaggatctgagaagatcttgcaggcaggaatgatagactgaatctaaggggatgaaatggagtagaaaaaatgtaaggttctgttttgaggtctgaaaatctcagctatgcattaaaaagactggaaacaggggtagggacatatcagaagacgagcccgtatgaaaaagacctaggagtttaagttggcatatattgataatttattgtgctccttaaaaatttaatgcagtgtttggctgcattaacagaggtagagtatttaggatgagagaggtaataaactgactctgatgctatagcaggagcactgccacagttctggactccaagctttgaaaggaagacagacaaaggatggtcacaggatggtgtgtgggagtgttccaaagcttgtcagataacaaagtaacacaggaggtttagcttgtgtacaactccaagaggaccccagagctgctgttaatatctgaaaggcagttaaataaataagggactggacttcttgttaagaggaacaggaaggatctggggatgaaagttaaagcagacccccaaaaggagggtcttcttattcttaaatatgttctaagatagaatgggctacttcctcaattttagaagtgctgactaaggcttatgaggactttcaggaatgcgaatggatgacctaggggtactttctagcccccagatttcatgattcctttgccttccagtgatgaccatgtcctgcacagtcccagcactggcaggtggtggacagagccatgactctaggacattctaggcagtgatgagagagtcttcgcaattctcagacaagatttccctaaggacattttgatgttcgtcttcatcagtgtttccagttctttactctgctagggaagatctgggggatatggtcacttcctttcagcagaggctgtgttatttcctcattcattcttttctctgtgcccagcagtgtgctaggtgctagggggacattgaggaagaagacagagttcttcccctcttcaagtatgcagtatatctgggaggaagtaagacaacaaacacaaattttacaactaactataaagttataaatacagttacagtttgggtacatcctaggaagaagtacagtttttgccaccatgggggtgtagaacaaggcaaccaaacctagttgggcaattagagaagacttccccaagggagtgacatccaagtgaggccttgaaggagaaatagaatctagcacaatggtctcaggctggtgaagcacatgagtgaatgccacagcagcaagcttcagacttgttcttgaccaaaggaatttttcacaaggatagagctgagctgatacaaagccagccaacagtagtgctatgaaatggtggttttccatttactgtagaaagtatgtagaaataatttcagttcctggtattagagcaagttgaagtcgtaaataggacctgcttagaagaacccatgtcttgtatgagtggtttttatttcacgtggtattttggtaatacattctctgcttagcttctggggatattttttcctatcatggttttctgaagtcaggttgtctgagacttctcagtttcctggtgggatagggctagaaggtttttgtttatacttttgggcattgttctttccccagaaggttatataacttggaggagattgagtcatttttttcactgactacctttagggggtgtctgccttcgtactgttagcttcttgtcattgtccggcttccgtggccacagcagctcgttcgttctcttgtggctgtgattttagctggagtaaactatgagtagaaacttgaataagaaggaaagtgaatatgaatgtgaatatgaaaaaccaaagactagaagagaactgggtttgtttagtcccagactaatccttgtctgtatttgttgcttatatgagtgacccaccacccacagcatacaaacagacaaaaaggcacatcttaaaaagataaatttcagctgggtgcggtggctcatgcctgtaatcccagcacttaaggaggccaaggcgggtggatcacctgaggtcgggggttcgagaccagcctgaccaacatggagaaaccctgtctctactaaaaatacaaaattagctgggcgtgatggcgcacgcctgtaatcccagctacttgggatgctgaggcaggagaatcacttgaacctgggaggcagaggttgccatgagccaagatcgtgccattgcactccagcctgggcaacaagagtgaaactctgtcttttttttttttttttttttttaaaaaaaaggataaatttctattcttagatgctggtctaagttcaaatttaaatgcctttcatcttaatttttcctagtaaacatttttgcagacaattgtgctgttttatttttctagtattagtaaacacatagttgtaattttaaaattcttgattctgaattttgttttttgctttcaagggctttgttggtttggtgttttggtaacccacctcatggtaaattcttctttctttcaggtaggaatgaattgatagccagatacatcaaactcaggacaggcaagacgaggaccagaaaacaggtaaaataacccacctggaaattgtgcatgtcagcgaatggcccaaaaaggcattttggctgcagtggctggctatgctttggctcctaggagcccccaatttgagttccctgtaaggacgtcagtgttggaggtattttaaattggctcagttttcactgttcatcatttcagtgaccctttattatgtggtcttacaagttccttttatactcacatgggaaaatgtcactgctaaggacggtgtatgaaccgctcctgtactgtatttcaaagctgacatttctttcccaaaatgtgcacctgtgaacactgcaaaaactgcaagtgcaaatgcacttgcaggtcatgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgagccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagaggtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaatcaccacacagtctgagtcgctgaacttttaaatggaaagttctacatttcggaaaccagtggatctaatcatctacattctgacagtgcgggacctgggctgtctgctggtctgtgagctctggtcatttgcccggtgaccccttcactgagggactcttctaaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtatgaaaagcttagagcagcgctgggggcttgtgtctggctgggactgtgtattcctaactgcagagctttgttgagatgcaaataaccaccccccaaccccaccccaaaaccctcccaaagagtagcgattttatatttgatttccttttttgttttgttttgttttgttttgttttgttttgttttgtttcccctcataaacccgaacaatgtaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactggtgaatgcctggtgctgggattctcgtaacctagtttccttgcatgtgagagctgtttacatttctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgattttttttttttaaccttcagatgtccaccaagcagccatgggctaggaaagcttaaaaaaagaaaagtccagagatgcaaaattgagtagaaattatttagaaagaatcatttccaaagtggtcatgaaattacctttttaaaaaatttagaaattattttaactcatgcttttgatgtatttttaagaagacttataaaaaatacgtctttttcatgcatgtctcttccctcagagtattttcagccagatttcttccacattgcttactactgttttttaagtgaatggcgctcttattaaaagagaaatctgagcagtggcctttaaaaaaaaaagatagatcttagagatgggaaaactcttgatcaaacccatttgcagtttcatttgtacttgagtttgcttaaatttttttttacttgtacctcatttttcagtctcaaaatatattttataggaaaaatgggggcattgataatttttcatatacaacttctttctgctttttccctttataaaatttataataaaacatacctgacttttatttttctgtaatgccctattttagaaatgcaaagagattatagtttgcaaggaggagctttcgtttataataaaaattgattttggcacatattgatggctttcccatgtgcctttttcggttctgttctgatatttttctatacagtaattaaatttgtggttttgttctgaactaaaaaacagtgtagtctcacaacacttgagtggtgagcactgggactcttcccaaagtccttcgacttttttttatgcaaacaaggctggctgtggaataggacaagtgattaggaaggagcatttggtgtgccctctgcagtgggcagcatgctggctcgctcgcacgtgtggctgatggtggctggcttttagctgcactggctgagcagttggaagactaagataactttgtagatcctgctttttaaccaaaggtgcaatactctctatatggatgtaactaccccagtttttgctcaagttctgactctgtttctagtttctctgagctaatgaattaatgatgtacaaagaagtttacagataacaatgttgtttccatctgtgatgatatgaattgctctatttctgcactgtctgtgtggttcctgtggactcaccagggcacacagccttagactgaaagccctataagtgaggaataaagctcttctgttcagaagggattcccatgtgatataggaagcactctttttctcacttggtgaattttagagttttcttccatagaaacaatttttctgttgctttatacatgtacatatgtaaaaatacacagcggtatttatgtttgtttctaaaaaaaaattaacaataataaaaaagaaacattcccctgactttcagccctgggccactctcttttggggcaggcacaaggaagagacagaaacagaagcagtaggatagcaactggctcagcatttaagctccaagaaccacctccgtcttcttgtagtttcttccgttctttcctaccatattgttcttggaaaaatggagtcctttgtttttccatctgctaataccaactgagtgttccaggcatggtgcttgctcactgtgatgggcagttaacagccaatatcctgttcagggagctggccatgtaaatgggaatgtaaactagaggagcactttgggtaatagcgggagcagccaaaatgaaatgtggggtgcatcccggggatgagcttcgtggagagtatactgttaagtttggcaattgaaagaggaaaggcagcctaatgcgtgctccctcatttaagctcactatgaagtgacttacagtattctgcttttggggcatgatactgaggaaactggggctgagagagtataattgactagtcacaaagccttcctagtaagtggtgaagccaggatttgaactcagatctttttgcaccctaaacgaatcattgttttagataaaattttatctagtgaaggtgggagaatgttttcaagcagagggcttcacaccagcacactgtacctaaactgtcacccctcacagtctttggggctgggcattcagcctttgctaccagcccttcacttggcatccacattttaactttgagcccttggtcaaaacgtggacttaatttgggttggtgctgtgagggtcatcagtaactgggggaatgacatggtcctggagacagagctgcttggcaccactctgagggcattaggacagtcgcagagagtgaggctgtctgtcacctgcttgcaggagttggtgctgctttctttcactccctccatgagcattttatctcaaaggcagtatacttaaccttcctaaccagccattaccaggatatgggctcaactctgttgatgtcccagctccatccatacccccttgttcagctctggaatctaatagcacatttgtgaggaggcagggacaagcatctttaccgaggtcatcatggggtcaggctgatagccatggtcttcttggcctcccacactagctagtgagataaactcgctacagataattgaggtcatcccaaaagacaacaaggatagcttctgggtgggtggggagcagaggggagtggcaggaagtatccaagcttaaaagagacactgtgctttgcctgggaagatgtaggaaggcctcctggagcaggtggctggtggctgaccatcccagtaactatccttgcagacactgccctagccaggttggttaccacttctccacaaactcagacgtcgaaggggtagacaaaggtctatggtcctcatgtgaagaccgaaaccagacttgcatttgtctgtccctctgtggagttggaaaagtggcttacccgcaatggaggccactgccagatgtgtcttcctggtgagtcttcttgcttataagcttctctttactttccagggaagggtgtggcagagttctttgggctggtgttttccagcctttttaaagtagcaaaactcatgttttgaattgaagcttactccctcaaatccttagtaatggcctcttaggctattccattgaatcaggtttgaaaagccccctgttttaggcagaaggaaaaggaggtgtctacctcttatgctgtcccttccagcctttacagagagctcctgtgtcccatttaaagcccatgtttttaaattctgtagttttgaagttctgccatgttcctaggaagaaaacagactccaggagagagtggtcatttgatgtcacattgatagatgagtcatcctagctacaaaagttactctcctgaaaatccgttagaataaattctaaaggtcagctttatgcttctactaattggcagttgttctcaatgtgcttgtttgtggactagatcacccccaaattgtgtagacttaaattttagtaaagaaaaaaattgttctagtgaaagtctaagatttctacgtagatttgaacttgaaaagcataggaatgattactgaattcagtccagtggttttcattgagaacctaagtgtgttctaggtccttttgtagacgttgggcacatagaattgaatccagagtttctgttcttgaggaacattgaacttttctgttatttttccagtagatatccacagctagggggctctgcagtagaaattaaacaggatagtgcagaggctgcccaagtgaaaagaatgattcattctgggagtgagggaattaaagcttcatggagaagtgtcattagaactaaacatagttgaaggcagagaatttccataaagttgggactatctgggggaccatgaagagcatcatgtaattggggacatgcggtgggaggtaagactggaggagcctaagggaagggccctcgattatcccactgaggagaagggattcatctgtgggcctaggggcatacatggggttcattcaaatttaccctctggaaagacctcgccagccaggttttgcaggatagctaataagagggaggccaagctggagtcagggaggctaattcctgggctgctttaagagtggggaagagagtcacaggctgggaccaggggccaacccacaccccctggggctgctccgtggcacttagcactcatccttggctggctccctgctttggtgctctctgcctgctctgtagtctttcctactcattgtgtttaaagaataaattataagttctgtccttatgaagtctgaaaagtgttgtgtgccagaacttttcagaaagattttcaatagcagcatttaaaaatcaacttattaaaattgggttctcttaaagtaatggtaattgactaggagtgtgcatcaaaattatgaagtttttgttgcaaaatttaaacagtacagaaaatatattaaacactcatgtttatactatctggaattgatcattttcattatataagttttttttaatgaaaaatcaagtggcaaacattattctgtactttttcctctacccaccctccgtcttcaaccaaaattaatcttcctttctttcctaccacccacaatgtattttcttgccacttacttcccttagaaaatcaaatccagtgaaagctctctcttctcattttgctcctagatttttgcccattgtctttttctttttcttttttttttgagacagagtcttgctttgtcgcccgggcgggagtgcagtggcgccatctcggctcattgcaacctccgcctcccgggttcaagcgattctcctgcctcagcctcccaagtagctgggattacaggcgctcatcacgacactcagctaatttttgtatttttaatagagacggggtttcaccatgttggccaggctggtctcgaactcctgacctcaagtgatgcgcctgcctcagcctcccaaagtgctgggattacagacatgagccactgcgcccagccgatttttgcccaattatctaccatgaatttgtgcaatagccattggcaccaacatgagacttttcctctggaatttttagcagcttaagatagactcggccaacaatttggtgaccttggatacagaccctgactgcagaggagagatacgaggttcaggacatataggggatggttgaactagaaagggaataatgcgaggagacagtgaaccaggagcagagaagctgggagagtagagacaaagcgtcagtagactgaagctgagattcaagagctcggtaagatggaaaaaagaaaaaaaaaaaggcatttgtggccagagcacagtgattttggaaattaaatttatacattcagagttgtggggattttctcccccgccccccccggggttggggcattttcaaaatatctaggacaaggctgggcacggtggctcacgcctgtaatcctagcacttcgggaggccgagatgggcagattgcctgagctcaggagttagagaccagcctgggcaacacggtgaaaccccgtctctactaaaatacaaaaaattagccaggtatggcagtgtgcaccggcagttatagctacttgggaggctggggcaggagggttgcttgaacttgggaggtggaggttgcagtgagccgagattgtactgctgtaccccagcctgggcaacagagcgagactctgtctccaaaaaaaagaaaaagaaaaaatgtctaggacagaagctagagtacaaactgcaggcctagaagagagcttagctttgaaggagttgtttcttagtgatgggagtgctatgtgtttgtctcctactcagacaaaacccttttgacccactgctctcaagggggtaggttttatagatgacccacagcctgtagctgggcctgagtctacttctaaagtagaagatgaatccatgcagttgcagtgtgaaagaggcttctaggcctatggaatatccatttaaaaatcctgaggatgctgagttagaggtctcccttggaccttgtgtcaccagctgcagcgacagcagtgtcaccaacaccagctttacctgttgtcttccatctcaccctttcccttagtttagcccctattggcgtctccagtggagtagtgagaagcagcagcatgtctgaggattagctcacagccttagaaattattctctacttcgaattgtttcacttaccattaattcatgaaaaagtcattaactgtttttttaagctccagggatttattatcccagcatgtagaaagaatgcagaagcattctccatgtgttaagcagtctttttcctactcagagtttctttgtagagttccatgcaggagtctctttgcctgtatgttcagttgccctaagaagttgttcagaccctgctcagagtccttctttccccattagcagcaaaaaggcagtcctttcttgctgttttcagaagctcacggtagccacagccaaggtctgggaagcaccaccacactgtgggccatctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgctccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatataatctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcgaaatcccattgttaattggcctccaacttagataatgccctagaatgacatctatccaaaaggttatctagtgaggacaagggctcctgagtatttcaggtcccgagcagaatccagcttggaaagccagtccattacctggcccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaagttaatccagggatatctggtgccacaagccaagctctttgcaggatgttcttctgccttcccaaagagtactggtccaggatgaggttcattttcctgacttggaatgctttgcattgtctccctccactgagccctcttcattgtgtctttatgtttgaaagaaatagaagaaggactcactctggagcttaacttgagcctggagccagtttaggttcctctggccccttgctgtcacctcttagagaaaagggggctgaggtcagaagggtgccttctcccagacacctggatccggcaggaagctgtcctaaatcccaggcttcctgggagagagtcatgaggcacacctatgagtttgctcgtctgtagtcctcatctacaatcctttatgatgtgaagccccacatcagagttaaaggaaacgatgttgacaattataaaataccaaatatagctgagtatatttaaaaatgaacaatggtaaaagccttgaaaatttttccttggatgtgaatggagtctttggcatttggaaatacaataaaatgaattaattgctgcttattaggcagcgagtcaggagaagcatgaatgtgccttctgtcctctgcgttagctgttacctgactgaagtagtctccttttgtatttactcctgccttttctaatgataagcaaattagagatcatagctagaaaaaaaatcaagtgccctccatcctttttccaaaaccataatatagttctgtgatgtttatctgctcaaggggtatggctaataattgcagaggtcatgtggagccacatagtgcaagattagaaagaacatctgcaagattacttcttaggaaagtattttgtgttttgtctttttctgaaaaagtgattgtgcaagcaaattgctgtctttcctcccttgcactatattgctggttaaagcatatttgaagaaaaaccatttaataactatcaagagtttttgaatccatggtcgtttttttgactttactattttttctgacgtatttgatggacttctatatgaataaattacattggaatcctatctttaaattctgaaatcatggcccatgaataaactgtttggaatatattgattatgctgttcattaaaattccatatatggcagctatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccagccatgtgcatttgtgatattgctgtcctcctgtcatgtatattacatgtagatattttccaaacattgtgtccatttcaaccataaaaaggaggcaatcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggtagatgatgagacaggcatcccgagtctcaggtcagttggaccgtttgttcttagaacccatcctctttcccatcaaaagtccatagaccacccatagttcctgctccatgagtgttttctgcattgcaggtcatgggcttgggttggggttcagttggaaaagggagatttcccttttctttccccactccccaaaacatttggctttttatgtcctcattctttgtaatcttagggatagagggacggaaaatcagcaataagtagtcagtgtgaacttgtccaaacatttttctaggatgcaattttcttattcttgctcatatgcacacgcacgcacacatacacactcagaatatttcctgtaacctaagacttcacagagcataattccgtattaacctaacagtttttcagcatcaaacaatgtgctcacctttgtaaatctcatccacatctcagaaatgttggtgtgaagacatcttaaaattagtgtggtgtacaaatgtagcatgtgtttgaatttacctagcttcgcttgtttggatagattagcctcctcccctttagagtgaggatgagtagtgaggatagagtcgaatgctttaaagtctgggatattaaaccagagtgacacagaggagcagttcactcaggtctgacacttagagttattttttcaaagccaggcaggtatctctgggctgcaaatgacaatttagaggtccttccattgaaatctcttagcttggcattctttcaaattcccgtttcaggataagtgggtctgtaggcagacccttggttctgatttcaagatatccctggtggtgcttattatttccagggtcacattagattttaaacaaaaacattttaatccttttaattttcaatatatattgtagataaaggggagatgttataaaaattaaatgagtagtcagagtagctcgaccacaaaaggtaggaaatcactggtatagacattttagtccatttgcagaaaattgcctattctcaaataggtaggtcaagtgcagaaagaacctctacttgagatgaaatttcctttctacacttagctttctattaggacagcagaccaaagctgcccaaattttaacatcctgctgtcttctcactagtagtttccttgactatatgcattgaaaagtatctgtttataatggaatttaccctcatagctacaaatacctttaaacccagaaggacattaggcagtaatgtgcaacttttaattttataaataaagaaacttcgaagtcattaaatgacttgatccacataatgcagctcattaatgtcaggcagggacaggtttgaagccaggtctccggacaccccagtgggtacaccttttatagtcttggagcaagttggtgtcataaaagcaattgatttgctctcctgctcttgaactcctgttttcatttaggtacctggtagaatgctgggtaatgagagagtcaaaccttactttaacagaagaaaaagatcatgttctgaagctgtgtgacataaacagcaaagataggtgcttttctccttttccacactgactgatttccgtttcaaaaaagaatatcaaacttgtttgaagatttcaaatgatttttaataagcctagcaaatttcaagcaactcaataaagcgggatgtggagatgcagggaactcatttggacctggacttagaattcatgagtcaccccacccaagtgtgcacaaacagattctgtatttgggcaagcagaagtgcctctgtctgcagaatttcaaatacgtggaactcttcgggtctgtgagaggatccacgatgttcttctggaatggagccaagccctcaagttcttttgtagctattgctcagatgtgtcagtcaggcaggcaagacgtctgtgctgccattttccaatccccctagcctgggccccagagaagttgtaaggcttgttctgtgctgaggaaggcacctgtggtcatacctgagccattacctcagtttcagaaatctgccttgagagcatttataacccccttggtagaggttgagtggcttgggggctggagtccaaagtgactggtctaagagaaaccaatggattcgtattgatgtcagggtgatgttgatggggaatggagttggtgtgactagggccatggtttctgttcatgggctaccctctgaggggatggacaagcgaggagcaggtaaagccacagaatagccaacagtagattgcctggcactgaggtctgcatgtgtgggcccagtttgtcagtttatcataaaatcccatacacttcaagatttgccctctttctggcatcctcagtatctgacatgtttcaaatcttaaaaaaaaggttagttgaggaagctagctttaggttagaacatttgacagattagcaaatggagccccaagtcgaagaactgccatctgataagaaggagataacagcagcaaaaggatcattctgagtcactctggccgttcttttgaggcccaggaatcctgccagcttctagggcccttggagtgtcactcggccacgggaggtgtcattacagatgttcataatgaccttgagcatccatgaaaagctgttacttgaggctccttagtttttcagtcacagccagagtaatatataagacataaaaattaatgtggctgggcgtggtggcttacgcctgtaatcccagcactttgggaggccaaggcgggtggatcatctgaggtcgggagttcgagaccagcctggccaacatggtgaaaccccatctctactaaaaagacaaatacaaaaattagccgggcatggtggcatatgcctgtaatcccagctactcaggaggctgaggtaggagaatcacttgaacctgggaagcggaggttgcaatgagctgagatcatgccactgcactccagcccgggcaacaagagtgaaactccatctcaaaaaaaaaaaagaagaaattaatggaagtgttaggctccgttttctttttcccccctcccctccctttccttttttcctcccttcctccttccccttttctccctcccaccctccctttcttccttccttttctccttcattctttttttttctgatggagtcttgctctactgcccaggcttgagtgcagtggcttgatgaacacagctcattgcagccttgacctcccaggttcaaacagtcctcccacctcaggctcttgagtagctggaaccacagaagtacaccaccacacctggctaatttttttttttgtgtgtgtgtgtgtggagacagggtctctctatgtaacccaggctggtcttgaactcctgggcccaagtaatcctcccacctcagcctcacaaagtgctgggattataggtgtgagcagccacacctggtcttcccctttccctttttctttattggctctttttcaaaggttaatgtaagctttttggaaattcacattgtcttcctgacagttatagggcaaagtagtatctacaccctgggaacacctagcacatctttcttagaagcccttagcagttgttcatgagctttgattttttaaaaactcctttggccttgcttttgatgccttgatgtgtttttttcatcacctttggttatatcagtaagcattgaagcaccctctctgctggtacttggtgtcttagcctgaagctccctttgacgttccctggaggtggaaagcactctttttattttgatgtcaccattttgtttttgctttgatggcatttgggcctggaatatagaccctctattggcaccggtagcctttatatgcctacgaggctcaaagccctgcctgtgcccaccgggcctgtctcataccaggaggctatttctctgtctgtcctggggaagccacagaaccagtgcaaaggagttgaggggtagttttttattgttgctgttgttgggtgcccttctcaatcattgcctttctagatagccatctggatcaccttttcttcctaaaatgtgaaaaggcccacacccctatgcattttattgttcccaagtattatatgtttgtgtacatatatacatatgtatatatacacatatatatatgttttttttttaaccaaagaagaaaaaaaatccctttttatgcaatccttttaacaaattgtttattattgtatccaggtaacaagcatggtaagtattttcaccaaactgagtattctgtattttagctgtgcttggcagacttttttggctagctttgtgttgttagccttggctttcctagaaaagacccgttcaggaaaaggagaaaccacgtacctgtagcatcccctaggctcctggcttcagtacgaacccacgtagccttagccccacggcggggatacctgagaaagcatgcaccccgccagcatgctgcttggccctgttacccccaacccccgctgcttctgagcctctccagccaggtgtctgcagggcttccaggccttgcatgaccccagcagctcctgggaccatggccctgtgacagtcaggacacacagatagggctcctcgagctctgtggacggtcctaccccagtccacagctacatctcttctctcactcctcctcccatccgtttgcttaaaagcagggcctttatttttttttcttccttaaatgttttaagtaattggagaaatcttctggaagctgacaagctaaataaatacgttgtccactcttctgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccgggggtaagtcatgagctcagtccagtaatgacagctgctggggttggggttggcatgtgccagtgttaagcctcccacctccatttcttgtcatgtgggtcaggtatgtgagagggcaaaggctaccttgtcaactgataactgagtctaaagtggtgaaagtaaggagggaagggaggcagagagctagagagaaagggagggggaggagaaggaggaggagaggaagaaaagaaaaaaggaaaaggaagagggagaaaatcagaagaggaaggaattctgagtccctgaagacatggaattaaatgtgcctttctgggttgggctcaggcgtcttctctctttatctttttcctggcccttggtctctgtccctctgtcttcaggggcaactagcccctaaagggacaaggtattctattaacatttacattttgacacctaccaaaggctgagaagcattatgttataatctcaatcctccaggtaatcttaaatgctgcttattgtcattgccattttgcagatgaaaaagctgaggttattcagtagcaaaacaagagtttggatagctgggatcatagtggaatggatagtgatgtcaagaatcagccccagggttgcttgactcctgaggctgctctttccctcctctatgtcatgccccctttccagcccacaccaatcgcagcagggaagctcgctgcagagaagctgcctgcattgccgcttggagctcctggccttgttcaagctttgtcctctgccttgctgggtcttcactgctgttgacgcagaatattatgcagggaatgtttcagaatgaagggagggtacatggataaatcagtcagttcaaatattggtgagccccctgcagcacgcgcagatctttgcttaggtgtaaggaaaacaggagctgctgcctgcgtctgcccttgggggcattttcaggaaggaggcgctaaggggagctctgggttgccagtccaaggatataggttgtggtctcgtgcaagtggtgaccgcatttgcactctgggaaagcgattctgttgggtgatcgaacctgctgtcttttagcaggggttgtgatgcgtaggcatcctaaactgtgctttgaagtaaactcgtaattctgaggcctttgcattttgccttccagttctggccgggaatgattcaaacagggcagccaggatcctcacaagagtaagtctgaggaggggtgggcactgacaactacgggctggtcccagcccacgtggggagagctcttcctggaccatagtgtctcagggcctggaggagaaaggagcattacactgaggtcccagaaggcatcccctttttattgtgtacttaggcccctggcaggaaagagactggcttttcggatctgggagaggtggaagcaccccattcccaccttaagtattagcagtcatccagctggaagcaagaagtggacccctcttccttcatggtattgaaggctgagctgtggtcctccttgcctgagaaagggcggcacaggtgatcctctagcccatttcattctagccagccctgtagtaggatggctagtagacaaatcctactgatgccttgggggcaagagaagaaagatcagtaaactggaaataagggctatttcgggataaaagaaaggaaaccttgcctatatgctgtaaaaaaaaacttgcattgtttggcctagagaaggagagcctgaagcatgtcccacactttgcctagaagtggtgactgcttgacctcagaggttcaaaggcagatgccacagcacaaggaattcaggctgtctttccagcacatcccattgaactggaatgaggcttggtggtttgatccctacctggctgctggtccctctcagtttatggaacaactgcctctgcctggggtgtgctaccacctgcaggcagggaccacagcggtgaaggacctcccactgggaggtcatggtggggcctgggtaatagcccctgctgcagatgcgatctcttaactctgtctgccatctctctgttcccagcgtcaagccttttgtgcagcaggcctaccccatccagccagcggtcacagcccccattccaggtgagtgtccctgaaactcctttttgggagcacagccccacacagctgacagctgggtctggcactttgttcccagagtcaagagatgctcaactttgccacagccgcacattgcccctgacttgcaggatccttgggtagcctgtagctcaggagggccacagggtcccgattcccatcagtcatctcccaagagcttttcagatggtttgtttaagaaacaggaagcctcctcactttcactgaagacgctggattatcctcagaaggcgaagttgctgcagcatcttcctcaatataaactggccaaattaggcagtctaagtctcaaggccagatagggtttcattcaccctttcttagataagtagatttcggtcctgctacctttctttaaaggagagagtacatggaagctcaaagtggaaaacatgaatctgtctagcctacctgtctccttccccacaaggcgcaccccccatccccacctgtgtgtgtagaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcatactgcagcccttaaccttagctgaagttggcttaatgaggaacacatgctttgtgcttatttgactgtttaccatcactggggccctctgccagcatctgtcgtctgagttatcctggccagagccggtggagagggggctgttggcatttccttctgggtcatctgtagagccctgttccagtatttgcctgaggcccaaggggaggtgagtgaccagcatcaaaggtgacgattgctctttcagggtttgagcctgcatcggccccagctccctcagtccctgcctggcaaggtcgctccattggcacaaccaagcttcgcctggtggaattttcagcttttctcgagcagcagcgagacccagactcggtgagtgtgcccagagaggtgtgtcttgaatccaggatttctttccctttactgtttacctccttgcttctctttctttcctcctttaccccgccccatgcctgacaaatatcctgtgtgaaaacgggcctaggaaagaatagccttttgattaagtaaaaagggattcctattggcagatttgtagaaaacagcagagcaggaggtgtattactgtcctggaccccaaggtgctgtggggaatacttgagtcagagagagggacgtttacaagctcttatgttttgtaaaatttaacaagaagtaacatttattgagccttgccatatgcctggtcccatgcagagttatttagatatatgatcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggccgaggcaggtggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccgtctcaaaaaaaaaaaaaaaagaagaagtaacaaaatggcactttagcagtttgccatagagtgcagtgcattataatatcataaataccagtaacattggcatctggactctatttgtcactttcttctttcctacctcccccacccccatcttgtacccatcgtcccattgtttctcagccaggcatttcccatacatatgtgatcctcccttctttcccacccaacaagccccgtaccctttcttcacacccactccttggctgtgagtatgagcgttgcatctgtgtgtgggtgagcccaaggcaaaaactgaaggaatccttagtttgtctctgagatcctcaccaactctcaccacgttctctatctcaccccatccttcccatctcataagtcccatgctgtctgtgtgttgcctgccttaatgtcatttctattatcgggagacagtgtcaagaatgagctaagagcctgtggtagataaccgagatgctgaacaattggaggtgacctctcacgggagtgtttgcacttcagcttgagggaaggcctcccgtggggcagaggggcttgaccagtcatcaccagagtggagaacccacatgtggcccactcatgtctttgtccacaaatcatgaactttgggagctggtggaaaaatagagctgcttccaaattagggggaaaaatgagggaaggaatgtaaattgggcccatcaggacaggtacaagaaaatggggctattcagaccaggaaagagaagaaaaggccaactggatgactccttccaagcagctgagtggctaacaggaagagtgatggtgagggttaaatccgtctaggtggaaggcattaagacaaactgaaagatgccctgcgtgactctgtcctgctggttctttctgggaagcatacatagttctttggttgaaggctgggctttggcccagatgctgcttctgcctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaagtgacttaagattaaacagaaggaaacaggagcccaaatcttgtatttcattgtatccttttcactatcgtaaaagatcacctcccagttttgagggtctcttgaattgtctttttttttttttttttttgagacagcgtctcgctctgttgcccaggctggagtgcagtggtgtgatctccactcactgcaagctctgcctcccgggttcacgccattctcctgcctcagcctcccgagtagctgggactacaggcgcccgccactacgcctggctaattttttttgtatttttagtagagacggggtttcaccgtgttagccagggtggtctcgatctcctgaccttgtgatctgcccgcctaggcctcccgaagtgctgggattacaggcgtgaggcaccgcacccgggcttgaattgtcttttcagtctgaatatctcctgtgtaagcaaatttctgtttgcatatgactgttttttaggaaacagctccaagacactgggaggcaaaagtccccacatgatttttgcttccctggttaaaatactatggaatcatttataaaaattctctttttttaaaagaaattaaaataatgtggtagctccctcattgttaactgtgctctccagttatggacctcttagggcccagaaggctcgattgcctctttttgttgttagtatttgttgggctaaacattttgaatcattcagaccattctgcaaacattcgtgtgcacctgcatgtgcaagaagctgtacaggagaggggctcatcgctgcccagacggccacagcctccgcccctggggagtataatgcctagcaggggagacagacacgaaacagatgattatctgagagatcattgcaaagtgctgtgacttctaggaaggaagaatactgaacgctgtgagtaacaggaaacagggcaagcttccttgaggaagtagcccttaagccgaaagatggaggattggacagggagagaataagggagcagaatattccagaggtgatgaagctgaagtgtatgtggcagtatattaaatcagtgactatttttggaaagtcaaggcccactaagttgctagagtagaggccagagataagtgtttcaggtacgttcaggatacatatgataatctgaatgggtaaactggatctggcctgctgttgttgaataaaaaagcttgacttacatagactccaccacatgacttaaaaggccctggaatgaaaggaaggcctggtgtaacatccttgggacctttgagaaagatagttatattttaggggatatgaattggggattgggagaaattagaatttatttaacaagtattttttgagcacctactacacgccagccactgtttcaggtgttagaaattcagcagtgaacaaaacaaagttctttttctcatggagcccacacttgggtggagaacacaagaactacccaagcacataaatacccagtatgtcaggggatgctaactgcttatgtggaataatggtcctttgtcacaactgatttttttttttttttgagatggggtcttactgtgttgcccaggctggcctcaaactcctgggctgaagtgatcctcatgtctcaggctcctgagtagctgggactacagttatgcactgccatgccccaaccttcttcacaattgaaagttacttgctttttggatttaaagtatataatttcagaaaataataataccccctaatagatatgttgatgtttctggcttgtattatgatactaagtgatgtgcattagacattaccagccagagctctgtcactgctgtgaaattattttgcctaacctcagtcactattgttggtgtcgcttctgatattcctatgttacaaacactcattcttcagttgaacacaaatgatttaatatatgcaaatgaatgtggaagtttttttgtttttttttttgtttgttttttttttttttggagacacagagtcttgctctgtcactcaggctggagtgcggtggcgcgatcttggctcactgcaagctccgcctcccaggttcactccattctcctgcctcagcctcccaagtagctgggactacaggcatccaccaccacgcccggctaattttttgtatttttagtgagacagggtttcaccgtgttagccaagatggtctcgatctcctgacctcgtgatctgcccgcctcggcctcccaaagtgctgggattacaggcgtgaaccaccgtgcccggccgcagattgttaataggatctatatttgattttagtggacatgtgagggcctgaaggttggttcttgtgctagagggaaaaagtggtggctgaccagttgaagtgatggagaattaataaaattatttaaagcatttgacagtatcttaagtaccagcctctcaagttatatactgtgtgctttattggacaaacacaacgtgctattacaatcaaggtataatggtacttcagggctaaggttacactgaaaaatttgtatcatgtagatagtttctttggctcttagagtttttgtgacttctcagactttaattttgctatagttttgttccaacaacagaaacattaaggccatctaagataaactcagctgatacattttaacaaatttgggcatacagtacttaaaatataacatccagcattaaccacattaatttgataagcgaacaaagtgaccaataattaaagggccctaagtaagttaaactttgcatttgaattctctagatgtttgttacagacagacatgtacatatgtttccccctacttctttgtaacggcttaggctcattagacccaaggggttataaaatatttttagtagagaagagaacttataggtagtgctggcaaaaaaagaaattatgtagccaggttccatgctatttgtcattagtgacttctttcatctttattgagctctgtgaggtaggttattctattcccttctacagaagaggcttggagagatgctgccttacagtagccagctttgcaccccagcctgcctgtagcatctcttaagacaagataagacatgattgctggctgggtgtgatggctcacgcctgtaatcccagcactttgggaggccaaggcgggtgggtcacttgaggccagaagtttaagaccagcctggccaacatggtgaaaccctatctctactaaaaatacaaaaattagctgggcatggtggagggtacctataatctcagctactcgggagactgaggcaggagaatcgcttgaacccaaaaggcggaggtggcggtgagctgagatcacgccactgcactccagcctgggtgacaagagtgaaactccatctgaaaaaaagacatggttgcatactttggtaccaccaaagccaagagaagaaccttagtttatctcctccttagtctgaagtggccttagaaccagcattttctgaaatttactcgttggctcaccacatatgtcacccttgccaacattgaagacttcctcacaaccccaccactcctagcaatagtgatggccaacatttactaaatattttctgtatgccaacactatgcattatcttatgtaatccttatgaagtagcttgcccagtgttagacagccagctgacatgggaagtaggattcagatccaggtctgttgactccacatcctgagatagtgaccaaaaggctatacggtccatttgtagctgatgagtagtctgtttttgtagcccagggccgtaaggagctaatgggagaataattagggggatgatcgccccctgctggctctgtgtcatgtgtaaaccagacggcagcttccccaagttggtggtggtttatgttggaggagaaccagcgagtcagtccctctgttacctttggctctactggaagctaagagaaaaacagcagagggtgaagaaaggaaggaagagtgtaaaaaacaaagactattttagttggaaatatactttctacatgatttcagtgttgcatatcaaaggatctcaagtgttaagtgtgatatcctccacccagggtgggctatttaaaaggggcctccctgaaatcagggtccagtttctggaggccaagttaggcagatgaaaacccggcctggctgagctgtcagctgaatcctgaaagtacacagggagtggttttcctgataaagcctggagtgatgcctccacctcaattctggggcacggcgggttcctccagccccccaccagggcagcagctggcaaacccctgcctgctcagactgcccggtcaccaggctgtgtgtctcatgcctgttgtggtctggatgccatagtgagcaggagccaggaagaaagcacagaaaggatttactcaggcgggagttacacaaccagaggagggaagagttgggggtggagaaagaggcaaagagattgttctctttagattttgaggaagcactcactgccttgcagaagagaagttccatgatacagtagaggaacaaacccgatcagggaaggcacacgtttgctcaacatatgaaactcatttatttttatttttatttttttaattgaggcagggtctcactgcattgcccaggctggaatgtagtggcacaatcacagctgactgcagcctcgacctcccaggctcaagggattgtcccatctcagcctaccaagttgctgggactacaggcatgcaccaccacacccagctgatttctgtatttttagtagagatggggttttactatgttgcccaagctggtcttgaactcctgggctcaagcgatccacccacctcggcctcccaaagtgctgggattacaggtgtgagccaccgtgcccagccaagcaacttatttatatattatgtcaataatgatcatcaccagcacttatgagctctgtattagtatgctgagcattatgtccagtctgtacataaaggaaccgtggctcagaaacgttaaataaagttatcaagctctacctccaaaaacggtgactgtgccaaagtttaccaccactctgtattcttaaccatgtcactgtacttttgaagaaataaagacaaagttcaaaagttaaaaacagctgcctgcaaagtaggagctccccaagcaaggccagacctctgagggccttccacattgggtagatggttactctgggtttcctctgagttcctattccaacccatggaaaattgtcttccacaaaatcagtctctggtgccaaaaaggggaccgctgctttagagcctatctttcatcatgctctagtggcagcaaagaggtgactgatactagaattcttagcagctgtttgagatttggggcagattaccgcagctcagcctcagtttccagtctgtcttaagtggacataacaggatcgctgccatgcttactgtgatgattacatttagtaatatccctgaacatactgagcactccacaaatgcttctgaacctgaatgtcttacagtaatgtgaaaggaaattgagccagagctctggacagggatcaagcttgcgagaatgtgctcactaagtgctttggactctactgaaattctaacaggagtcagaatatttttcaattacttttgagatggagttttgcttcgtcgcccaggctggagtacagtggcacaaccttggctcactgcaacctccacctcctgggttcaagcaattcccctgcctcagcctcccacatagctgggattacaggcatgtaccatcatgcctggctaatttttgtatttttagtagagacaaggttttgtcatgttggccaggctggtctcaaactcctgacctcaaatgatttgcctgcctcagcctcccaaagtgctgggattacagatgtgaaccaccatgcacggcctcaattagtttttaaaatcaattaaacttttcataaaggtagtaaattaatgtggtcaaaaaatctccaagcataagagaatggaagggagatgtcccttccttctcattcctatcctacccttaagtaggtagccactgctactattctcttatgaggctttgtagtgattttagtgcatatacaatctaatatgaatatgtattctcccaccccaccctgctttttaaagagaggatgtgatctaatttgtgcttcaggaacacgatggctgcatcaggtgagagcaggggctggaggaaactatactgttggccagctggtggctgatgaggaccaaaccagggcaggggccatggctgaggaaatggcagaggggagagatgttatggagataaaattaaaaagccttgtggattaatgagctgtgagaagaggaggataaatggtaatgactgggtgttggagaccaaggatgctgataagatttgaagagtcctggaacagaggaggaagcaggattgctaagaactgacttgatgataatgcttttgcctttcattctcaaaataagcttgttgaaatacctattagagacaggaaagctcagagagtttaagtaacttcatctgggacctggctaatagatggcagggttgactatttgaactttgtctgaatttcacagtgtatgagaaaatgacacttaccccactatctgggaaaatgggaagggcagggattgttctccattcacagatggacatttgatttgggctccaggacaggagagagttcctgaagggtcacctgggcttggtgatggcagcccctcagccagaaggaagggagttttgctgcctggtgttctggcccttatctttattccaaggggctggacctcctggacgtggatgtgggagttagcagtcttcatagtcagagggagcccaaggtctcccctctgggggactggcaggcctgtggttgagcccgcatggaaggtctgtaaatatatcctgcagataacatgattctttctcgtaaaggcagttggtcaaacgtgggcccaaggatgatttaatttcacatttttatacttctttcaatggcctaaatttacagatcaactaaaattccgttgtcagaacacagatcctttcttggtttggaaaatgtgaccaggacagctctaaggaaatatgacattaatgaggcctgtggaagaaagaagagggggatggctgtgcatgggggattaggttggagacacaagataaaaagcaaggtttcagccgggcgcagtggttcatgcctgtaaacccagcactttgggaggccaagcaaggcgtgtgggtcacctgaggtcaggcattcaagaccagcctggccaacatggtgaatcccccgcttctacaaaaatacaaaaattagctgggcatgatggtgggtgcctgtaatcccagctactcgggaggctgaggcaggagatttgcttgaacctgggaagcagaggttgcagtgagctgagatcgcgccattgctctccagcctgggcaacagaggagactctgtctcaaaaaaataaataaacaaaaataaaaaagaagcagcagcagtaaggttttaattcccgattgccaggagggttcttgcctttatcctgggcaggacagagaagggcaccggtgtctctggaggagcttcctagttttatagtggctgctgaggcagttgctccatcttggggtggagaatggctgtttgaacaaatctggttcctggtccttcagaaaagaggctccttctctcctgtaattcagggcttggaagtgatctcatgccagtaagccaggtcaccagcatctgtgcagctctgtgtggcctgggcggaattttcacattgactgtttcatttgaccttgtagacaggctagggttcatcactgctcagatgaggaagccagggcccagaaaggttaagcaacttgcctcaagccactcagctcaaaaatagcagagcctagatattctaacccaggtgtcattaatgttcccatctcatgcttcggaataagtggtcggaaagtacatttggccttccaggtttggggaggaaggctgcagctgatctaacggttggctctgcttagtccttgaatgtctctcaggtttttctcatgtttttccaagcctggtcttccagcaggacgtaggagatggagtgtctcccggggaaggagatgatggctcagtgtggagcacccccatgcccctcacagtcctgagcccttgccgagccacctgcgagcccctcccggcccagggcacactctcttgtggcagcagacattgtactgtgtttctaagatgctctggccacttcccctgtttcttcattaccctttgggaaggaggccactgaaagcgtctggaaatccgggttctatagacatttcacagaggccccagtcaggccccctctgctttctttggcaggtccgcaccccacgcaccttcctggttgctcactcagtcggtgggcctttcagctgcacttctgtggggaagacacactcctgtctgaggaagcagcagcccctctgtagagatggtgctgggagtgggaggtgggaaggatgcatctcggtgtgagatcccggaaggaggcattcacttgctccttgtttccaatgatgtttctctctgggaagaacgaggggcatgggatgaagtggcatatcagggccaagtggccagaacagggctggtgccctggacagtgagctgaggagagaacccacttcagattcactttctcctgggcaggaaccgtgagcacaggcaagctcctgggctgaatgtgcgggaacctgtcttggcttggctccgcagccattccctgtccccccaggggccaccgcaggctgcccagcctgccctggggggtaggtggacagacattccaggcaggaccgtgacaagaagtaaatgtaggtgatttgtccttgttctgttccagcttgtacattagcataccttgacatgagttatttgtcttgatttctttaaattcctaagtggattataatttttttcttggtattatttgacagcagtcatttttcaaggtttcactacgttcttcaaatacttagaatttttggaacaaatttaggaaaagactgccatcttcaggttggacggtgcagtgcaggacccggtgtgtctgagggcacctcgcagatgctgaggactagcagatttgtagggctttttcttccttttccacaaagattgaactgccttcatcagttcaatacatctagattcaatacatctagaatgtattgtcagtccttttaaaaaaaagagaaaaaagccccagtgaccactgttggaagttgtactgttgtggtttgtttcatctacagtgatggacaacctcctaggctgtccccactccacttttgggaacagactttgcatgccttagaggaaggtaggaagcaggtatctggagagggtactgtgtgcctgagggaaatgcggacgccagaccccacaaggcttccccacactgccactaccctagcaccgatggtaacatcagaacagaatcgccttaatgagtctgaaactttccctgtcttcatttatgctttaagttttagtatgtccaggtttttgttatcagagggaccgtattgatttcacattatttcgtccaaagtaaagaaacatcatgattcttccggaaagtaataacaacagcaaattacgtgctatgtacagtgttatgtgttttccttgcattatctcatttaatattcttgacactccagtacagtaggtactattattattcctgcattatagttctactaagtatacatatttccactatggctgtggaaactgcagcagagagagagggctataatcacttgccctggatgactcagttaggaagtggtgctactgctcagattcaaacccagatcccatctgacaccacagtccaggtgttcatcactcctcactgcaggctccctaagcagcaaagaacagcagggaccaggaaacaaagtgacccatagagcagctttgaaggaagacgaaagtcctttattaaccccccccgggtatctcagaagccctttgcaagtgaatggttgactttcgagggttgcattcacctttattattatttgcaactgctatgaagaataactggagggattatagcaaaacaaagagaaaatggacatttctccaagtcaaaatagaaatccacatattaagatggcatcaggtactgcgtggcatccttgatccaggtagggttttactggtgcaacatctttttggtgaaccctacctgcagacaagcgtcccagctcctgtccagctgtcctgagcgtttgagctgtaggaaagctttgcagtctgacccgagctcctttaaagcccaaggaacttgtggctaacacagagtaaacatcctgaagtaatgttttttgcttccttttatggttctttcccttcctcagaaaaactccataatctttcaagatagtttttgattggtggtttatttaataaaataattgtataagccagattgaagcacgtggcccataggaaaagcagtattctgctccttcatggctcctcaccttccagttctactttttggggaccattgcttgcagccttttcagccatttctttgtattaatatatttacctccacatttctaaataacatgcttatattgtatatctcattctattaattttaggcatcatctgttgacttcttaacatagaagactacgatttagttctctaaatttagtatatgcccccctccgtcttcctttcagtccccctatgtgcttttctctaaatttagtatatgcccccctccgtcttcctttcagtcaccctatgtgcttatatcacattaaaaaaaattagcattcagttaattttacaaacccatataaattttgcacacagcgtggttaatgttatatattggaaccatttccttaattgtaaaacgtttttttctggggtgtatggttgtcttcttaaaaaattgttcagttttacatagctacaccaattcaccctcaaagtttcgaggagaactcatactcttctccagatggtgagatataaatcaggtccgctctcttggtgacatccttccaggagtcctcagctccacggatccactctggactggttgctgacctggctggtttctttacctttcttctatgttaggccccatctctttttaaaacgtattccatccttttgtaggaacataccctcctatagctccctgggaacaagttgcaaggaaggtcagttttctgataccttaaatatctgaaagagtattctactttcatgtgtaatggataatttgatgttcattatggtttttgccttggacttgtgaaactttattcatgttttctaggtgatttccacatattttctccttgctaatgaacaatatgtttaatgctggagaataaggtcattcttataaaaagagcaggtaaatgctaatttagttcatgtgatatgtagaagtggtgttgactgtctttattatccccatcttctctgtaggaatttatgagaacatatatttatttgggaaagatagaattctaagtatcgaggtaataagcttgctctgtacagtcactctgtaggttctatgaagatgagcactttgttgttagctcatggattcctggtgtctagcacagtgcctggcatgtatgatggatgataggtgtgctggttcattctattaaaatctgtaaaacaggcagagtgagtaccttttccatcgttgaccttgagatgttgataatcagttgtgcctctactgagtgcctaggggactcttttggagaagtcaaaattagcctccgttttggatattgaggaaatcgagtcttgggccttgcatatgtgagtcattgacattcgccctttttctgctcatatcttgatcccaaatgccagttttctttcccaaatgccagttttctcttatgagtatttgttttgtgccccatagaatagaattgccctttttttgttttatgtgccaccttcacttttggggaaactaccactgctggagaagaaacgagatttatttgggaaggagagaagcaaataaataatccaccttggcccacttcccttataaggagaactggcaagactggaaatagagccttcaccaaagggtttttagaattcatttcattaaaacttgaacccaacatacagatttcttcctttcagccttctggatttggggacagagggattcctgacctacccaggttgaatgaaggggagagggtggtctgtttgtttcaatgctgtggtctccagggcaccttctgtagtactttgtattcttagaaacagagtcaccacctcttggcagcagtgaagccactcagatgccaatggtcagagtttggtttcaagtcaccagccttgtagagacagtgcccagtttcctttggcaaagacagcctgccccttctctattcatttcagccttgaacacagaggtaaattcctcaaaatagaaacctttgtggactctatctgatgcatttgtgaatcatgtttgtcactaattctaatttaacttcatagaagttttaaaacgctgtttagtttttttgctgttgttcctttcccaaatcaactttcaaaaaacgttggtttaacggtgttagaaaggcttagacattttcttttgggggacagtgtgattaatgtttgcagcaaacgcaagggctgtggtgttgacagatccaagttttattaactccaggactattcctggatgtgtgacctcaggcaagtcagttcatctctaagcttctatttcctcatctgtaaaatgatttaaattaaatccacctccagcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaactataacaatggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatccaccctcctcagcctcccaagtgctgggattacaggtgtgagccaccaatcctggcccctatcaaacatttcttatatggcaggtcctatgccaagcaccttctgagcattagctcctttaatattcacatatgttgcaaatattacaggtattatatccccattgcacatatgagaagtcttgaggtttcaggtttgtgtctggctccaaggctttcgtgctttacactcagcaccttgcttttcagctgtaccttcatggtccccattggtatgtggtagattttacccccattcaccttcttgacctgtagatgtcagggccgtggttcccatttccagcagtgcagtgcagggacattttgatgttaagcacaaagacttcaagtttcccagcttctcaacttcaccccagctctgacctggcccaggggcagctagcgaggcagaacagctaggagtgaggagcctaaagggagactgggattcagctcagtgagtccctaaggcttgtatctcatgccttccataaactcactccttgcagaaggcgctagaatggacagaagcggtgccttctggaactggggcggtctgagagctagctgtaagcagaggttgttaatcagggttggatggacggatacatagccagttgtctaggtaataaacaatgccttttgccctgtactccccattccattttgtgtttctgattgcctttataccaacgtctgtgcccacacctttgcccatgttattcttttttacttttgcccactgagactagaaagactagaagcttcttagcagctgtgactgtgtctcatacatttccatgggctgttgtttataattggaaaaagtgatgtggcaacatttgaaaaaatgtataaaaagctcaaagatgttccctcctacccttataatctcacctcttcccacccccataatctcacttccctaacacaatggcttttacttttaacctttttaaaaataatttcttccttctgaggcagaccctgttgttttatagtatctcccagcttctgtcttacctgccaggtggctagtccatgcagctgcatccatgtcagagcttgatagggttctctctttcacctcacctgataccttttaggatttttgaagctttggaaaagataccactctgatgttgaacaggagagggacctggccctctccaaaagatactggcctcagttgcactgccccttatatgcaacactggcatcagatggagtgtccagcctcctgtcttttggcatggtggccagagatccaaatgtgggtagcaggttatagatttaaaccagtattccttcaggatatatttcatagggttttgtgaccaactgagtttgagaaactctagattatatgtttaaaaatgtttctttatggaagtgcctttttaagagacaaggtcttactgtgttgcccaggctggagtgcaacagcatgatcatagctccattacaccttcgatcttccaggctcaagtgatcctcctgctttagcctcccaggtagctggaactacaggcatgcaccaccacacctggtgattttttttttttttctggtagagatgtctcactgtgttgtccaggctggtctcaaactcttgggcttgaatgagtttccctccttggccttccaaagtgctgatattaaaggcatgagccaccatggccagtcaatggcactgcttttaatacgctagtatttactgtgaatctctaagagaggtcttattaaaagaataatagctagattttattgactgcttattcttgttagatctaggatccctgatgaagtctgtggagtgtcttatttaaaccctgtaacaatccagtgaagtgaatgccatcactgtccccattttagagacttgagaggcacttgcgcagtatcatagctagtttgccttgggcagtgttttgtgcttgagtaggatgagtctagacccacacaatctttttttttttaaagcaggtcccagtgattaagttccatggactgtacattcttaacccatgtataatactcagctttgcccaagccttctgttagttgggacttcctgtggaatagattagtactcagggacagtagttggagaattgccagttttaacttggaatgtgagcagacttggactgctagataaagaaggcggatggagtttctcagtgaaccctatttggttctgaggcccatggagcctctgcatccccaggtttcttggtctgtgtcacattaagttggtattaatgcctattcagtgggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaatgtggtttagagttttttgtttgttttttcatgaatgagtgacctgtgttctttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatgacatgagctaactgcacacagatttcttattgggctccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagttccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagcacagctggctttggatttacactgagtgcaccttcatgtgcttctgcacaattgccaagggagcacggactcacacctgtgaactgtcctcatgccggccttatgcatccacatggtgcacctgggtgacattctctgtccctgccaaagggcacaagggacaagcagcctctttggacttcacttaaattcccggagctgggatgaaaataaagttacatgcttcaagattttgtaagcatcagagaggaaacagaattgctttgcccagtgtatacttcatttgtgctttaaaatgacgggcaaagtcccctggctgctgcagctttgctgatgttccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaagtgtttgtgccccttagcatggcattaaaggccctaagcgacctggttccagggtagcttcctcttgtgtcctgccaaacccctgttgccccacctgtccagtctatgctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggtgtcccccttcctctgggctctgcctcagggggccttattcatatagtggcttccttttttattgaatgcttgctttgtgctaggagctgtgctgaatgctttacgtgcatttcatttcatcctccacgttttaggtggaatttgcctcagctccacctaggaaaaaaggctcgtagatcaccagagacaggcttgtaggttgggtacctggagcttgacatcagatctgtgtgactttaatgcctctgctctgtttcctcgttgcataatcccttgtggaccctgaccacaggatctgtcaacctaagcctctacgtatctctataccaagcaagaaccttacacaacaaagcccaacagatgtgagaacaaatggatgaattaaagaaaaatttatgttttagattccttggaaggaaatttgcatattaaattagtttgtttcgtttcttttagccttccatgataactagatttcattttttgtgcttccattattgaaatttggttagtagtccaggcacagtggctcacgcctgtaattccagcactttgggaggctgaggcaggggtattacatgagctcaggagtttaagaccagcctgggccaaatagtgaaaccctgtctacgaaaaatacaaaattagtcaggcgtggtggtgcacacctgtagtctgagctactcaggaggctgaggtgggaggatagcttgagcccaggaggtcgaagctgcactgagctatgattgtgcccctgcactccagcctgagtaacagagcaagaccctgttccaaaaaaaaagaaatttggatagtagatgtagccttctacttatattaatggatgttggatctgtaatacacatggacaacctgaaaaagcgatcacagtcacattttccttttctgaattggtggctgccttctagtaatttggatggtggttggagatcagttatatggtaacagggtagctttcaaaatgtggcctgcgaacccctagggagttccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagttttatcacatcaaggaaaacaaatgacattatttgttgccaaagataaaatttgggctttcaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaaaatgaccactgttatctgaggagtctgtcacataatgtaaagcagcactacctgtctcactaattttttaaaaatacaggcatgtttaatttttttaaaaagatgtatatcaacatgtaattagcttattatttcttaaaatgaatgaatattttaaaatttgctcagttttaatttccagtacagaaaatatagatataacctgtagtaagcaaaaggtctttgaggtcctcaataatttatttggtcctgtttgcagtatcgtacatgatcaccaaactgctgctagaatgctcacacctgttacggcaaattcaaaacccaggaaaggcgtctcctgggaatttacttgaggtcagggtcaggctgtctggtacatcaataatttatttacgagtgtaaaggggtcctgtgatcaaaaagtttgagagccactattttaaaggatgtaaaaaggggttgtttatccaagtgaatgaaaagctaattcggaattatagaatgttatgaagagaaaccattttcagtaatttcaaattcaacagtagtgtttttaaataaggtttctgataattagcatattgtttgaatataaagtagcatagagtgcgcttagaaagtcttttttggttttgcctccaaaattgcccttattttacccagtggatgattttaataaatgttttccatggtggggcccttcagtcatgaatcctcaaataacaaagtctagattgcagatgtttagagtatggtagctgttgggagatgtgcaaatttagaaacagttactccgagatcagatacttgtttattaagatttgcagaattaaaatggagaacttccatgaatatgatagaaaacatcactccttcagtagagttgttaggaatatttaacctttataaagaaattcagtcataactatgttaaaataaaggagggaaggcaatttaaattcggtttgcaatttgaaatgtcattggcttcctctaatgactcagtaagaatgaattacatttagaatatctatccttggatatcagtaggtgcttccagtgggtgtttccgaagtaggtttaacactcccttcgaaatatcttttagcaatatgcttagcagatgtgcttatttttgttacaacagagactctatacccagtccttttcttctctctttttcaaatggcctaaagtctctaggctgtcagtatcagcctgactcttacctgtttatttgatcgttcctgaatttggttttcagaatatctgctacgtccaacctgggctcggtcaggctagaccacgtgaggggtttgctatggaagaatactatgtgttacctaaagtacctgcatttaagccccagatgcaggcacctcagttctgccagttgacacttggaggcgaatgggatggtgatgagccaagtagtagtcactccactgattttagggtggaagattctactggcatcccaggccccagagcataaatgaataacagagtcaaggatgccagcatgagtacccctctaccatataagctttacagtgtctcatgccttcatggtgtgggaccccttaaagcccgtatgaatggctgtttatctgttaagatctttctaaagagccttattgaggtataatttatatactataaagatcactcatgttaaatgtacaatttaggcctggcgtggtggctcacacctgtaatcctagcactttgggaggccgagatgggcagatcatgaggtcaggagatcaagaccatcctggctaacacggtgaaaccccatccctactaaaaatacaaaaaattagccgggtgtggtggcgggcccctctagtcccagctacttgggaggctgaggcaggagaatggcgtgaacctgggaggcggaggttgcagtgagccaaagatcacgccactgcactctagcctgggcgacagagtgagactccttctcaaaaaaaaaaaaaaaaagaaagaaagaaaagtacaatttaattatttttagaaaaatttacagagttgcataatcatactaaaatccagcgttggaatttgtctgtcaccccgcgaggatctcctgtgcccatttgtagttagttcttatttccacccccagccccaggcaactgtggatctactttctgtctggatcaatttgcctgttctagacatttcatatgaatgaaatcattcagtgtattgtttttcacagctggcttcttttacttttgttgtatttgaggtgcatcctttttattgtagaattagtgtcccatccaatgtatataccacattttgctttgttcattcactggttgataggcatgtggatcatttccacttcaggctattatgaataatggtgctatcgagtctttgtagacaagtctgtgtggacataccgtttcatctttcttggggagctacctaggagtggaattgctgggtcctacggtaactctatgtttaacattttaagatactgctaaacttcttttttatgtggttgtaccattttacattctcaccagtaagatcttaggggttcttctccttcagccattatgtctgcaagtattggggtacagattacaggggacatcttagatgaggggctggtaagcaaaggcactgagacagggtgtgtgtaacgtatgcttcaggtgcattgaggtgtgttgcagctgaatcttcactggtaatggaaagataggtgagtagaaaaatttggaaagagaaggaatccagaatttagttgtgacagcagtagggagcagtcggtgttttaacaatttttcagtcaacagagtaatgggattctttttactgagtgttacagagactctgcattttgccttttctagttttattatattttccttttcatgacagcctcttactcatttcctttctatttcttttgccctctttttatttactcctatgtgttttaattctacagcgtatttaattacaaagagagaaaaggtgattttgcaggaatggaagggaagggaagaggttcctctctttttcagcagtacctgaacctgacgcttaactggtaccttctttaagccaggcactgtgccagggctaagcacatacttgatattatttaatccttgtgagatacatgtgatgagtcccacttcacacatgaagaaatcaaaccatacaaaggcaaagtgacttctgtgacatcatattgctagtaaatgccacatctgctagactccagaatccatgctctttgtgtaaacctgtgcatggcctcttcagggagcacggttctgtcactagaaaccatcccaacatagcttcacttaaatggaagctaatggtgattgctgaaggatagcagccttggtagtttctctttgaagtcctgtcattatgagatgctctggtgtgtttacatgggagctaaggtgtattttcatatatatgttctgtatattattatgttctgattttttttaaaaagcctttcttgctgggaaaagactggcctttctgggtctagccaattcttagagtaggaacatgattctgtctaacagaggatagtccaggagcctgcttttcatatgcaaaccaaccagtccagaaccagacctcctctatgtggtccaggcaccccaggatacagtgttcctctgccctaatcattccctggaatggtaccagacaactagggaccacctctgaagcttagagccagctggagttattcgaactagtcaatccttaattggtcattctgtttcccctgccctgcccatggaaagcccaggaaaggctctggtctaagctggcctcttgtcttctgcctcctgaccaccctagtatctttccatgtggcccttgatggcctgccatgcttcctgtcttggggacctttgagtgtaataaatttttttcctgaacttctcctgtgctctgtggccgcacctgactgaccatcacataaaagaatacaaaacgtaaggtgaataaactattaccaggaaattcaggttggagtctaagtcttaactagacaagttagtgagatcctgcaactaccattaggagaaagcagtgttgtttttatattatgattatgaaggtataacattctagacagttgggaatatataatttttaattcagtcctaaatgcatcatgaatataacctaatgtgatacatatttatgtagttttgatcaaggaatacgtgaaatctgacactccacttttataccttatgaaatatcatgttagctatatgtcagtatacttcaaattatctgtttttttttttttgagacagtgttgctctgctgcccaggctgaagtgcagtggtgtgatttacacacatggttatgtgtgtaaataaccatgttgctttctaaaatagttgtagcagttactctctcaggccatgcatgaatagaccaggcatcttcatcagccttgactggtgcaatttaaaacaaaacaaaaaacaatcttctattgtcacttgttatttgagttcttctacatctgcttttattttttcttcctactcaaaagtcttcgattcttcctcattctctgtagaaacaatgattactattaaggttgaaataccatatttcttcaattctgagacatggacttgttcccatttcaacagttctaaaattggaatgcttctgtcagttgatatccaaagcactttgccacattttctttatatccagtctattattgaatactatgcagccataaaaaggaatgagatcatgtcctttgcagggacatggatgaagctggaagccatcatcgttagcaaactaacacaggaacagaaaaccaaacaccacgtgttttcactcataagtgggagttgaacaatgagaacacagggacacagggaggggaacatcacataccagggcctgttgcggggtggggggcgaggggagggaacttagaggacaggtcaataggtgccacagaccaccatggcacacgtatacctatataacaaaccagcacgttctgcacatgtatcccagaaattgaagcaaaattaaacaaaaaagcatcttctccacccctaggcagaggagtaggttgtgactggttattatcacctgaccctggccagcatagaagacatcttgccattccctggacaccttagttgagttatttgcactttatagtaccatagcagttgaattttagcttaaatttaaatccctaattaaaccatctcggaaaattacgcattgatgtggcattgaaattgttattatggttcaagaggagttttggaaccagattttttataaatgaggcaagtacttgtactggcagctagtcatacttcttttttccttacaaaacatgatcaggtgctgtgtaggctctaggaaagagggatgtccacccacaaatggatgaagctgtgcttcattgcagcattgagattcaggcagatggattgccagtgacgtggcagacagtgcaattaatgtaacaaaatgtcaacagccttgggaattgatcatagattgaattcccagagctagaagacatgagtatgattcagtcatgcatcccgaaggacaaaaacccaagtgtagctcacagctgactgtcaaaagcagttaatttctagctatatgaagtttacagaaggaaataaaattacagatttaaccaaataagacatgcaattgagactaatacctttggaggggcctcagaattctatttcctgtcctaataatgttcaagggtgtcaagattggaaacactgctctaaagaaagctgtatgcttttaacattctattcataaacattataacccaaaactattcataataataattagtacagtaaaggcttagtcttaaactttgattggaataataaagaagaaagcaatatgaaagtgaaatcttacggatttgtatcatgttgccaggttataacaaatttttaaatatacatttaatatttctgctttcactctaatcattatcaaattagtcatatcttagaaaccaggatatatgatgttatcctatacttatttaaaattgttttgtattttaaaattcttgggattatgatcattcagtgtaaacaatactgtctacatagttacttaatttgctttttttttttttttttgagatggagtctcgctctgtctcacaggctggagtgcagtggcacagtctcggctcactgcaacctctgcctgtcgggttcaagcgattctcctgcctcagcctcccgagtagctgggattacaggcacctgccactgtgcccagctaatttttgtatttttggtagagatggggtttcgccatgttggccaggctggtcttgaactcctgacctcaggtgatccacccgccttggcctcccaaagtgctgggattacaggcgtgagccaccatgcctggccaatttactttcttaacctattatttttaaaggaagaaaaagcaagcctacttttactaaccatagcagatgtgagaagattttataaaacaaaaaaaggggaagcaagttacctggaaagaggacagccattagaagatgcttttgtcttggtagaaatgaaatcacatttgttcaacaaaatgacagtcactctacataaaactgggttttatttaaagagaagaaactgggcgcacaataacccagcagaacagaccccacccccattggagtctcagcttgtttctaattgtattctgcatgatttagattggaattgtagacctgagtctgtcatttggaaccaaacgtcctgttgctattcatggaagagggagttaacaatacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtcttttttttttttttttaattatctcttgataggccctgctattgtaagcacaggaagagagaaatcaatacatttgtatatctgcccattttggtttgttttcgtaagaaaaatatctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgaggaatcatccgcaagcaattcgtaggaggaaaaggagacctcaagagactcacttgaaagcttttctgggccatctcgttgctagaaagtcattcaacaaacatttgccaatgtcgtctttgcttctggaaaactgggaagcagatgtgattgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcggaagggctcacaaagacatggcatttaaacagaatcttgatagaatttggtcagtgcaaggggagtgagaaggagttttcagggcagtggatactcatgtacagacaaggagtcctgggaggtggcgagaggtccccatggccactggggcttaccgaactcagagaatagggagagatgtgggtggaaaccctggtcacaggggcattcacttcaaaagaccatacctgaatcctctgaaagcctaaaacgtagtaggaatgaaatcatggatttcacaggataggatagcttggaaaatgagcacaagagcttacattgcttttcctcccatcctcttctatcaaaccacagatacttctcttttttttaaacctttgactctgaagtcttcagggcttccgggcagaatctcttgcattgggagttgccttgacctggaggaattcattccaacagctattcctaaaagactttctgtcctgggtcctttgtctctgtgattgctaagaaagcccaggtcaggggtctgtcccttccttctggggccatttaattccactcccttctgtggctacagactgagatgctaagccacgatcccacctgagctgctgccacaattagcttgattcatgctgtcacctttaccatttcacctcaagaaaaacctgagaaggaaagaattgatgtgccatagtcggggtggctgcatattttcagacccagttttgcaaggcgtagttggattaactggacacttcagggatctcagtcagttgcttaaaactgaacctaggcccttggtggtgtgagagaccccctctccatgtgcaggtaaagatccacggtacctcctaccccccagtccaccccatgttaatttactttttaaattaaaaaagtgatgcaggtttgttatgaatagtttgagcagttgaaaagaatatagaataaaaagtgagatcctccttgcacacatacatgcctgtggtcagccagatcccaaaatttggaatgtatccttttagacttatacgtatgtatctacaaccattatacgtatacatatacatcacttgtttttactaaaaagggattatgctccaagtgtttcctgcaacttcattttccctacctaaagtgtcttggacatatgatgccttttacagcaatgagaatttgagggtaagtctcagtttttattctctgtggtaaaggtttcttgataagtagagttgtcagatttatcaggttgcccagttaaatttgcatttcaaataaacagtgaatacttttttggtgtacatgtcctatacagtatttggtatatatgttcatatgtactgaaaaagtatttgctgttcatttgagatgtgagttaactgggttccccgttttatctggcagctctgcacttgttagttcacttacgtatcattggcttggggttgttattgttgttctatgaaaaacttttcatgcacaaaaccttgaaaccataaaaaggtcctgtttcctgggaaaggtggtgtctgggccagtgttcacacacctgatgaatgagaaaggtttggggccagctcagctgggcacccagaattcattacttgcctctattggaaagaactggcccgtgtagctgctttgtagttggagctgagacctgactctttcatcctagccactatgtgaagttgccactagtggtcacctgaagttgtgtgggtgatattaattgaatttttgaaaaactaaatgctggtatttgtaggaatttgcagtgcagacgggcagcctttcaaccagtgcatagcataattagagcaagcttttaagattctttgaagtgccaaatgtttatgaaattcaaataggggtgccaatctgcacaataaaggggcccttggtggtgtttttaaaaatcttctattttgtagatgtaaatatatgccataattagcgggaagtaacttgaagagccacggctgagtttattcctattattcttatttaaaacagctgtggcaggcaggctacagctgctgtctcatcattgggttgggcagggcataagggccgaagtgaacacactcaaagactcttttctgagggcagctcgttcactccccctacatgctggcttccttgctggggagctgtctcacggttggcccagcttccccacccaccccaagcctctgaatgtcaatgggactggcttcaagggtcttagccagaaggcacttgcctgcaaatgagagggcgaggagccttttagagcagccagctttctccagacctcccccttctctctgcccatggcagtgctgcctctaggggcactgttgccccacagccccaggcccagtgcagagcgattgtcctttggtgcctgtgggagcagctgcaatgccgcactgcgtgccctgcctggccgagccttaccatgtggcaggcctggacggctgcccgccacagggcccagctcccagcaccgcctgccaaggagccagatgctaccattggaaaaaattgcttcacaatttgaaatcttggttctttgatcattgctcggagaggatgaagaagagaggttcaaagtagtgttttaaaatgccagcgtctcgttgcagccatcagtgcctattagactgtctctggttggggacagtcctcttgatgttttcatttttgcaaccaggtcattctccccagctcttccaagccctctggataggaagggaaggtccacagcctgctcctgaccctgtgcccctgctgtccccctgcctcgcgccttagaggttatctgcttgcctttgttccagcaggcttttccccaataaagcttgtaacaaagttgttgtcatccgccaaatgctgccaccgcgtgagctgctcactcccattcttcactgggcaggagtagccttcacttcctgatccttctgcccccacagccaggtctccagaggacggaggttttgcagggatgatccactctgtcccctggcctagcacccgcctccaaggacttcagatcccacatacttgggtgaggcttcattcttccttacccttgaaatgggaagggtcagtctttggagagtgttgcatttttcatatttactgccaaaaggcaaaaacatgaaatttaaaccaaacagatccaggatggctgggcatggtggcccacgcgtataatcccagcactttgggaggccgaggcaggtggatcacttgatgtcaggagttcaagaccaacctggccaacatagtgaaaccccatctctactaaaaaatacaaaaattagtgtggtggcgcacatctgtaatcccagctacttgggaggctgaggcagtagaatctcttgaacccagaaggtcgaggttgcagtgagccaacattgtgccactgcactccagcctgggcagcagagtgagactctgtctcagaaaaaagaacagatccatgaataaatgggcttactgagtaagaggtaatagaggagaaacgaatccagactcttatctggggactaaactgtttcagttgtggaagtaatgagtataagagaaggatgatttgggaaagaatttggaaacttttgatggggtgtatttttgttttctgttgctgtccgcttcctctgcccatcattgaaaccggcttctgcttcgactttttgttgtttttcaggacttgcccacaaatagaccctaaagtctttaattcactcaacacacgtgttaatgatggccttttttttagtcccagaaagaattctataacatgtctaatcatgccttttgagaaatttatacctgtttgagctgttatactcaatacgtaagacccgtcataaacacaaatcagaaaaagtcctaatttttctgtttggaaaaagccagtgttgcatctgtgccacacacccgacaaacgtgggttggggccaagactggctccatggtgacagtctttatcgtgtttattgattacagactcttgtctcgttgaggaaaggtgtcagtgtctctagatgtgatttgaggctctgtcttcatctctattgtggtcaatatttcaaattgacaagtgaacaggagtgatgataggtattgttaatgactgtgaattttatagtacattatagattacaggtgaattttatatgcattatctcctcatattaccaccgtggcctttggaaacacatcatcttccctgtggataaagatgagaaaagcgagacccaaaaagtgattccaaatctctcacttctgctgcctgtgctgtcagtccagtgtctgagatgagatgacaaatgagaagcagcattcacagacgcctggaccagtgtcggactggatgggatgagtggaggactgaactttgtagagtttaacaaaagtaaatgtaaaacttgaatcttgggaagcaaacagaacctgaagaactatgtgggtgaggaggaggagaggaatggtgaagttaaggaggaaaggagagaaaactgcagaattgtgttacagaagtgttcttcggtctgtggtacccgaagttctggatggaagttacagaggagctcatttcaacttaacagatgtaataggcagcatcatggatccccagacatgcctcctctgtagccatggaatctgtggataatggtacattacatggcaaaggggaattaaaagttgttaatcagcagatagaatatcttggattatctaagtgggcctagcatggtcccaaggtcccttaaagcagaagagggagacaaaaaaagacatccagagagacgacagctggcaatgtgagaaggattcggctggtgtttctggctttgaaaatggagcaaggggctccgggacaaggaatgtgggtggtctcagaagctggaagaggcaaggaaacagaaccctcttcagagcctctgtctagtaaggagttgcgtcccttctagttccttgatcttagccagcctggagctgaattaaatttctgacctacaggaatataaaataattagtttgtcttgttttaaggcactaaatgtgtgataatttgtagcagagaaaattaatataacagaaaaaagcattaacagttaaggctgtctggcaatattattattatttataaatagagatggggtcttgctgtgttgcccaggctggtctcaaactcctgggcgtaagtggccagcgtgcctggcccagcagcattattgaagtgattttcctgtgtctgaaagtatttagctttaaggcagtgcaggtcaggatgctgtggaaaggatttctgcttttggaggtaggagagagttgacctctgaactaagtttcagcttagcgtttagggtctctgtttctagagcaaacagggagaagatttcttagaaggactcatttccctggacttaccttccccagccatatttctaagtgttgttttttaacactgcagaacctggcctatgaccagcctttttggctagcttgtgcccagaagatgggatatggtttgactttggaatttattggaaagataagttttactagttttcaactgtttcttggatttttgtttttatttacttttagaaaatatcctgtggttaggtaaaagctgattaggcagaaatagtttgtatctctgatagtggtacatttttaaaaactcattttcttgccttcagaactacatgaaataggtttgctttccacctggagtgattttcagttgggaggggggacgtgtcagtagggtagataatgaactctgcaaatcccagacttctttgttgttgacttaatgctagcattctttctttgatattaccttcacttcatgggagttcagtgactgcatttctttctggaatagccataacactatcagctgacagataattatatatatataaaattatatatatcttgataattatatatatatcttgataattatattttacatcaatacttcctcctagaaaattcctgaagagcatctgtgatatggttggatagctacataattattttccatgttcaagggtaattacaaagcagttgtaatggcaaattggttatttactgttagttgggaagccttttaaaatctaatctcttaaatttacactaataattaaatagagaattttctcagactgtttctccctacctcttatctaaatgaaggataaaatgcacgtagactctatgaccgagtaattacactcctaggaacgtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatggttgagtctcacaaataaaatgctgagtaaacaaaactaaacactgtaaaccctgttgcacttgcttaaagttcagaaaccagacaaaactaatgtgtgatgtttcaggatcatggttacgctggcaaggtgtatagatgattgtgcctggaaggaaggatatttgggggagagagggacttccatttcttcatctgggtgctggctcacttgatgaaaattaatcaagctgtaaacttccagtttgtgtacttttctgaatgtatattttaattttatgtaaaactgttaactttgacagctttaaaacatgtaatttgttgggatggtttctgagggtaggttgggtattctttaataactttgttttgaataattctatcattgtaactacagatcatccattccaaatggaagctatattaaagttgtttggggagttctaagagataatggtaaaccaatggtgaggtggtaggaatggtctgccgcagctgcaagcagtaaggactttgcttggctgtagggaatttacaaacaatggcaaaaccatctaaaaaatcaattttctttttattatcaccatattaactgacaaaacctcctttgttggcctgagtcctaaataattggtgaagttagtgttgaatttttttaattactttttttttgagacagcatctagttctgttacccaggctggagtgcagtggtacaaatcatggctcattgcagcctcaaactcctgggctctaggaagcttcctattttagcctcccaggtagctgggactacaggcacatgccaccatgtccggctaattaaaaaaaaaaaattatttgtagagatggcatctccctatgttgcccaggctggtctcgaactcctgggctcaagcaatcctcctgcctcaacctctgaaagtgctgggattataggtgtgagctgaatttttattttttatatatgtatgtatacaacatatgttgaatttttattttatatatagaacatctatatgcttcaaattagcaagcacattatccattatattacttctccttcagtaacacatgtggactcagcctagtactcatttcaggtgcagtctgagtccacagtccccatggtgctccttgttccagtggttaaacagatttgtcaatgagcaacaatagtagaatgattatgaagatgaggaaacagaactttttttccattccttcattctctgtttctgctttgggaatttttacgtttacaattttaaataactgaagtagagtgctggttattgttgaaagtcattttgtcaaataaaggaaggcggtcttaaaaatgcgtcagatctgctaggtgtgccactgctgtgggacagctgctttcaccagcgttacttaagcatggaacctcgtacagacagaaccgtaacagttgtgaacatattcagcaattttactaacatcatgatgaataataccattctaaacttagttaacattttaaaattatatatattgacagattattttttctgttttaaggttgacagtttttaaaaacaatctatttactctcccagtgacccacctgcccccatacacaattgcttatttcactgtgttcccttccatagtccagtctgtacaccaaaatcactagactgctttcccccatgcttagaaatagggtcttgctacgttgcctaggctggtctcaaactcctgggcttaagcgagcctcctgcctcagcctcctgagtaattgggactacaggtattctaccacacccagcttgctagactgcatttgattatttactagtctttcagaacaacttgattaatcaaaatcaactagtacaatgttagcttacagtgtattcatagcacatggagactctttttcaaagctaggaatttaaagttgaaagaaagaaaaataatttctaatgcaccttttctgctcaacacaaacttattgcagcatcattgggaagcatcatagatattcatcagtagagcgtgtattaaattatggtgtatctgtgccatagaatagtgtgcagccactagaaagtgtggctgttcattatttcaaatggctgtactttatagtactgaaattccatgttagtactatatgagttctaagtggcataggtatatatatatgtttaacgcaaggttttagaaaagttaatataatgtgctactgtttgtgtgataaaggaggaatgtatatgcttgaatacctaagtgctgaatatctctgaaaggacacttgagaaatggataacattggttacctttagggaggttggcaaattttggggttcatgcccattttacagttttatttttcccccgtctttaccacatgcatgttttcacttttttaaaaaatgttgggctgcgccaggcatggtggcttaggcctgtaatcccagcactttgggaggccgaggtgggcggatcacctgaggatgggagttcgagaccagcctgaccaacgtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaatctggaacgttttggcacaggctacatcataataataacagcattaatcctgccaccataaagcacctgaactgcttttcacagcgaagtattctaaggtgtcagcaaagcgaggcagtggcagttcttgaaggtaacactgccatgttgaaagctcgatgggaattccagtgttcagagcccctgtgtgcctgaggtgtatggtagcccctctgccctggagactggagctcagttagacccaggggcctcttcagccttgggagttcagatgctgatctcatttagggaaagacatgcatgatttcctgctgagctgctcttttgtggagccaaatgttaaacctttgaatgtgagaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctagacgacagggccagaccctgtctcaaaaaaaaaaaaaaaaaaaaaaaaaagtgccaaaccgcacaaaatataaaatctcatttgagtgtcagatccacgtacctctgcttcaacaaccaccacggcagtccacatttatcatctctcgcttggactgctataatggcctcctagtatatatatatatacatactttctgctctcttccggagtcttctccgagccatggtcagaggtgccttttggaaggcagagctggttgtgccctgtcactgttccaggcctgtctgctcactgtgtcctttggtctcaggatatttcacctctccagctctcctgccatcctctctctcttgctttctctttagcgcttctttctggctctgtgccctcttctctcttatggaatgcttctcttgcctaagcctcgtcttctttcttgggatctgagttgcatcatcattagaagtgtccctgaccctgggggcccactcctcaccgtttgtgctcgtgtccccccgtacctctctccctggtgcttagttccgtgtggtatgttcctcacttaattgtaagcctcacgagagcaggccctggctcagcttttgctttttttatccgcagctctgagcattgtgccggatgcggagcagggggttggtagatacttgagggaaggcagctattactctgtggctgtctttggtctgttttgtgctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtacttattttctatctgaatgatagttattttatgtatcttccatatcagttgtaggcaaaacccgtacattgtctagcatgaacctttcatagtaggtgcttaataaaaatgtgttaaatgaatggcaacttaagtcattatttaacatctttgtaagccagtctttaataggaaccatttcccctccagatattctaatttttaagaaagtttctgtttgtacatatatgacaaatggctagtcagctgcagtctcttgttttttttaaaaaatatctctaaagatgagtgaacatgaatccaattaatatcctgctttctgtgcatatttcaaagaccttgtggatcttttattgcaagggtatagtagtattctgatactgaatgcaagaaagtaaaacaaaattgatacttgtagcatgtcatttcaagagaggactgcccaaattagcaaactctttaaaaaacgacagatgggtattgaacttgtttctagatgagcatcaccttcccaagccagccctcttcattcagccaagcagaggtcttaccctgaaagttactgctcggtgccatgactcctgggatgagagaataacccacacctccatttcctttccaacaggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagaggtaagttggcctctgtatactggaaacttcattcaagggcagactgttgccttcctttaaaccttccttggggcagagagttgtatttttggatgtctgcttcttaccttctgtattagtccattctcacactgctatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagttgagatttgggtggggatacaaccaaaccatatcaccctccttctttctcccacttctttttcctgttaacttctaaaaagccaaagtgatttggaagcacctgaaaggaagcaaataggatgtcccgtgccagtcctctgactgtgtctgaagtcagctgtgccctgctcagccagtgctgtgcacctttgcttgaggccttgtggggtagtgtggtatgaaagctgggtcgagataggccctgccactcagaatgatgccctccctacacccaacccctaggtccaagggcactcccaggcattgtagatagacgtcaaggtggtactcagctgattggcacctgccctctgaaaccatgataccttgagtttgatattgttgcttttgccatttccactgccttcgcttttaattgttttagatagagtttattatatattaggatccaatctctttttacggcttttatgtttcataccttcctccctttaaaaagatgtatatttgtttgatcagggtgagttgctttgttgaataatgtttgttgttggcattccttaaaggttgtattttttagtgtcttctatccatcacccaattaattgatccatgttcagtgagcagtttttatttgcagtggccccagacctttcaggttcaagagcccaccttagctgtacaaagactttgtgctgaggagggagagagggagaaggatatatttcttaagaccctgggctaagcaatgaggatttgggatgctgcaggccctcgtagcacaagccccctgagcaatggacaggccttatgagaatgttgttgaggaaaggttatgctggcagaagaggatccaggggagttgactcagatggacaatttaagcttaggggtcatgagctttcccacaatggtggcagtgggaatcctgtaagatgttttgaatggaacttagaaactaactggatattaatgaggaggaagagtcaaaagtcacactcacattttatgcttggaaggatggtactgccactaatagagataaggaaataaggtgttcaagaggaaataggcaatgattatagatgcaagactagaacttggatgacaggtaaagactggaaatataaattgggaatcctgagcattaaggattgggaatggagacctagctgcagagagggaatagaaagggcacaggaataaggattaaatttggggagcagccactagccctaggataagtagagggagacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgtgtgattgggagtgtggaagatgagtgttaggcaatgttagtgaatagctaagttgtcagggatgttctctgtagttgaaattccctgcctggacaggtgcatttgagaaaagatgaaccagacagcttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgtttagaatgtgtgtctgcatttggtgtgaagtagtagtccacttatattttcttccagataggcgtttgtatcaaaaccacttatgaaatgattcattctttcccagttaaacagatctgtcccctttaaattaccatatattctgagagctgttcctggagtcccactgttctattccacccactatttgtgtctacgtatcccagtaccatgtggatttgattacagtggctttatagtatatactgatatttgatgaggcgagtcaggctcactattctttttcatatattttctaagctagtaaccaacatttattcttccaaataattcaatcacttaaacatataaagaaaaacaaaaaccttgtttgagcaatctaattgtaattgcatcaaacttagatgttcttttggaaaaattttatattaaatatttctaatcaagaatgtatttgcattctcatttcattttatgtatttcaataagattttatcattttcattatacaggtttgtctctttcttgttaaatatatttctaaatattatataatatgttgtaatttcctgtttctagattcgaattaatagagaaaagctcttgattttgcatatctgtcttcaatatggccatcttagcaaattctcatacttaactttagtttttcccccagattcctggggtacccttgtatagttaactgatgttagttgaaaaagttttggtgttttgccctttaggattatatttactgtaggcttttattaatggtctttattactaatttaagtgttttctttctattcctattttacttaggatttttattagttacagctgcaatacgttatcaaatgcttttcagcaactgttgctatatgatttttcttccaagttgttgacataacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttcctttttttttttttttgagatggggtctcactctgtcacccacactggaatgcagtggcatgatcttggctcactgcagcctcagcctcactgggctcaagcaatcctcccacctcagcctcctgagtatctgggactacaggcctgtgccaccatgcctggctaattttttgtattgttttgtagaaatgtggtttcgctggtctgaaactcctgggctcaagcgatctgcctacctcagcctaccaaagtgctaggattaaaggtgtgagctgtcacacccaactatatacctttttcaataacctgtttgccaaatttcagtcttgaatgtacactagtttcataaaaagaataacactggaaataactattctttaaagattacataaaacttactcctgtgaaactatttggtctttatatgttttttagcatgtacttttaattaattatttttaattgatagataaaaattttatacatttatggtgtataacatgatgttgtgaaatatgcatacacagtagaatggctgaatcgagctaattaacatgtattacctcacatagcttaccaatttttgtggtgagaacacttaaatattctcttagcagttttcgaggatacagcgccttggtattaactgtagtcaccatgttgtacagtagatctcttgagcttacttctcctaactgagattttatatcacttgtggcctccacctttttcagtggtaaatagctaaacttgttagttgtggtcatttccacaatgactgatctatttgttgacattttccccttctttttgactcagtgttagcaagttgtatttttctgggaaagcatctctatctgctgtgttttctttgctttgccgtgtgtgtgtgtgtgtgtgtgtgtgtgtgtgtgtgtgtctgctttagggttatgtgaaataatctcttatgtatcttctaatttgtactgtaattgtggttttgccacttttcttttttctcctttttacttgtatgaagagtttattttgtctgtctaaaggaccagtttttaattctgtctgcattttaaatttctatttcattgatttgagcttttatctttattaattcccttttcctggcttcctttgatttctttgtggtttgggtttttttttttaaggatgtgtgttttattctgtaaatttttacctttaatgatgaagacatatgaggctacttcattaagtttccttcaagtgcagcttcatcatggctgatacgttttgatgtaaaatatctcccttttcattgctctttagtttataattttcttaattccttttgatccaaggttatctaggaagccttgtttcttatttctgagttattgaaactgcatatatactagtattttcttagtttcttcctttcataaacaggtgacattcaggggctcatgatccgtgagaaataatcagttttttctaaagtagagagattagctatattggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcatgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacagaagtgaggaaggtgggcctgggaggcgctgggcctgcgccgagggaactgaccaggttgttggattgggttcctagtggtcagtcagcagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttcaacattagccaagttttagtctcagcagcaacatggtatgcaaatcaggcaaaagctgagttggtatgtttgtacttcagacataccttgacatgttccatgatggacttccaaggccttctaagaagttacatgcattaaggcaggaaaatataagctctcagtaccagaagaaatataaattagaatagaatgcatggaatgcagtgaccaggaggaggaaaatgttcttcataggctaaaaaatctggctaggctgagtacagtggcttatgcctctaatctcaacactttgggaggccaaggtgggaggatcccctgagcccaggagttcaagaccagcctgggtgacatagtgacaccctatctcaaaacaaacagacaaaacaaacttaatgggcagctaaaggaaagggaaaatagtgttcaaggtccatgatgggaaaactcaccagtgcccctggatggttctatgtgggttttcccctaatacttaactttaaaacaaatttcttctgggagctttatttggggacttcagaagttgttaggaacaatgtcatcctcaaaatagaaaatactcagtaatgggtttcataaggctcatttaaaaaagtaacattacttgattaaagggaaaatgccaaaacaaaacttgagggaaacaatcttagcaaaagaggggcaacaaggctatactgtggccaaatactcctctgaaagcctactttattcctttttgttactaggattaagaatccatacagcaggaattctttacttggtgtttttggttccattgggacagtggctttcaatcagcagtgttctgtttttttgttttgttttgttttgtttttgttttttagaaaggctgtttcccagtttcccaaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttattttttaagctctgcatgtagttgaagtgtgcaaccaggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtgaaaatagagcaattcaaggtttgcaggactggcatatagcaggtgcttgacatataggtgcttcctgttgctatctaagaatagatgcatcactttagcagtcagacgagtagaaggtaagtgtgacatctactgaggatcttaagtggcctcaggaattaaccaaaactctgaatgaatggcttccctgcctctcttgggggggagtcttagctgtttattaaaaatcaattctgattctgtttctgcatgctaaggatgcatgttctcagtccgtaaaactctacctcagagagcacagctaagataaatgtggcctggaaaagtgttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcgtcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacactctatgctgttggttcgcatgacaaaaccacctgattacacattaggaggtgtcctcattgttaagcaactcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatcatctaattgatgaacaggagaaattgtacctcatataaaatgacatagtatttgcagataacttatacaaatcatctcttatactttaaatcatctctagattacttataataccaaatacaatgtaaatgctatgtaaatagttgttatactatatttctaaaatttttattatttttattatgtcttttttcgtccccaaatattttccaatctgatattgattggatctgccagtgtggaatcgcagattgggagggccaactgtattcttatttaatagaaagcttgcaagaagtttgaataggttgtagaggtgccaggtgctgtgctagaccctttgtaaatgttatgtaattctcactttcagactatgaggtcatttttctcattttatggataaagaatgtcaggccaccccgaggtcacagagccagtgatggaaataaatttgagataccatctcacaccagttagaatggcgatcattaaaaagtcaggaaacaacaggtcctggagaggatgtggagaaataggaacacttttacactgttgttgggactataaactagttccaaccattgtggaagtcagtgtggcgattcctcagggatctagaactagaaatacaatttgacccagccatcccattactgggtatatacccaaaggattataaatcatgctgctataaagacacatgcacacgtatgtttattagagcactattcacactagcaaagacttggaaccaacccaaatgtccaacagtgatagactggattaagaaaatgtggcacatatacatcatggaatactatgcagccataaaaaatgatgagttcatgtcctttgtagggacgtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagagggggaagggatagcattaggagataatacctaatgttaaatgatgagttaatgggtgcagcacaccaacatggcacatgtatacatatgtaacaaacctgcacgttgtgcacatgtaccctaaaacttaaagtataataaaaaataaataaataaataaagctaaacttaaaaaaaaaaaagaatggatagaaaagaccttgcaaggtatcttatggtcatgaaatcaaaagacttgagtttaagactttatggccttggtcacttagtcttcagacatcagtttcaccttgatttataaacagaatgctcaagtctgcactttctacctcagaggttatcattgaaatattttaattcagctaagctgtgagagatggtactgccttctgggatacaatgcaaataaaacccagcacttgtcacgtagtaattcatggtccttcaggatgaaagaggcaggtaaataaaccattgcaagcaaatgatggctgtagtgtactcgtgaaacaggtacctctgaaatgcagagtgatgaggtagggattctcagggatgttgcctcgatggataaggagacatctttctgattactaagaataggggtatcccatgggtacatacttaggtaccaggggctggggtgctatggtgaattaggcaggtgggccgccatcctgggttctgatgcaggaggcaggcatgcatcaagtcatcacaaaataaatgaaaactgtagctcttgctacctggcagagggacgcagggcattcgtagaacaggggaatttgacctagttcaggcggaagctgaggaaggcttcctgaggaagaaacagttgagagctctctgcgtggtgaatatgcaaccatgaccaaacgaacctctcagctccttccctgtcaaagagcacccactcctagaggtcgtatgatatcatatgagacaatctgtgtaaagcatttgatactgagtagatggatagtaaacactcaatatttgttggctattctgatgtgaattttcattcattcagcaattatttatttatttatttatttatttatttatttttgaggtagagtcttgctctgttgcccaggctaaagtgcagtggtgcaatcttggctcgctgcaacctctgcctcccgggctcaagtgattctcctgcctcagcctcctgagtagctgggattacaggctcccgccactgtgcccagctaatttttgtgtttttagtagagacggggtttcacagtgttggccaggcgggtctcgaactcctgaccttgtgatccacctgcattggcctcccgaagtgctgggattacaggcgtgagccaccacgcccggcccagcaaatatttattaaatgacttgtgtgccatgtcctcaagctagttgctgggaaacagggcccctgttccttaggaacttatattccactgggtgagatggatattagaaaaaaaattgtacacgccagtatgtgtttaccaactgtatagcatgctgtgatgggaaaatgagatgtactgcaagactattctttaagtagggactggaagcttggataccttaagagcaagggaaactaaacaggggaaacagcctgatacttagagggaaattaggcctataacaaactggaagaggctctcaagttcaaaatgttttcattcaaacaatgctttggcgtaatcaaacacaaaagtaacagagtcactgacgcgtttcatgtttttgcttgattagatttgctcttagaaagttccttctgagaatagcatggggaattgagaccagagtgaggacagaaaggagtcagggtctgtgtggtgtggagggagctgcaatgatttgggctggagaactcaaaatacgagggataattagagggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctattgtgaaacaagatttagcagaagtttaagactaggatgggaaaaagagtggattttaaatgttctcatcacaaagaagtacgtgaagtgcttggtatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaaggtatttcttacttatgataaccacgtttagatgggcttcaggtcatagttgtagtgttctgaatctgtgttagaggacacagagtgaggctgagcaaatctctcttggacttaagacttgttcttctccaattaagtcatagtcgtcatacacagatggaatatgttttcatccttttggtattatatactttttttttatcttaacaggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtca

SEQ ID NO: 34800 - DNA, 33170 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccaggtaaccgcccgggctccggccccggcccggctcggggcccgcggggcctctccgctgccagcgactgctgtccccaaatcaaagcccgccccaagtggccccggggcttgatttttgcttttaaaaggaggcatacaaagatggaagcgagttactgagggagggataggaaggggggtggaggagggacttgtctttgccgagtgtgctcttctgcaaaagtagcaaaatgttccactcctaagagtggacttccagtccggccctgagctgggagtagggggcgggagtctgctgctgctgtctgctaaagccactcgcgaccgcgaaaaatgcaggaggtggggacgcactttgcatccagacctcctctgcatcgcagttcacgacatccacgcttgggaaagtccgtacccgcgcctggagcgcttaaagacaccctgccgcgggtcgggcgaggtgcagcagaagtttcccgcggttgcaaagtgcagatggctggaccgcaacaaagtctagagatggggttcgtttctcagaaagacgcggagtacgaaagaatgcggccgacagagctgggcagcgcgtaaagctcccagcgtgtgatttgagcttcacttcggaagacctaataattagcgattctcactgagctagaacgcgggctccggttactgcgggcgctgcgctggctgcctcggcgggaagcgcgcgggcgccatgggagccgggccgccaagcccgggaaagagaagcgcccaccaccctgcggcccttggagggccagagccggggcccggaagtgtccccttagtgagtcagggaagggacgacccaaacttagactaacttgtggttcagccgggcgaaagtcctgggagcccggccctaaaagcagctggagacgcccaggccggcttaggcggggcacccaagaaccccgcccgggagtttggggcggcctctgggccaggccccggctagcccccaacccccactcccactcgcgctcctgcgccccctttctaggtcttctgggagcaccttcggagctcagtcacctgtgacaggtgttgggacctccgcccgactccgagcggtggcgccccctgctcacctcacctggaaacgggggacgagcgcagtggcagtccggccgcacgccttacctgggccgggatcctctcctccgcgggttcctctccctggagctgggcggcgagcaggtcgcctgcttcgcagtgggaagtggaccttctcctccagtcataaatcaaacccagccatcctcgggcctcctccctcattagagatgtttattggagatcgtgtttattcggctgtcacggcgagaaaacgcggtgacataattacctctgaccagagtcctcgctccgcgcccagggcgagccgaggacctcctctgtcgccttctcatgcccgtgcccttcgtgatcggagggcgcccgtgataggcttgtctttttttcctcagaccctctcatagaatttggatgactggaattactattcagatttccccagggcccggagtttatttatttattttagaattggaaaggaaaaccgaagggaacccaacgcccctccggggcagaagggggcagcgcgcgcgaggcggaaggacagtcactctcgctgcacaaactttcccgcgggccgcgccgcgcgtgcaggggctggacgccacccggcgccagagccgggcctgaggagcggggtctggccgggaacgagggctgccagcctgggtggtgtcatttgttgcttcatttttcattccctttcctctcgtgaggaatcagaggcatcgggccgcgcgggctgagaattcttaaattctccccggccgcattcggctgagccaacccgcagttcctgtcagcccctctgtcccccgggcagcggttttccccgctagccaggtttggaagtcaccctctgtgagactgggttaggaagtgacgaaaagcgccgaattgttttcaaattgaaaatacttttttttttttttttggagatagcgctgacaaatatatgggatcccggcttttgatccctggctgccgcctctgttctcctgtcgctaataaaactcgcattgagccccttagtgccttgattaacaggcagattaactcttactggggttgggaacagcttgtcctaatcaatgtcattttaaaagcccgtcaggatgcgcttagcttcggttccctggatgcttgagcgagccagccatgacatttgctccctccccctccccagcctcaaatcccccagtaaagcccccagttcccgcctgcctgttcccaggtctacaacgggacaaatcgcaggaccgggtcgttggcctttagaataggcagcggtttagagaggggatatccagggagaagggactgaggtggccttgacttgcttgcttttcctttgaagctgaactcttgcctcttgggggcagaggttacagggaaaagagagatggggggatcgtcacagggtgatgaaatggaaagcaaacttttctaggaaccctatttgcaaaaatcggagagtgccgctgatttcagttgtcctacatgtcaggagttttaaacctaactcctatctggacaacagcatggagggactgggaggcaaagccttgggagtctgacccgctgggctgctaggaatccctttgctgggagactccactggacaatgttattttaaaggtattttgggggtgggcagggagaagacagagagagaaagagagagagagagagagagagagagagagagagagagacaggctggcctcccagagcgaacggaagaggactgaggactgaacccagggagcccctagcactggccatttggcaggaggcgaggaagggcgagggcaccgcggcttccccccaagccgagcagtggccacagcctgaaggtgccacggggcggctctgggatcttcttggcttttctaggctctgggctcggcgaggctgccgggttagcgggaaccggcaggttgctggagaaaggagagggacaaaggcctggaagtgggggaggcaccagggactgggcggccgggatgggagcctttgcctttagggctcactggacccgtttgccagctccgcggacaagggatcccaccttcccagggtctgcaaaaagagagacgtttggggcactacaaagtgacgcaggtgtctgccaagactttccttctccaaaaaatgccagtcttcaccctttccagcgcgccggcgctgcgcctctgcttgaccggggaaagagagagtttggaggtgtcagaactgtcagaactccggatgggaggctcttggttctgaagctgggagctggaggcacttccccccagaagtgggcacttctttgcctccccgaaggcctgatggggtgggcacaggggaatgccagggatcggtgcgggtgagatgcttgcctcacctcatgttgacgcatcaatactggctagaagctctgggcaggctctggcgagccacggtcccccagcgggactccctccacgcagacagccccgctaccgggtgggacgaccccggcggcccccgcgggaacgcacccgccggcctgagaggtcctccctctggccacagggggcggagggtaggggggaacaggggcctgtggggaggcggggaaaggagacagaacctaaagcgcaatccccgccgcccccccgcgtcttggagggcagcaagtgggcctcgggcgtgttggtagccgcaattaaaatggcgacctgcgagttgtctcggttttgtacacacctctggcaaccgcgcccgcacctcagtctcggcccccacacccctaggccgcttcgcccccagagccggtacttggcagagggagtgaggctccccacgaggtagaacagcacccccaccttccttgagaccagtccagagagaacgaggaaatctcactctcacccctctctccttaaactttgaaaactcggcctcattctggggttgaactcccctccccaaatattgacacatgggaagcagccaagtcctttttgttttttgtttgtgcggaggagtttccaggagtctttcccggagcccccttccccacccaatgacgtcagtggcattcactcctcgctccttgccttttctgattttttgttaaaacttttctccgcagcgagatgggggttggaggggtgggagaaggagctgattcaaagagccagtgccctggggggaaatagcaacaagattacggctgcttctttccgaggcaaagcttaagaaggtgctaatccactcggtcgctaattgagaggttgtaaaaatgatactcgcctccagttcggacagaatcacttcccccccccccgcccccccgcaagtccctcgctcatgcacagcggacttgagtcttgagtccaagcttctttaatgctcgcttggaaagtaaaaggagagagaaagagaaagccgactttcgctggtctgggactcagggccgcggccccacttgccggcatcctccgaaagtcgcgctcctgcgaaatgaaacctcgcccaggaggccgcggacctggacacccggcgccacctccttcacctctgacccaggtttcctcccggcgctgcgagctcccggggaagggttagagccggcagccctccccagcccggggaggggagagggttatgcgaccccacctctggctagggccggggaggcctttgcttcccgggagccctgcccgggctccttggtcgcagggctgctgggtcccaggcaggaacgagagggtgaggcccacatgtggcccggcggcccagggcggcttgcagcgtcctcactgtcccggctgccaggggctgcggcgacgcggccagtcagcagcgagttcaggtcgcgcagattttattgatgagctctgactttcagcactttccctaagtcaagaagagtctagcgtacccttcggctgcttcatttcagcctccctgcctcagctcttcagccctattccccctcgccctgtcctggggtgtgtacagcagcccaggccttccttctccttcccggctccgtggcccgaagccgccgagagagctcgggacagcgcaggaccaggcagccgctcgctctcctgtcaccttaactgcaggctccgaggggcgcctttggagtgtactgaggtgtgtcctaatcgtgcggcattcaacaaatggacttctggtgtgtggtcagaagagaaaagccatttacttactttcctccccggttttctggcaacagctgaaggggagctgcctccgtggactgagcagacccaggagagggagtcgtggtgcggagacacacgcaccacacacagatgaccggtggcacacacgacacacgctgacataccgacatcgccagtgggacacacacacacacacacacacacacacacacacacacagagagagagagagaatccctcccagcattggtcatccgcccccccacccaggcttccactccccctcccctcttatctcccctggcttcccctcctctcgggcgctgcgaaaagcagccgcacttagtcaacaaatggcacgtgggagaagttggtgagtgtttggtgaggactcttcagggcttttcacaagaaccctctgtacacaaagtaagtggcgtgtttactcgggcctctccagccagagctgtgcctctgctccgctgcgcaccgcggcttccgaaaggagaaaggagagaagaaagggcggggagagcggggtggaggatttggacaggccctggaggcttgggctggggaggcctctggcctcgtttagttctcggcccggcaacctcctctcggcctaggcttcgccgcggcctccgcagctggaatggagctgccaggacccagtgacgctcccgcccctttcctcttcttccaaggggccaggtgggctggggtgcggccgccgctgtgctctgtgtcttggggccccggctgggatggggtgggggcgggcgggggcggggcggcaggccacgctgtcctggagttggcaagaaaggacagcacagaaacttgcaccctccgaggactgggagtcccgagtccagcttagggggagtgggggcgcgacccccaacccagaaaccttcacttgaccgctcaagttcgcggcagcagggcgggccgcgccgaatctcggcgtgcgcggagcggggagatgcaggcgagcgccagagcccgggctcgggggccctgcgccggggagaggagccgggacccaccggcggagccgaaaacaagtgtattcatattcaaacaaacggaccaattgcaccaggcggggagagggagcatccaatcggctggcgcgaggccccggcgctgctttgcataaagcaatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggtgtgctggctgcagccacttccctcacccacactctttatctctcactctccagccgctgacagcccattttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaaggtgagtccgcttctttcttctcgctttatttttattgcaatattcagacaggtctcccccttcctccccccttccttcctcccctctcgccggtcccctcccccactgctacgccgggagagttgggccggagaagtttccacgcaggagcccaaactttctacttccagcgaaagcccgcgtcggagggcgactgccggcgagcgggagcggcgcagggctcggggcgggcggccagctcagccccagcgccagcgccagcgccagcgcgggctgagctcgcgggaagaagggagactccaggcgcgacagcagccgcggctcctagccccagcgtcgcccaatgctcccgacccgcgggaaaagacgaagaggctctgtggtgcccaaggccctggaacggccgcagagagcaaccgctgccggctgctttgtccagcccgaggcccagcgaacgcgcagagagcgggcgctccgaggactcgccgagggagcgccgagggaacctgctcgccgcgtctccgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttggtgggtatttttccttgttttcctctgatccagtctcaccaggtgttgggatttcagcaagttttgaggtgcagagttggtttgcttttttgtttgttttactccgaatccccttatgtttttcttggtaaggccttgaaaataaatctgtatgaaagcattggccttccccctcgtctgatcacttcttctcccggctaattagtcggagtaatttgagagctttcgattctaagatcccaggaggaaaagtgtcttttcaaagttcataaagttgttgcctctttccttgtgcagattttctcagtctccctgcgccataatagccctgaattttagcaagtgtaattgggggaaatggagttgaatttcaagtggaaatgctttctttttcgagtgctaaaacctggctcttcattcatgagcgatttctagaaagtttaaaaacaaagtgaacgtggtttctttctttcttcctttttatttttcttatactctcccaagctccctaagccattctggacgtttaactcgaacttgggaaggttttagaaggggctgggagcagaaaatgaaatgaaaggcaaagagcttgagcctggcgagtttactgaagagaaataatagttgttgcggttgacattacattttttatagccagtgacctttgcaaaagcgtgaaggcagtttgattagttgttatcttatttggccctagagagtaaaactttgtcatcataattgctaattactcttttggctgggggcgggaggaccgagagctctcccctttacctcagttaaagagtttggggatggaatttgagaattaagtaattaaaaaaagaacagcatttgaaaactgaggcttgtgttggggacagagaggtgggggcagtgaccactctcttgtggtccaaggctggggcgactccaaaatgtctggagactccttcgttcaggatgtggttctatggccccagcgaggccgtacagagcctcgggctgagctggggggctgaggctgcagttgggggtctgacctctccggtgcacaggactgcttccgggtgtcgatgtgccccacttcccgggttgcttctgcacttagtgttcacgtttacttaagtaattagatagcttcttagcgagagggaagtgggaatggagcagaactggaatttgaaatactaccaccttcccagctgcttcgaaaactaatcaacgaggcctctttgtgctcagctactgaatttaaaaaaaaatggtatcaagaagttacaagccaggatgggagcattctgttgtgattgtgcacagcgtgggttacaaagtggagttctggaagttttacccctcctaggggaattccattccccatctccccacctactactcctttgcagcttcagggtcctgcatttgttggggtggggtattttgcattagagttggagattttgcctatccagggcatggctatgggtgccgggactgagagacaggaaggaagcattggagagccaacctagataagggtaactagtaaccctctgctgtggccagtatttacccaatgctgagaaaaagtcctcattttcggtttatttttatggatttaagctgtctaccaagtagttaaaaagtagaccaggaatggccttgtagagtaaaatgtgcttcttgaaattctttgcttgcaggcaggcagatcaataatcaccataggtaaaacagaaaaaataatgcatttaaaaaaaaacagagagaaatgatgctgtgactgttttgttattttacctctttttggggggcagacctcttgaatgggctctttattgtaactctctcttcccaattgagctccccacggtgccgttgtatctttttacagcccctaacaactcacaccagtaacacaattacctccagatatttacaacaagaaattacttttctattttctccactcacccaaaagactttttttttttttcctttgggaaaggtagggaggtgttcgtacgggagcagcctcggggacccctgcactgggtcagggcttatgaagctagaagcgtccctctgttccctttgtgagttggtgggttgttggtacatttggttggaagctgtgttgctggttagggagactcggttttgctccttgggttcgaggaaagctggagaatagaagccattgtttgccgtctgtcggctttgtcgaccacgctcaccccctcctgttcgtactttttaaagcagtgaggcgaggtagacagggtgtgtcacagtacagttaaaggggtgaagatctaaacgccaaaagagaagttaatcacaataagtgaggtttgggataaaaagttgggcttgcccctttcaaagtcccagaaagctgggaggtagatggagagggggccattgggaagtttttttggtgtagggagaggagtagaagataaagggtaagcagagtgttgggttctgggggtcttgtgaagttccttaaggaaggagggagtgtggccctgcagccctcccaaactgctccagcctatgctctccggcaccaggaagttccaaggttcccttcccctggtctccaaacttcaggtattcctctcccctcacaccccttcaacctcagctcttggcctctactccttactccactgttcctcctgtttcccccttccccttttcctggttctttatatttttgcaaagtgggatccgaacttgctagattttccaattctcccaagccagaccagagcagcctcttttaaaggatggagacttctgtggcagatgccgctgaaaatgtgggtgtaatgctgggacttagagtttgatgacagtttgactgagccctagatgcatgtgtttttcctgagagtgaggctcagagagcccatggacgtatgctgttgaaccacagcttgatatacctttttctccttctgttttgtcttagggggaagactttaactaggggcgcgcagatgtgtgaggccttttattgtgagagtggacagacatccgagatttcaggcaagttctgtggtggctgctttgggctcaaaacccacaaacagtcaaaacaaactatttcagtatgcttcttcactatagttcagatagaagaaaataaatcaaaattggggcatcgcttctactgattaaagggttaactgctaaagaatgtaggggaaacagattggggatattccagtactttgtttcaagccccaaagggtagattttgtatgcactgcagggcagagctgagtgaccctcagatcgccccaagaggttgagtggatcaattcctaaagaacggagattctcctgtcctagccccaggtccacctcggttgggagttcaggcctacctgatgcagctgcccgaggattaactcctattttcttgctaacagagccccatattcgagccccgtggaatcccgcggcccccagccagagccagcatgcagaacagtaagtgcctctggtctttctgggacttcgggctcggggtgcgcggacccgagggtcaggggaggacacagggactcgcgacgcccgcgctggcccggccgccgaccgactgaggcccggggacctgcggcggctgctccccgctccgcgcccggcagcccgggaggggagggcgtttgcttggctcttctcgatactggagaagcaggggctgggcccttaagaacagcccgcccgagttttcgaagctgcggtagagaaaccccatcccccccaaatcctgtaactcacaccccctctcgcccctgcccgggctctgaccccggagagaggggctgggctgatcagggcggggcgaagtcttctcctagttgagcgagaaggaggcccctttgggcttagccaagactgaaagtctccaccaacccggcggggttgggggcttctctccccaagtcactctcagggcagctcctcccctcctcaccccactacgggcctagaagggatggggagaggagcccccaggcctgcagcagggtaggggtggtaaactcgctgttacagggcgcgggagagagcacggtttactgggtctggtaaggaggtgcccaggaattggaaaatccctgccctggcaactgcaattgcttgggtcctgatagtcccaggcccagagcgcttttgatacttatggcccttgtacctccctgctttcctctgcccagaccccgtggggtcccacccaccttcctgttcgtggtgggtgctggtacgcggcagggctagtctagagctccgacctgggagcctggaggcccagcgaaaccaggcccggtttgaggttacggttgaggcacacggcgtcggggctcaactgaactcaaagtgtggaaaggcccgggtcttccagcagcctgccctggccgaaccacacaggcttaaggagggtccccagcaccttatccatctgttttggaaacgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctatctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttcttttctgttttttctttttgataatatctatccttggctaaggggagggcggagttcagcggcggaaataaagcgagcagtggctggtgcgaaccgactcccggctctaagccttacttgcggtggccggacttgtctgtggctgaagccgagcccgggctctgactctcacgtctgcactggaggtgcggaaacctggactggggttcaccagccacatactggctgctctggttgttctctcctcttccttcttctattctaaccaaacaaaacccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcaggtgatcctcccggcgccgccccactcgccgcccccgcggccctccactctcaacgccctctcttcatttcttactgtaaacgatgctaattatggacccccccaccctcacccaccccagtccccagtccccccacccactcccctgccttcccactttcccctctccttccaccatccttccctatctctttcaacctgggtcagttacataagataactcatctgcttcagaaaaatattgtgtgcggatttttttaaaaaaatctttctctttttatttggtaaagacattcattgtgggaacagtttatgaaccgtaataagctgagttatataaaccggcataatttcattctgctctccccagcccatgcttacctcagcttttgaggtatttgtttattcttcatgtttatgaataatatatattgattttaaaaggcaaatgctatttactcctccctaactcacatttactcaattgagtattttttaaagaagaagaagtaaaaaaatcagtttattttttacctttgttctttaaaacataacgccactttaagcaaggtcagcacaaaaataaatttatctacttcgttttgatgcatcttcaggcagtgtttaagaaaagttttttttttaaaaaaagcttttaaattcgttttttagttcaaattgtttgaaagtatcatcatatttgtagtttttagggctacaaatgtaattttaagaaaaaaagctctctacagtaagttctcataccattgaaggtatatttttgtgttatagacccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgtcctctccctgctccacatttgtctcctttgtacctgggggaacagagaggaatgccctgacttttctttgactgtctggaaaatgggagtcaagtgtggggagtcattcacttcatttgcatgctgcaaaacagagggcggaggcaccagggaaaggcacttgaatgaagaaggaaaatgagaaccagattgtaacttcgtcctaatccacctgccagaactttccttcaggtgtcacacatccatttccatcctaatattaaacaatataatgaaagaaagctttacaacaagtctaaatagtttttattttcgggcagtcttttaacaaagcaaagcaaccgtgtgagttaggtcaccagagacaccaagcaatggtgaaggaccccctccgcccaattctctatccaactaaatttccatgcccaaagtgatagctatcattttttccacggtgtatctgcaaatccacccactgtcccggggtggctgggagctttttaacgggttgagagttgctttttaaggttgtgggtgagctgagatgggtgactgtgtcttcaggagacactaccatttggtttgattttggtttgatttgcaggtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaaggtaaaacccaagcagccatccacgcagctctccatatgtgcatccctttgcctgtcccctactctcccaaccatttcctctcagggcttccatgcttggggaatgtcatgggtgagactgcatttgaaggcctgggacacatcgaccacattgtatgtaggtggtgtttgttgaaccattttgttggcctgggaatgtgagggttgtgtatgtcaggagcggtatgaaggtggctggtgggtgcgtgtgtgtgtttgtgggcagcactgtgtgcataagaacgagctgcgtggtgcactattcaaatttgacattagaatgcagggagagcccccttgtagaagtgtgacaagataacgcactgacagactgcgaggttaacataattgtatcctgttgctttttgctgtaattgacaaattatgtgactatgagtagggtgcacatgaaaaggtgagcagggagatgcagggcgagtcggggatggggcattggaagtggtggtctcccaactaaaaccaccccactatccttgcccctcccccgttcgcccctctgggtcccactttctcactctctgtgggtggcgactatgtggaagtggtgaggtgaagatactgtgagcaggacggcgggatgccgggagccgctctggtctgggaggagagatgggacctgaaacaccccaggttctgtgagaagggctggaggaagaagagcgggggatggggggggtggggcggaggggagggtcagttggctcccctccgctcccctccacaccccgaggtagcttggtcaagaataggaaacagtttactccgaagattaatcggtatttgttgtcctcgtgacaaggagataatatgcgggataatgggacgtggcgtctcactcccaggagcacaacggagccgaggggctcggggccaggggcggcgcgcgggactgcgaggaggctgccggcgcatccgtgagctctcggaccggctccggatgcccggcgcctccatggagtcgggcgagggaagggaaaatcggtaacagtatgcgaaatatctggtacaaaggatgcttctgtcactcgcaagaatttgttatgggaacaatcctgtcgctctgtaattgctcattagagaacgttttgtttctcattaaggcgacatgaataagcgtctagttgaaggagacagctgtagaaatgttccacaagagacctctggacacgattcggcaccaattgccaattagacatgtcagttttaagagcagaaaacaatataggacggacactgggaagatagggagcaaagcgctcgcttcttgtttcccagcgcggccgctcggccggcggaggcctcctgacgcgcggggcccgggctcccctgggcgaccccgcccgcacgggccccgaacccgccgcctccgcgagctcagagggcccccaggcccgctcccgcctctggtgagactagcgattgaccccaccgagtgtaggcaaccccatccctgcctgacttttgaaaccgtaggattcccacttgtagacactggacacacccaagtgacacccgaacttcgcactcacgagcgtccacccctccgcccccagcaatctgaggtcctggtgatccctcccctgacaagagtctggcccacttagtccgagaagtcttggggagggactcagggcacggtggcctaggcctgggagggctgagcccagagcctccactccgggctctccccggtgcgtgggctcccatgagcttggggcgcaggatacaccccccttccgcttcttggagttgggcagaagccgaggacagcagcttccaccagaggtggcgcccgattcgggcggattttcgtcgccggcagtctgagggcgggaagtgagagtcaaatcagctagggtccgcctgtgatggttggggccggaggtggagctagtccaggggcttttcactttaacgcgcctagttgctagaaaattctgggtcaactggcaatcaccacccccccacccgcaagtgaggtttttggggggtgattgtcacctcaggcacaggaccgtcgcccctagttgcgtggggaggacacgtgggccaaacgaagcacagagttgccggcgtgggggtagcgggcaccggtggtgagcttcgcttcacgttcccggggaatcctcagactttttggtgctaagagggtccccctccctccctagccccctttcccagcccaggaagcctttcttgggttttaaagagtccatactccaaaagcataaggcgggggttaggtctcagagggagacaaatatggtttccatctgatcaacgccatgcggcggtgaataaaatcgcgacgacgtgggctgacaacaacaagagacaactctatccagccccaattctccggcgatttggtggttttagggatcacggagacactttttcttatctcctcccctcaccccacccccaccccccataatacccaagccctctataggatttagtcagcctctctttcaacagatgctacaatgttttgatccgcgctccagagctgaaaaggtgccgcaaccgggttgctatcttttcttgcttgttttccgcctcactgattaagacactaagaaactaaggaatgattttatttcccagcaactctctctctgtctctctctctctctctctctctcacctccttccaggaaacaaatcctattcccatcgtcagatggtcctggggctgggataatgggaggcgctttcactcgctttctcacggattaggctggaaggtgaacggcacccactgaaggcccctgctttgcgcggctccgagggggcgccttttgaagaagatatcttaattgtccaccacttaggtttatcgtgggggtgggggagtcgagatccaacttctagttttattttgttaaaagctttaagagtggaaggcaaatccactaaagtggggggaaatgtacccattttatgtaagagcagccgctaggtcaccgcctggctgcaaacagttgccacttctaaagtaatgaactgtctccgtgccgctctccccgcggggtagagaagggatcctgcagcgacaggtttctttttgctgtggaattccaatccccgcttcccatcttttttttttttttttttttttccagatttaaaattgagctctactgtccctgctgacttttctctcttaagtgtcagttctggaggcagcacagggcctggcggcgatcgcgtgctgcctgtgtaaacccgtgtgtatgtttgtgtgagacagaacatggataagaatgtgaatctccatgttttaaaattaagaaaatgtcaaagaggcaaatgagagcagagcatgctatcggcggggttcttcggaggcagattcgggcaactttgtttaattggcgagatcgaatgtgccagaaaagggaccgagatggggcccctaggaaggcatgggcatgagtggccatggggagatgggcattgtgttctcctcagtgtcccccaccccataccagatgtgcacagatttttgtctgttttccaaaagcaataaccctccggcctttctagttggccaaaaggagctatttccagtcttccttcttcaccaaacccgaaaataaagcgaggggtgggggtggtcgcttcatttcttcccttgaaaaacgctttgaaaagtccccggaaacttggggcagtaaattagcacagacgcttgtgcccgcacacgtgagcggagcgcgtctccctcagctaagtagccctcctcgacccccacctttctgatggagtgcaaagacccagagtccagatggggctcagttactaatattctctggccctcatcctccttttcctctctctcccactcttgttcggccctcgtgtctctttttcctctcagcattcttttctgtccttttttaaaaatacctttctagcctctatgttttttgagccttcttttcccctccatcgccctctttttccctccatcgccctctgtctttcccctaacccaggccccccaatccttcccccttgcttccacccccaccgctggtttccatcctgcctcccctccatctcctctatgtaggaacccagccctggtccccgtccactctccctgcctccccccatgctgggccctggcccccccatccaccctccatccccccagccaagcgccctaaatagcacggaggcgcccgctcttcggacagtgattaatgatagcagagcagaggggttaacacacttcactgaaaagtctgttgactgggcttcttgtaacacaatgtggcccgctgcacgcctcaagagaatccttttgttgtccgcgctcattgtagcctcaaaattctgcccacgaaagtttgccaacgctcctgccccaggagtttaatagtttcccttactcgcggggcattgtgcagcgctgaaaagcagcccctcgctattcaagtgttggtggtcatctcaatagatctccaagggcccatatggtggccagtgccgatgaatccgcctgtttaaatgggggagaaagttggggttttaaaacatttcaaagttcctgaaaagatcccactagatcctgtcacaattccctgaactctttgaaggcgcagcctattgtctcctggttataaataatattcctggccaagtcgattcccaccaaggcgctcctaggggcccctccaccccgcctctggccaagttttgaggatagggaggtgggtagcccatgctggtatcccttgggggtcatttcaggaccccagacccaggacccagcctgtagtggccctggaggcccagtcagagtttaggcaatcctgcttcccttcactgtggccttacaggcaaggtgcaagccgggagccagctagcccaagtgcacatcttgccctccaggcagcaagggaaaaccataaaactttccccctgtataatgatagaagttacattcaaagtggtggaaatgccctaattaaaaatgtaccacttaaatgatatgccaaagattcagctgcagcatagaatatttagctagttagtgaactctctactatttcttttttaaaattacacgttaaaaatttaaaagaaatcttacttttctctggtgcaacacattacaaagaatggacagtccttttatctaaatataaaattccattttcagcaattatagcctgttcttggtgatgatataattacagctgtgctcgtaataggtgtcaaggcgaagcgcactcatacaatagttgaataaaactgcagaacaatgcgagcacttctaaattcacaacctttaaatgaaattgactgtgcagaattcaaataaaaactagataaatattttttaaaaaagattacaagcttggtttggtttcttaatagcattttctacaaacctatcaacatctaattgattagataggaattactgattatagatcaactgaaatcttgaacatcactcttctattttcccaacacagccataggtaaagagattctgtagggagtggagtgaggcatttggggagttggggttacttataaaagatcattttaattggaaacttcagtgcttattttttcattcaagaaatgccacttagtgtgtgtattataaagtctcatcttgataaaaacaaagaaaatggtggtcaggtaactaacatcgcaaatgtatttttttaaaagaaggctgacagttaccttgggaatgttttggtgaggctgtcgggatataatgctcttggagtttaagactacaccaggccccttttggaggctccaagttaatccaaatttctcttaccatcctattctttttgttccagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaaggtgatagagtttttcaaagtagagaagcagtaaatcaaagtaaatgccacatcttcagtacaaagagctaaatttagccagggccctttgcatagaagaatgaaaagatttccttttttctgtctttttatttctctgggcatcttttcagtgtgtgtgtgtgtgtgtgtgtgtgtgtgtgtgtgtgtgtgtgtgtgtgtgtgtgtgtggtgtgtgtgtgtgtgtttcttcttttcatctaccagtaattcaaagactaaatgtctgacttataaggaaaaatgatgatttggctatttcaggccacagaaaggtcactgaatgccattccaaagaaaatttaacttggttctggtgggaaagttcttccaagtacagtcaacactagaagcattttaaagggaattggttggaggtaatgggagtggggaggtgggaaccagtttgatgcacagtttggtcaacatattttgtgtagttctggcacaatatggaaaatcaacttactctttcagagtttgagagaacccattatccagatgtgtttgcccgagaaagactagcagccaaaatagatctacctgaagcaagaatacaggtaccgagagactgtgcagtttcacactttgtgattcataccatttgtctttcctagagacagaggtgcttgtacagagtactatttatttataggactaatataataaaaaggttcagtctgctaaatgctctgctgccatgggcgtggggagggcagcagtggaggtgccaaggtggggctgggctcgacgtagacacagtgctaacctgtcccacctgatttccaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccgggtaatttgaaatactaatactacgaatcaatgtctttaaacctgtttgctccgggctctgactctcactctgactactgtcatttctcttgccctcagtttcctccttcacatctggctccatgttgggccgaacagacacagccctcacaaacacctacagcgctctgccgcctatgcccagcttcaccatggcaaataacctgcctatgcaagtaagtgcggctggtggtggcctgcataacccaggccccagagaagtgaggagtggctcagggcctgcggacctcattggctgtgtctgcacccttgagagcttttcgcactacagtgattggcttgaccagtcaagtcggagacagtcaatcccatcacttttaagtgattgactcattaattcatgccctaaaaaaatgagtaataaaaatctgtccagttttgtcaggttgatctgccttttattatactgttaccttgataatgttgggtggtggtggggcatgttttgggtaccagggagccttgcaccagaaagtggaaataatgctggcacattatcagatagcagattagtagtttaaaatttgggtttatattaatgtgtttgtatgctaaatatagaatctgtgcacgcatttggggcattactttgggtatatgtgataaactagtgagaaagaaaaaaggatcagaaatgggattcatatttacatggtgagatatacataatataatgagaatgctagttttctgtctgtatctacaataagaaaaggcatagcaggtatttgctggaaatttagtgtgtctttgctgtgaatggtgtgacgagtttgtggccctcctagctgcctgggaagcttgatgctattcacttggtatgacagcctgcctctcctcttagttctgtcccaaatatctattagcccctacatttagaggtcctgcactaggttcaccctttatgatgtaagttggataaggcagatggtttgtactagacctttgttgctggatggattcttgataggaaaaatgtctgtcttctggtaggcctttcccagtggttttcctagaactcctgtttgtgcaacaattagagatattagatggtacgatattggccagcatgagcctctgctggaaacagttctggggctacactgattgtttattctccattgaacattttttgctggatttcaaatccaaataacagcaaaataaatgtttcacagtcttcagactaatataggagcagctagataagcaacttcagaggaattattcacatgtttatttttattgcatctggatattgttggccatagtgcaattgatgtaaattaagggattaacagcccattagttggtgttgctataactgcgttggaattttccagaagtcaggttgcctagaggaactcattgcaggaattagaaacaaatgcaagctgaaattctggcaggccctcaaggcctgtttgcctctttgaacttgatgttagcattcatcatctgactttaataaggccacagagtgtctcgttcagtttcatgtattataacaacatccaggtttctgtgaagatagcaaaatgtgtatgtgagaaaataataagacgaacaagtagatgctgcaattatattagggctgtttccacatacagagcggtatggggaatcaatctatttcaaacactgacttttaaaaattacataatttgtataattcaaaaagtacatgcattcattaagcataaagaaaatcaaaatgatcaataactttactcttcagagaaaactactctttgaattttggagtgggtgagcccgattgtctatccatttattcattctcttgaccaaaatcatcattttacaaatggtgggtgtcttcctctggaccttctctgatatgcttccctctctgagcatatggattttggaaattaaacatttctccagtttgcagagaagagaaatgatagtatactgtactatcatctgacctgcttgttcccgacacacttcttttaattcatcccaagtttgctgccatggcatagtaccatgagagctcatgaggcgttttgttaggagaaaggtttacctcctcagtgctgccattccgaacagttcgagggtagcaacagttttctagttataagtcagtctgggcttttgggtctgttaggaagtcatggttaattctcaggatggaggtcgttatatttactaacacttctgatcactttaacttggggtcattacagatctgcttcttcaaagaatctttaatcccatcagtgaaaggttcccaaggtccctgaaccatactttactgagagctcctcccactgctctctgtcccaaagcttgagatatgggctctgggggtcatagggttcccaaataaatccagatttgcagggagaggggatgtgttttgatgaaggtcctcatgctataggttcttcaaagatgctagcagaggttagagacaaaaatcctattaatttatggatagtggcaaccatctagctggacagttgtcagaacctaaagtgctttagaggcttgatacataggcagctttcttctagctgtggccagtggaaggactagctcgaggcccaatcttagatttatcatatggaattccagtacttcacgtgaaggcatctttaatgatcagacttgttggcagagttcctcgggaggagggagcctggggctgtggctgtgtgatgtgttcctcagtaaccacaggtttgcctctctcctcacagcccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggtgagccactgctttctgcaggctgcacagaggcgatctctcttcactagaagtttacccaaacagaatctcctggtcttatgggagggcgtgtttaactccttgctttccttgtccctgggggatggggattgaaaagggaaattcagttaagctaattagtaactttacaccatatagacaaaaactaaaattgtttttcctgaatttggtcacaaaagttgtgtatgaagacaaggcctgagactgcaagttttctgaggacagattattagacgaagctcagtagggggcccactgagctgtaggtgcgtgcttgttgaaatgcttcttgccctcatagctcctctagaccttttgctggaaataaaaagtgacacattggttttccagagacagctttattgtaaaagttccaaacatgcaaacaaacagaggattttttttttcttttcctttggattggggtggggggtacttgggatccaataggtatatatacatatattgtctagtttctgaaggtgctacttttatttgtaacaattgaagtgattttaatacagtaaaaaatgttagaaagtattagtttttttttttttttttttttttgtaaacctataaatttgtattccatgtctgtttctcaaagggaatatctacatggctatttctttcatccacttctaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagta

SEQ ID NO: 34801 - DNA, 2380 bp, Homo sapiens
acaaacaggcgccggacgcggagccgccaggaagcgcgggagggggggcgggcccgagggggggccgggccgcttggtaacccctccctgtccgggcctcgccgctcagtacgggggcggggctagccggctgaccccctggcctactcccggcctccggctccaggcccttcccggatccccgcccccggattcccaggggacggggaagggagcgcccgccccgatatctccgccccccagcccctaacccctcagggttgagcggaccaaccccaccacttccgcgaggggcaggggcggggtcacaaaacgggccctcggcctaggggcggagtttctcgtaaggggcaaggccaaggcatcttgtattggggctgacaggggggcgggttattagggctgaggatgggaggatgctcagggtattggggtcagggtggcattagcccagctcaagccgggccgggctgactcagcatcctgccccagccagcttccatccctgacacctctgcattcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgagtgagtgatttgcgtctcccttcctcctcctcctcctccctggacaggctccctcctgctgccttgaatccccacctcgctcagaggggcaataagtagaacatagtggctgagagactggttacagctctgccatttattagctgtgaaacccagggcatgttaccaaaccaccctgggcccattccttcacctgtaaaatggaaataatagtacttatctgatagagttgttgtgaagatgtgaattatgcttggctggcacatagtacagcagtcagtaaatgttttactattctttttcccttctgaacacctgtgcccttcagtccctcccccaggcctctatctccagacatcctaacccctctgtccctccctttgcagccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggtgagtcagcaaagcatctgacacctcctcccacccgggactcctccctgcctccaaccctgggcctcttggaaccgctgactctccctgactctttccccttgcttcccccacaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttggatggaagcaa

SEQ ID NO: 34802 - DNA, 4376 bp, Homo sapiens
aatacgcctggcatccaagtccacccactccggactttggccttagcagtagttagtgtgggaggctgggaagactgggagcagtctcttaaacaaaagcaaaagaataagcttcgggcgctgtagtacctgccagctttcgccacaggaggtaagtggatactgggagctgggggaactgagaagactagccagatattacatgtattgccaactcaaaactttcagcttttaacatgcttcctcacacattatcccctttgatcctccacaactctgaggtggacctggtgggtcttagccccacttggtagatgagaaaataggttgagagagacagtgagatgctcagtatcacacagcaaacctcttggccctatacatcattccaaacacaagacccaggttgcatatagaaggttcagtgtccctggtttagaaggagaggtggtgtgaggcaagcaagaagatgcctctgctgcactccagcctgggcgacagagtgagactccatctcaaaaaaaaaaaaaaaaaaaaaaagatgcctctgctccatacagcaggtctgtacacaggatctggctcatgtggttttagttaagttagccacaaatacagggtctgcccacatctttgctttgaacagatgagccatggttggccaattatctgccaaccagataatttctcaatatgctcacaccagatgcttccagctagggagggtattaggggaaagggcttgagggccacagtaaactggacaagtttttctgcccagcctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggtaagtatggtagaccaccaggaatatggtgtggggtgtcctgatccccacagtcaccccaggagtcacctgcaagggctgtggtaagctaaagggacaatttgaggagaagcagttttcagatgctcccaggaagaagagggagctgtgggagtgcctcacctacccccagcatccttttcatctccccacagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggtgaggggtacagggctctgggttccaggactaacagcagcccactcaacaaacgtgggccagcagaggtggttaagatacagcacattggaatagttaagaagagacagtttagggctagacttcatgggttcaatgaagtctacccttatgtaagctttgtgaccataagtagattacttctctttacccatttttaacgtgtttgttttttgttttttgagatggagtcttgctctgtcgccaggctggagtgcagtggcgcgatcttggctcaccacaatttccacccccggggttcaagcgattctcctgcctcagcctcccgagtagctgggactacaggcatgcgccaccatgcctggcttatttttgtatttttagtagagacagggtttcactatgttggccaggttggtctcaaactcctgacctcgtgatccgcccacctcagcctcccaaagtgctgggattacaggtgtgagccaccacgcccggccttgcctctcgtctttaaacaataaggttcaaagttccgtgggagcacaaaggagacatgatgaggacaacgggagtagggcctgagtttttttttgtttttttttttttaagcgttttgctcttgttgcctaggctggagtgcaatggcgagatctcagctcactgcaacccctgcctctcaggttcatgtgattctcctgcctcagcctcccgattagctgggcttacaggcacgtgccaccactcccagctaatttttttgtatttttagtagagatggagttataccatgttggccaggctggttttgaactcctgacctcaggtgatccacccgacccggcctcccaaagtgctgggattacaggcatgagccaccacacacggcccaaggcctgagttcttagcaggagtataaggcgcctaagcttagtctaccttctaaggaagcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtggtgaccagacttgtctccaactcccggcctcaagcgatgcttccgcctgggcctcccaaagtgttgggattataggtgtgagccactgcatactggaacacatactttatacttgaatttttttttatccccttccctcctgctccttacctatacttggatttctacatctgtgccagggcagtgggatgtatccccactttccccatcagcttaccctccagcaaatacgagactatacccttcaatatccagcactcagggctcaaccatgtgttttgggagcaagggaatggggttcctctaggtcaggaatcggcaaactcagtactcaagccagatctggccagctgcctacaagctgataatggttttttttatttttaaatggttacattgtaaactgttatataagtacctgataatatcattaattttgtttcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtccctggtctgtggtaactttctcagctccccaacccatgtccctcaaagtcccctccctatagggcaagaacccagcaacttcgctctgccccgactctaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtgtgagtagccaggcccacacaggggcacatgaagggaaacaagtaccagaaaggccagtcctgcataagcctgctaggaggtgggtggggcacccagggcagggttgagggtgaacaggatgttacaagagtgcccaggccatgtggaacctgcccactccccacactgaggaggggactgagggtgacaagcccagggccccagaagacagtacctaagatgggctggagtgaggaagggaaactgattgcaaccacctatggggctgcagacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaggctgaccccatttaagtgccaactactccaaaccga

SEQ ID NO: 34803 - DNA, 32566 bp, Homo sapiens
gggcacaagcaatcctcccttctcagcttcctgagtggccaggactacaggtaagtgccaccatgccagactaattttcaaaatttttgtagagacagtatctcactgtgttgtagagacagtgtctcactatgttgcttaggcttgtcttgaactcctgatctcaaatgatccacctgccttggcctcctaaagcattaggataacagtcatgaaccactgtgcccagcttttttaaaaatttaatatatatatattttttaaatggagatgagatctcattatgttgcccaggctggtctcaaactcctgagctcaagtgattctcccaccttagggtcccaaagtgctaggattacacacatgagccaccatgcctggcctgtgctcagttttttaagtttttttctattaaccatttttatagcctgtgaatgtcagatatttacctaagcaagaaatttaaagttaaatacatgggtattttgttgataactcagaaggtttagctgtatttcttaaaccaacaatattaaattagtcttacttataaaaaaaatcacacaaagattattttggttttggctgggttcatagttttttacctttgtgccaaatcctgaccctgtaaaatatttaataagacaagtataaatctgaccataaatctaggcaaatatgtatgttgacaattttgaagacattttaatatttattttactaataattttaaagccagtttatttattaaagaattacttaagtcatgtgaacttggaaaacctttgggcttactaatttatgagtgctcatttatctataagtcaattgggtatcatgtagatacaacatataacatattacatgtatatatgtaaacacatctaaacacacatatatatgcacaaatagagatcttatacctttattttttgatttgtcttttgaaacagggcctcactctgttgcccagggtagagagcagtggtatgaccatggctcactgcagcctggacctcccaggctcaagtgattctcccacctcagcctcctgagtacctgggactacaggtgcgtgccgccatgcccagctaacttaaaaaagttttttttttgtagagtcagagtctcactatgttgccagggctggtcttgagctcctgggcgcaaatgatcctcctaccttggcctcccaaagtgctgggactgctggcatgagtcacctcatctggcccttatagttttcattttagaattttagtcatgagatagtaatacaaactcaccagtttataaaagatagttggatctaaattatttttggaaaaaattgggacctgttagttcacatggctaaattttatttgtcccaataggtaatctaatgaaggctgtgagccaaaatttttgggtaaggtagttcgatggcagttttattttaaaaatcttttatccttttattcagtttcaaatgagtttagagttaggtttttaatgttaacattttagcttgaactggctgaatcgtataagaaaaacaaaatttctaagtcttcttaagttagtaatactataaacagtgagctttatctcaacacaagtagaaaagtcagtagtttcaaagtaggcagaaaaaatatatagaggtagacagagaacttagacgatcctacatgttaactctgtagttctgggtggaccacttgagttctaatctgtctattattttaagatgtgcacaacaatgggccataatatgtatctagctggagtctcagaaaacccagtatgtctttttttatttttccgagacagagtttcactctgttgcccaggctggagtgcagtggcatgatcacagctcattgcaacctctctctcctggtctcaagtgatcccccaacttcagcctccctaatagctgggactacaggtgcataccaccgtgcctggctaatttttgcattttttgggtagagatggggttttgccatgttgcccaggctggtctcaaactcctagactcaagtgttcttcccacctcagcatcccaaagtgctgggattacaggcgtgagccactgtgcttggcctggcatgtcttaatgtttgagaatctcatttttaaaatattaatctctcagtttagaaaaactgttggattcgtatttttatgatctcagtagttctattttcattctgcagttgttttgtttgttccccttgttttaaatttaaatatatttcccccttttgagggaaggaaatgtgtgtattgtgaaattctaaaaaatctgtgcctaagaggtgtatgggagccaggagaacaaacaggaagagctgagttctgattacgggggtagaaggaggaggagcagctagaggcaaaaaggagaaagcctcctaaatcattaaaattttcaaatcgtttcacatatcttttttacctcttgaattgaggcatttttaaaataatttttttagaagcttgtaggtgttattggaagtaaatcttccattcaatttgtctgtatctaaaaccagctttttttcaactgtgtgtgcaaataaattatcttaggcattttcggaacagctccattttggccactgctgcttataaccaccctgggttaggggatctactgcttatctaggcacttgcaagtggaaggatggtaagtattatacctaaaactcagcaggtgtcttagagtgcacttcccattttagctttgtgtgaggacaagttatggagtagagtaagagtgccctcatgcgactggaaaaggaaaaagctaaggaaaggtctcaccccaaatcaccagggaaacaatttacaaagcttctattttaccctgccctagtatttaacaaaagcccttatcttgaattcatagcagcagctctcgttctgagacagtcattgtaccacgtagccaaggaggaaaccagctttaataaaccagaacatcaaccaagacaggaacttcattgatttcaggaggaactcatctgtagcactcagcaggggcatctaagtccaggaacacaatggattttgtgctggcacatgcacaaaggttggaagcaggtctaggtagtccagggaggtcactctgaaatcctgtcagctatgccattttgttgatggaaattaaggctgttgaggcagaaataaattgataaaggtttattggaagccaaatgtgaggatcaatctgggaagacacgccaataaagctgggtgtattccaaagtctgtcgttagaagttggaatgattttataagaaagtttagaagaagggatggagactcttcatactggagttgtcctttttcattgaatggcacaatacagaggttacagtccttggctacagatgacaacatacaagttaaaatgtccatgtttaagacaatcagtaacacttcatgattcagaaacaaatcagtgtccttttcagtgtcagtaggttacatattaatgtgtacgtcaacagtttgagaaattttcaataagatttgagagactcatcgtaagattctttactcagaaatgctatgtaagccatgaatcataagacttgccccaggtaggctaatttggaagactgccaaacgtgacctgtaggttatcacaactaaatgcaatgtggggtcctgaattcaatcctggaccagaaataggacattagtgagaaaactggtgaaattagaataaagccattagtttagttagtggtgttgtaccaatgttaatttcctggttttgatcattgttctaaggttatttaaaatgttgacatttggggaagctgagtgaaaagtatgcaggaattttttgtattatttttgcaattttttgtaatatttcaaaataagatgttttaaaagacacatttgatcaaccatgacagaggaaaggctgaattatctttttattttccctagggaaaatgatatttacaaaataatttttataggaggaggcactcaaaaagtatacagccaaaaatataagaaaaaaatatcattaactatgtcaagcagttaattagtaaagatatcaggtgcagtggcatgtgcctatagttccagttacttgggaggatgaggtagaaagatccctttagcctagacgttctgggcttgtagtgtattgtgccaatcaggtgtccacattaagttcagcatcaatatagtgacctcctgggagcaggggaccaccaggttacctaagaaggagagaactggcccaggtcagaaacagagcaagtcaaaatacaggcgctgatcagtcgcaagatagtgcctatgaacagccactacactccagcctgggcaacatagcaatgcacgtctctaattttaaaaataaaataaaaatataatgtcattttctggattttgtgatatttgtagtgtgaacccagaaaatttgtgacaggtctcagttaatttagaaagtttattttccaaggttgaggacgtgtccccacgacacagccttcggagggcctgacaacatatgtccaaggtggtcagaacacagtttggttttatacattctagggagacacgggacatcaatcaacatatggaaaatgaacatcggtttggtctggaaaggagggacagctcgaagcatggaatgggcttccaggtcacaggaagatgagacacaaacaggggcattcttttgagtttctgtttagccttttcaaaggaggcaatcagatacgcatttatcttagtgagcagagggatgactttgaatagaatgggaagcaggtttgccctaaacagttcccagcttgaattttccctttggctttgtgattttgggggccgagatcttttcctttcacattttctccaccctttaaaaaaaatcttctggagaaagcattttagaagaaaatgagtctctggtcccagcttttttctaatctctcttggttaggatggttcgttcctagacaggtaggtcctaagttattagcaaagctcatttttagaaggttgtgaagtctcatgtcctatgcagagaaattagggggaggaagggatacaaacaacaataaacaaaagaaaaatcctggaaaattgatataggccacattactctgtagtccatacatcagtaggcaggtatgaaagcggtttatgtatgtaaataggttgctgttattttcttctgaagtttaagttgtctagcttcagtttgcagagctttacgaaagcacaacttagttttttagtgactccaaattaggaaaaatggggaaaaaagaaggaaaacaattgaaaacattattttgaagacttgtagccaacaaaaattagaattcagtccaaactgtagaaaacaataaaaattgcaaaacattaggcaagactaaaatctaacaataggtgtactacactttttgaaacaatcttttctctctccagtttcccatttttactaaagacaaattatggtaggacttgtttgctttattatacttggcctaattatttgtatacagagcagcaagaatatatatatattttttgagatggagtctcactctgctgcccaggctggagtgcagtggcgtgatctcagctcactgcaacctccacctcctgggttcaagtgattctcctgcctcagcttcccaagtagctgggattacaggtatgtgctttcacacccagctaatttttatatttttagtagagatgggatttcaccatgttggccaggctggtaagaataattattttttacataggcttttaaattggctttgatgaaactgtgttctgtagaaagaatctcagataagacttctttaaagctgagcccagccgtggatttgtgctatcaaatacctatgaattgagttaacctctcctcttgaggttccaaggtaaacttggggctcctgggcctgtcagaaagtgacattctttacctaccacagatcaggaaccctgtacaggggctgtgtagataaaggtaagaggccaatttttccaaggggctatcttggttccagaagtcaagtttgattccaagggaaagcacaccattccagtcaaagtcttgataaaataaccagtttctccaattgtgtcctgttacaaatggaaacagattcttactgcacttacgtaaatagctgtattgttataagttacaaatactcacaaataatttccaaattctggagaaattaggcagagagacacaaatatgccccaagttttgttcatgggagtatactttagtcaattgctaaaagctgtaaatagcttaaaagaaaagttttcttgactctgaaaaacaaaaaaaaggatcagcaacgttttaagcaaaaagttaaaaatattactttagtcttctatcagtttagtttatgcagttaatcctgttctgcttgatattcgtgaacacttcagctctccatgagagtcctgaaagttttttcctctattctaaggttacaatctccaaagttatcagaaacctgcatttaagaacacctgttagagttctatagctgattataaaaccaccttctaaggaggaccaaaacaagacaacaattgtctgtggatgatgaaaggttttagggcagccataaagaaacaattgacaaggaaatttgttatctctgtggcatatgataatttaacataacaattataattattactgataatgtacactaagtcataccaaaattacaggagtttcccatgattttggaacacataccagtaacatatttatacaaatacagcccaaagaaaaccaaacaccatttcatatttgactatgcttcctgtataatttttataccaaataagccaaatatgtcattttcggactctagggaacctattaataatacctttttttttttttttttgagagggagtctcattctgtcgccaagctggagtgcagtggtgcaatcttggctcacggcaacctctgcccctcaggttcaagtgattctcctgcctcagcctcacgagtagctgggactacaggcatgcgccaccacacccagctaatttttgtatttttagtaaagatggggtttcaccacgttggccaggatggtctcgatcttttgacctcatgatccgctggccttggcttcccaaagtgctgggattacaggtgtgagccactgtgccaggcccaacaatatcttaaaggattaattaggtcagaaaaagacataatttatagtttgattttggaaagtttgtcaaatatcaaaggtttaaaacacttgatatcacaaaatagaattaataggtcattgtgaaataagttattcatttaaccaaagtgataactcaaggatttccccaaaaaaggtgaaaaccttcattctttgagagaggagacttaattttccaaacaataagccctaataaaaacagcatgaagccaattaaattcatttttcaaaattttataaacaatctataacattttaatcttgaccataagatataactttcataagcctttcataacctttataacctttaggagttggttaatgcttcaagaaaaccttgttaatctgacacaggggcccatatgctggtcttgcatcagtgtgcctttgacattaatgattaacatgtagagaaacagaacttgttttatctcttaaaattggccctcacaatctcacatgcccatctcttctgtgatagtccctgggccttgaggagtttaatagctttaatttctggccctgtgtttcaggaatacagtttattttgattggcatcttctaccaggcctgaagatggggggctttaatggctgtcagtgtttaaaaaattagcaggactttgatgtcctttttagaccaaggcatcaaagccctgtaactcaatgtcacaagtactttaaaagagcataaagagtgtgaaaggaaatatcttgggcccccaaaatcactaaggaaatctcaagctggaaactgcttagggcaaacctgccttccattctatttagtcactcctctgctcactgagatagatacatatctaatttgcctcctttggaaaggctaatcagaaactcaaaagaatgtaaccgtttgtttactatctatttgtgacctggaagctccctccccacttagagtcttcctgcctttgttttaagttgttccacctttccagactgaaccaatgtacttcttacatatattgattgatgtctcatgtctccctaaatgtataaaaccaagctgttccctgaccactttgggtacatgtcatcaggacttcctgaggctgtgtcatgggctcgtcctcaaacttggcaaaataaactttctaaattaactgagacctgtctgagattttctgggttcacaagagagatacacagatgtagtaaccttaatttaaaaaaagttttaatctttttttcctaagcaaaccaaaacttaataataatatgacaacttgatcatataaaagtttttggttttgtttgttttataaatccgcttattgtgacttacatagaccttttgtgacatgcttggactttccagtttgtcttgaacatccctccttcttaaataaccagtcatgtcattttactctaggactaaatttaccacacaatattctttttcatatgaaattatttctctttaagctttcttacaaaaaaaatctttatttttataactttctttacatctcttttatttcctggttccttttaccttgttttatacatgatctttaaataagctttgaattagacaaaaatttttcacttttttttaaaggacacacttttttttttagaaagaacgttttcctacaattatatttttattagaaaatacccaaataatgaaatatctattatctaatttaatataactttagattctaaattatgatgaatgtgtctacaagtatttattctattacatttacctaattattttattttcattgtttacctagattatttatgaaaactgtgatagtcatcatttaaaattatggaaccaccattgcaaaattataactgagacagtgaaaaagatttaacttaactggccccatcttgcttttaaccttcaaactgtccttgttcattcctgggcataggccaaacaaattttgagaggaacttagtttatagtttagctttgaaacaaagacgataacaaaccttacttcctgtggactagaccacctaaagccacaaaattaaagttatggtaatcttactaaatttaaggtttagctatttttattaaaccaatatcaatgtcttatttattaaagattacacaagcagagatcattctgttttggtctgagtttatagttttctaatccctatgccaaattttgacaccttatagtgtttggcagtaataagtatgaaattgcttgattaataaatgcaaacaaaaatgtatgctggcaattcttaagacatttctaatattactttaccaataattttaaagctagcttatttattaaatattttacttaagttacatgaacttgaaaaaggatttgactagtcttcctttttctgataaagtatttgatgatttaagtgcttttctttttctttaagccaattaattagagctcttttatatattttcagtagtgaaacattgtgtacacaacacataaatgcattgacatattagtcatgccaatagaagtacatcttatagattcataaagaccttttttctttcctatcttagacttccagattcttgataacctgtttcacaacactaggcagttctcagctaaatagccttaaattttcatattaaaggaaacaactcaggtgaaaagtcaaatagcaaaatttacaccataaggtacaaagagaaaaagtctgatggttctagagggagattgaagatggatgtcaaatcaaacacaaaattacagaaatctatcataggattgtataaggagacaaattttatttagatagggactacctatctttttttttgagacggagttttgctcttgttgcccaggctgaagtgcaatggtgcgatctaggctcactgcaacctcctcctcccaggttcaagtgattctcctgcctcagccccctgagtagttgggattacagacatgtgccaccacacccagctaatttttgtatttttagtagagacacggtttcaccatgttggccaggctggtcttgaactcctgacctcacgtgatccacacaccttgacctcccaaagtgttgggattacaggcgtgaaccaccacacccggcctgggactacctgtcttttaactggatctctgagctctgggaggagcccacactgaatcctgggtctccaaaaagggagaattattttgaggttaaaccatgtgatgcttttatagtgcacttaaaaattttgttgttgttgttttttgttttttaataaagacatttctaagtgtctaagctacattcttccttaaaaatcccagagtggcctctgttgcaatagctattaatgaagaaaacagaattcagtcaactgagaagaaaaaacttgcaaaaaaaaaaaaaaaaaaaaaaaagacaaggttttgggtgagaaaaaaacaaaacaaaaacatgaaggccttttaaatacaaacacaccttggatgttagcttttaattaagctgacttttaaccattgagctcattttaaaaaatcttttaaaatctcattactatatttcatctaggacaaattgctgctatttcagaagtaccaagtatcaaaccagaaagggtttgatttaggaaccaaacctaggctgttgtgatagggaaaaaaagaaggcagaactttagctattgaactacagggtgaggtgacagccattgctttcagttggcagctagcaaaaaggtggccttgttatgaaaataaagcccctttagtaatcaaaataaaaaaatgttcccttctcttttttttttcttttgctggccatttttctcctacaccacccttttttgtgtgtgggaatttaaccacttcagaggacttattccccataatttggaactttcctttggatttgatcaagttggatagaattgatgaaacccaacaggaaaaagactgaaacaacaataaaaacagaaataaacaatggcacaacttatatgatcactgagcactctaatggtaagcagaaattaaaaccagctttttgttaactttagccaagacaaaacctcaattcagctacatacctagggatgggtctcaggctgaaaacaactctctaccatcctagaagcaggaaaaacaaacaaacaaacaaacaaacaaaaaacaaaacaaaaaaaaacctcattttccctattggaagtgagctcaaactccataaaggagttacctgctttccatcgtcatggaagcagaaaaacttgcctttcttgttgaaagcaagtaaaactccaaaaaaaaaaaaaaaaaaaaaaaaaaagaggggatgtacagcaaaataagctttagatcttgaccaaattttgggacatcagggattctctggaggggatattcccagacctcagcaaattgtcctgttggtttgagccataaagttagctcatgctggtaccaggcactgataggagatttgtcaaaggtcaggggcatctccattgagaatccttttgtggttaacaaaatgtaaacccagaaaatttgagacaggtctcagttaatttgtaaagtttattttgccaaggttgagggcgcgtacccaagacacagcctcaggaggtcctgacgacatgtgtccaggatggtcagagcacagtttggttttatacattctagggatacgtgagacatcaatcaacatatgtaaaatgaacatcggtttggtctggaaaggagggacaactcgaagcagggagggggcttccaagtcacaggtaggtgagagaaaaacagctgcattcttttgagtttctgtttagccttttcaaagaggcaaccagatatgcatttatcttaatgaggagaggtatgactttgaatagaatgggaggcaggtttgccctaaacagttcccagcttgaattttccctttagcttagtgattttgggggcccaaaatgtttcctttcacagtagcaactattagatttaaaaaaattgtaatttcctatttacttttttcttgtaattaacttcttgctttacttttgagacagggtcttgctccgtctcccaggctggagtgcagtggtgtgatcacagatccctgcagcctccaccttcagggctcaagttctcctcctgcctcagcctcttgagtagcagggactgtaggagtgcactccatggccagctaatttttttttcatttttttagtagagctgagatctgattatgttgctcttggtctcaaactccttgcctcaataaatcctcctgccttggcctcccaaaatgctgggattacaggtgtgagcctctgtgcccagctttgttttatttttgtacctaatatttactcatagttttatattctttttattaaaaagagttccctagcctttcagaaggaactgccgtcttccagttattctccaaaatgaggaacactaagggaaagaggagggacaccaatatatgttctctaggccttttagaaaacatggagttgttcctttggccacaaccatgcaaatctacaagaaaggttatgttgcagacatcaagggaatgggaactgttcaaaaatgccccacacatgttatcatggtattagggactgaaatgggatataagttgaaaagagactaagggatttttgaaattaaatgttaggcaatttttaaaaataaaagagggccaataagcccaggccttacacctgcactgtggtgaggtgctcaagattgcagaggcaaacctgtgcaaagcttctgccaactcaaggcattcactgaatgccccacacatgttaccacggcaaaactggaagagcctatcaacagtgttcttggacacaaacaaattaaaggcaagattcttgctgagagaattaatgtgtttattgagcatattaagcagtctaagggccaagataacttcctgaagcatgtaaaggaaaaggatcagaaaaagaaggaagcaaaagagaaaagtacctgaagtgccagccttctccactttgtgaagctcactttgtgagaaccaatggaaagaagcctaagttgcttggaacctattccctacgaattcatagcataatagccgttaaaaaataaaagggggggagccccctaaattgaatagacttcaggccctacaatatccagatctacttctgatgatgttttatttcataagctgggcagtaagtcatgctgagtattctttaaatgattctctatattatttggtttactccaaacagaaaatagcaaaacattttgtctaagaggcatttctttatctgtccttgtcctgatgttggatgcctatgacttcaccgattgctgtaagcccttgagttggcagaagctttgcacagctttgccccctgccatcctgagcacctcaccacagtgcaggcgtaaggcctgggcttattggccctcttttatttaaaaaaatttcccaacatttaattgcaaaaatcccttagtttcatttctactttactctatttcagtccccaatgccaagttcgttctttttgtaagtatcttctgaaggagtgactcaccatttacttctattggaatccaaattttgcaatactcacgaagttgcaaataattaaattaggatatcttagaatctcataaccagggagagattactgtaaactcaaccatattcaccactatttattgcatgtctgcttcatgcaaaccttggttccatgtgctgggggaacacaaatgtagagcttatttctgtccctgagctgatgagataagaagttgcctagaggccgggggcagtggcttacgcctgtaatcccagcactttgggaggccgaggcgggcggatcacgaggtcaagagatagagaccatcctggctaacatggtgaaaccccgtctctactaaaaatacaaaaaaaattagccgggggtggtagccggtgcctgtagtcccagctactctggagactgaggcaggagaatggcgtgaacctgggaggcggagcttgcagtgggccgagatcacgccactgcactccagcctggacgacagagtgagactccgtctcaaaaaaaaaaaaaagaaaagaaaaaagaaattgcctaactaagttataagtcaaaccgctgtgactgctgtacagaaaaggcaaatatagtgtatgggagcaagagaagtgaatgattgattaggataggtgaaagctgcagagaggagatatatttaagttggaccttaaacacaataaaagatttcttcagctgaaaaaaaattccatttatgttagaaagtttttaaaaaagtgaatatggcaatttataaaaaattttcattttgaaatgttacgcttcttgattttccatgacagaaagtgtgtgtacacacgtgtttgtgtgtatgtctgcatgtgtacttccattgcattttaatctgaacattttcaaacatttgtaatagtttaaagaattttacaggctgagtgtggtggctcacacttgtaatctcagcactttgggaggccaaggccagcatacgacttgaggccaggaattcgagaccagcctggttaacatggtgaaaccccatctctactgaaaatacaaaaattagccagatgtggtggcaggcacctgtgggtccagctattcaggaggctgaggcaggagaattgcttgggcccgggaggtggagtttgcagtgagccgctatcacaccactgcactccagcctgagtgacagagtgagtctctgtcaaaaaaaaaaaaaaaagaattttaaaataaatatccatatatccataacctagattctacattaacattttactataccagttttatcacatatataaaacaaatatagtgaaatgcctgttttacttccttctatcaatctactttattttattaacatacttcaaactaaattacagacatcggtacccttcccctttaaaaacttcagcatgtatatatatcattcattaactagagttcaatatttatttagttttttttcctttggatgtaaaatttgtatacagtgaaaggcacaagtcttaagtatatatttgctgttttgacaaaggcatagactcatgtaacccaaagtcctgttgagagatagaacatttccatcacctcagaaagccactcagtggaggtgtgtttttgaagtatatgtgtacacagatcccagccattgtagactaatggagtgattagaggtaaacagaattaagctgggagaaggtaaagtttctaaggacagaaggattagtagatggccagcatcctaggccctgagaggatattaataacttgctgtggacagtaagcaggttagcttggctacagctgagtgaaaggcatgggatactaagtaaaacattactgtcctctaatccttttcaatactacatacaccagggttatcctttaggcctacattctggagggcagtggttcccaaacgggggtgattttgccccatagtgaacagctggcaatgccaggagacatttttggttgtcacaaggggatagtagtgctccaggcatctcagtgggtagaggccagggatgctggtaaaaatcctcctttactcggaacagccactcacaggaaagaattataaggctcaaaatgtcaataggctgggcgtggtggctcacacctataatcccagcactttgagagaccaaggtggaaggatcacacgagcctaggaattcacgaccagcatgggcaacacagtgagaccctgtctctatttttttttaaatgtcaatagtgcctgctgtgaattaagagtaagggttgctgatcccttgaaaaatcaacggaagttacatactagcagcaaaaattctttttctttgagaaagacagtgtgtttattttagcttttaaaatcaagaaaaaggaacaacaagtcattattattggttaaaacaaatacaaaaaaatgtgcttccattttggtttgctgtttggggtcagggcatgggaagaggcagcaagttcctcatggctggaaaaggaaataactgtggtgctgtacgggctccttagggaagttgggcagggcttgcagtagaaagatggaatctgtcatctcccacctgtctcatctggcttccaaaatatgtgatttgaagaatagggaagaggagaaggaggaagggaggaagagaaagagaagtttacagttttccctctcactctattttgtaagaggctccattcttagtagggtatccaggacagggataaccaggagaccagtacagtatgagctgctagatgatttatgaccaaaggtcaaatcagcaagcagcttcccagctctgcttcatagcatgtgatctccacacatccctgcctcagtgttagccctgggaggatggctgatccgggaacctgacctgtgattgattcactcacggtgaggctagaagaggatccttctcaaaggtgttgcaagtgatgagtgctctgtcatcactgaacttcaggcctattcctacactggttcctctggtgttttcatctctttctctctgtgacttatgcctatatctgtcccagattgaaaatccctaaagagcaggtatcctattggtccctggcttttttgatgttgattacaatgatgaagtgggtgatgattatggctttgcttatgtgccaaagcatgtttaagaatgtctcgataccagtttgagaaatagctttatttgtgatactgcaatgattaatttaacaaagataaacatgtaagttgttgcaaaatgatacggttttcaacagaaattaaggccattggggcagagataaattgataaaagtttattggaagccaaatgtgagaatttatccagtaagatacaccaacaaagttgggcatgttccaacatctgttacaagttggaatgcttttataagactgtttaggagaaggaagggggactcctcatatcggagttatccttttccattggagggtacaatacagaggttacaatcattgcctatggatgacagcgtacaggctaaaatgttttatgcacaagacaatcagtaaaaacaaatcagcagagctttatgatttagaaagaaaacaatgtccctttcaatgtcagtattaatcagtaacctgacaattaataaatacatagtttgaggaactcgcaatagaatttgagtgcctcacgataagattctttactcagagacaggatgtaagccatcagtcttaagaccttttccaagcagttcatttggaagcctgtgaaatgtgtcctgcaggttatcagggtctttttgctgaaaagtttatttattttttcttttcttttttttagagacagggtcttgctctgttgcccaggctggagtgtagtggcatgatcatggctcaatgcagcctcaacctcctgggctcaagtgatcctcctgcctcagcctcccaagtagctgggaccacaggtgtgtgccaccaggccagctaatttttagttttcctttttgtagagacggggtctcactatgttgcccaggttggtcttgaacttctggtctcacgtgatcctcctgcctcggtttcccaaagtgcaggaattacagatgtaagccacagtgcccaaccaaaatttaatgtttatttacttaagttttttatttattctgtttcttaattatttattctttttttacagctgtatactatctattatgtggctttactattgatggacatttaggaggtttccaaacttctgctataatatacaatgctataatggtaaccttataaatacatggaagtcgaatgtttaggtgaatgagtgcatgcacagctttactagacattacaacacttctctctatggaggctttaacaatggactctcccacgagcaatgcatcagcattatttcttcacatgcttgccagtggatcatactacaatctttttgacctttggcaatctgataagtgaaaagtggctcccagtataattttaatttgcatctctcatatgagtgagggtgaagagccacttgtatttccttttttgtaaactgctatttcaattgggttgttattccttttcttactgatttgtaagagttctttatctactaaatcaattagtctcttgtcttcaaagcctgttatgaatatttccccccagtttctcatttatcttgccttgtgtatgatggtttttgtcatgctcattttttaagttttagttttcagtttcctgtcttactagaaaggtcttaccactctaaaaatgtgtccagtggttcttcttaatacttcagtggtttcatttctcatacttacgtctttgaggtattcgaattttggaaggatcaagtttgctttttcccagctggatacctaggtgccacaatactttgttaattaaatcatctgtcccttccactgatttgaaatggcattttcatcatatctaaatgcccatgtgtatttgggtctatttcttgcctttccattctgttctattgatttgtctgcctattcacctacctgtacttagtagtatggtttagcattttggtacaacttatcaatgatatgatggtggcctttggattataatatttaacattttattttagcaaagtgtttgtgtattttcataattctagatgccttatggtccttctaatatcttctctccagaggactgtatgctgttcttaaggactctctgcttcctggacaagctcaagctaaggtgagtaccatcttcttaaatgcaaggatcttagatttgagtcaagaagtgtctgctgggaatgatctgatcactccttgttctgttggtcaggtccatgggtttccccaggggcagaaactgtgtcttcctagtatgttgcacaattcctggtgcagagaaacactcagtaaatgtgtgttgaggatgaactgatgaatgaggacatgaacacctgcctgccacagaagtctttcatgcatgggtgttcctggaggctcctctggcttcacaggaagggacagaactgggaaattattcctggggtcctgtcccagctccttgtctattcttctgtccaagagaggaacacagagcgaggaagggcaatgaatcccacttacccttctcccatctcacacacatccagaggcacgatcctagctcacttcaaccttgacctctgagctcaagtgatcctccctactcagcctcccgagtagctaggattacaggcacgcaccaccacacccagataattttttgtagagacagggtctcactaagttgcctaagctcagtcttgaacttctggcctcaagggatccccctaccttgggctctttaccagcattttcttgtatttctcctcatcttcaatagcattcaactgaaacatcacccacgttcatcatctctcccttttctacaccatggccttgagtaaagcaagtgagatagcaagggagatacgaatcagaacagctaaccataacagctgactcttatatactgtttagcatatgccagtttcgttttccaccaatgtaataattgaacacttagaacaagtggggatatatatatatatatatatatatatgtataacacatatatatataaaaccatatattatatatataatcatacccattgtacaagtgagaaaactgagttaacagagaggtttagtaacttgcccagggccgtggagcttttaaatagattcagcgctagagtccatgcacttaaacaccatacctttccttgtaatatgcatgtgcgtgtgttaacttcattgaagtaaaatataaaatgcagaaaagtgcacaagtcgaaagcatacgactcagcagattttcataaagtgagcacacccatgtactagcacccagatgaaagagcagagcactctcagccctccaggagttccagtcatctccctccccagtcactgccccctcctccctaaggttaactgctcttctgacgtctctctccattcttctgggagtttccttcccatcctattttaatccactcatattttaagcatcatggggtttgtggctaaagttagaaatattctatatattccatcttgcagtagaggtggcagtggttgggagaacacatttcctagagaagagaaacaattgaggatggggggtttagggggtacttgctttagtttccccacattctctttgccagtaaacctaagtaagcttcaaaccttgactccatcccctccccaccaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggtttgtcttaattcagcaactcaaacaatcgtttacaaagacctgcactggaagccggttctcagctgctgaaagaagagaaagggaaggaggctgacagaggagaaagtcagggcaggaaaagcaggaaggaagggggtgttgtggataccatggtggaaaaccagaaggaagcatctgcggccgggcagaggtggggctgagttctggccccacctgagctctggggagagttctactgccagcggaaggctgcatggatgactctgtcaagtagctcaacaaacaccttaggtgggagtccttgcgttttcattttattcctttgggtgtctctgaagaactcggagactctgtccctattcagggtggccctgctggcttgtcatgctgttaagtaccaggtagtttgggaaagaaacaaactcttctgcctttgagactaccctcaattaatgttttgggatggcttttttgctgtgggatttctagaggtgtcaaataaaagtgtgttctgagtggagaatttttaaatttctcttttttaatttttgctctgtcaccccagggtggagtgcattggtgtagtcataggtcactgcagccttgaactcttgggctcaagcaaccctcctgcctcagcctcccaagtagttgggaatataggcaggtgccactacacccagctactttttaaattttttgtggagatgggggtctcactatgttgcccaggctggtctcaaactcctgggcttaagcgaccatcccacgttggcctcccaagatgttgggattacaggcatgagccactgggctcagcctaaaaaatttcttatgataaaggaggttaaatggacctaccaaggacagtgttattctaggttctccatagagatctgggttcaagtcccacttctgccaccactatgtgacatgaacctccctgagcctcagttttctctactgtaatgtggaaataatactggagaagttgagaggattaaaataaattacatatggaaagtgcctagactagtaattggcagtcagatgatgtgcaggaaatgttagttctgcccctccgtattctgttttaggacctgtgaagtcaacttcatgtaaaagagtgctctctgcacagaggtctgaacaaaggaggttttctctctgtttgccatcggccagaatgaaatctctaatacaatggctgaaagcctcggaaatgacccactccctaaaactggagaggcagcctaagatcagtacctgtgtatgccatcccccagagtgctaagagcagtacctgtgtgtgccaccccccacagagtgctgttcatcagttactcatgatgatggttactgaatattgactccgctaatgtttatcatgcatatgttttgaatgtaggttagaggggaaagctttcctctggaacctctagagataagagctagatgtatttattatctaacaaggaaagtctccattggccctgactccagcatttactctgtttgctaatatgattatttgtggcttctgggcaagtgatcttcccacctgcaccgataaacaggcgactaccttgccccatggaaaaatgttgtcctatgaaggttagcttttatgagtctcctgactgcaacttaaagatacccttctttgaggctggatagagtttttttttttttttttaacgtatcttagtgtgagctcgtgaaggatggtacgtgatgctcttgtttcccttgccgataggaagttctttgctggtggagtgtgtagaacaaatgtgcagcttcctggcaaggtagtggtgatcactggcgccaacacgggcattggcaaggagacggccagagagctcgctagccgaggtaagtgtttcccctttagtctccaaagggccatgcctcccacccttcttcccactggggcctctgtccatattgctttgtgtttcctcctaggcttgggggctctgactagaaattcaaggaacctgggattcaagtccaactgtgacaccaacttacactgtggcctccaataaactgcttctttcctattccctctctattaaataaaataaggaaaacgatgtctgtgtatagccaagtcagttattctaaaaggagatactaagtgacattaaatatcagaatgtaaaacctgggaaccaggttcccagcctgggattaaactgacagcaagaagactgaacagtactactgtgaaaagcccgaagtggcaatatgttcactctaccgttgaaggatggctgggagaatgaatgctctgtcccccagtcccaagctcacttactatacctcctttatagcctaggatatgaacatactgctctttttttgtcttggacccaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcaggtgaggtcctgatgggtaggtagaaaagcaggaaattgggtatgggagtggctgctccaccctagaccatctatggcccttacatcagaaccatcatccaccccactagacaggttctgccacatgaaccagcaggacagggaattggcaagaggatggtgggtagatagactgggcaggatccttatcatcttttcgcctcagcaatgggaatgtcggaggtgttagctccctgtctgggcttgcaccttggcatcaaggtgtggccacaatgccactctcttctttcatcctgagaatcaaccttgtgtggccataggcatgagatgaagttgtgctgctggcaagttcttctggatcttggaaaatgaccagcttctaccacggactatgaaatccatgagggacatcctgggaccatgtctggcttgtgttaccactggattcctagtgcccagcagagtgcacctggctcagagtcggtagttagtacacatttgctgaataaatgaatgaacaatgtccaggaagatatgagtaactaaaattactcattagaaacccagtgacaatgcttattggatgtcactgagataggtccaaatgaaggatagttattgagtgctgaggcaataccttgttttaaaaggaaggggcagagcaagtgactcctatcaaaatgttaccccaacaaagacaactaatgaacaaagggaaagggcaattatgcaggtctgttacaggcagctaggggactccttgctaaccataggatctctttggttgtgccctatagaggaaaagcagctccatattctgatcaacaatgcgggagtaatgatgtgtccatattccaagacagctgatggctttgaaacccacctgggagtcaaccacctgggtaagtatctttgggtgactaaaaaatgaggtacacccactatcttttctttaggaagatgacactgtgtaaatgtggagaatgtccaggggccttcatagagcctaggaattccaatagactagacccattggcttgttgttcactgtacctctcctgatcagtctaaaaaagtgagatcttcctacccataccattaagaagccccaaatttcaggaaataccagggagaagaatgtcattcttggatggggcagtggcagtacaaggcttgccaggcagggccagacctggggttatgcaggcatctgggcttggctggaggggtcacatctacatgatggccaaccaagccatgggttggtccacggaggtaggcaatccttgagaacttgagtacgaggcagggtggggttcagcgttcaaggcaaagactttagggaggagagcatggagcatgttttctgatcctaagcaaatgttatcttccctgactgttctatccttctgcctatacacaagtgtacctgggtccctagttatgcgatcatggccagagtgggagttggaagccagcaggtgggtcaagggcagaggtacaaagtaatataattaagtatgattgccttacttgtagtctagctctggctcttgctttgaggaatccacaaactcagaccaaactgaccattagagttactcatggcatcaaaattggttcacacccagaagatagtgagctaacactgaagtcctcttggctcccacatgctgagcctgggctgtcattccactttcaatcttccctgctggctctcctcacaggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggtaagtctggagaaagaggaatagcaaaaatggtcctcagaccaaattagaggtccacagcaacttgggaagtcaggctgtcaaacatgcacgtgtcagtaatatctctgtggactaaggagaatgaaattatgaatggaataaaaacagagtgcttgcccccagggagcttaaaatcaaataggggttaagaacctcaaaaagttaccttgtatttgtgtcacatcttatctcttatctcatttgattttcacagtagctttttgcaacagacagaggctttttgttttttttgtttttttttttttgagacttgagtttcgctcttgtcgcccaggctggagtgcagtagtgcgatcttggctcactgcgacctctgcctcctgggttcaagtgattctcctgcatcagcctcttgagtagttgggattacaagcacgcaatatcacgcctggctaattttgtatttttagaagagacgagctttcaccatgttgtccaggttggtctcaaactcctgacctcaggtgatctggcagaagaggcctttggtaacaggtattattactcctagtttatagagcagagctgaggtccaaggaaatggccagctaaagagtatatggcaggtgagggcatcagaaccggaatgtgggtgctcagctttaaacctagggtgcttccttctgggtgccatttgctgaggtccacatggtgatctgagctacagagctgccactgcctggactcagggagttagggctggatttcagacccctgggtccaagttcttgctctaccacatgctagccgcatgtggatgtggatgtggatgtgcccctttaacctcccctgacttcatcttctcagctgtaaaatcaggtcaggctggttcttattccttaatgattctgtgctctcctggagcactgggtgagctgctggctctgacatctgcggatctaggggtccatttgttacagtgaataagccagagtttgggaacaatgatcttcacttccagaatgcctacagtagaagaagacggtaatcataaaaataaacaataactattacaataataattgagaggtttatgtgtgccatgtactacacatcttaactcatttaatacttgcaacattcctgtgaggtgggtgctattattttcccccactctaaatatgaaaagacaggcactgacagattaagaaatttgcccaaggaaggttcctagctgagccaggattcaaatgcagacagtccattccatgtttttaactttacatcagagttcagaccttggccctgcaccctgccaggtataaccttaggcaatttacttaaactttctgtgacttagttttctttgttgtaaatgggtatcataacataatattctattttacaagcctctttaagaattaaatgaaataatacatttaaagcatgttgtatggccctggcacataattggtactgaaaaatagtgaccgcaccagggatatcttgtggggggggggtgttaatcccccacaatctgcatcaccatccctcaatctatacctcatgaaatgtgcttgccaggcaaatgcagctcaaaataaagtcctacccaccaccttccaatcagatcgctacccctaaactcctcctttagaaatgataaagataccactgtcaatgattgatactactcactacatgttgtcatgtttattagtagtactaaagccacagtataaaaacgacattgaaatagaaggacctcgaaccaggcactccttttggaacatagaaggctgagaaggctatagatctttctgaaagatcaattcattcctgttcaaattccgcctggccaggagtggtacctgctgaatcctggggttatgtttcctgagtccctccttctcacttgtgtattttgctgcaggagataagctgttttcctgggctcagagtgtgtccctgatctaattgtgccctctttgtcccaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcaggtgtgtgaaggcaatgcggttctctccaccacctgtgtgcatgggaggtgccggactcgctgggctgttcatcctgagaagctgagtttgtgcctgatgatgcaatccaggtttgggttgggcctgcaaacagaatgccgttgctttgttaaggaaacttacagtacaaacttatgtgttgggaagagttgcttttctggctttattttatactcgtgtgccgcttttccatgaaaactttgcagctttctgaaagcttttaaagaagactgtcgctgttggttatgccatggagatctggatcgtttttctccttctttaagcttttggctcacttgattcatgaatttttaaataccaattagcacaaagtgctaggggaacgtcctctctcttcggtgtgaactctgtccctcaatgctgccaagattggcactatctgttgaaatatagaagtagaaattttagtgctgaatcttatcatgaactcaatgagcaactagagtctgggagtaaagggaagcccagggtgaaatctctttcccattccatgacagaatccagccctgtctgctctgttgtcccgctttgttcaaggcttttcatcagtgcagtatttattccgtgaagcactggaaatagtcttagtgtctgatgagaggggaatggataagtgataatagctaatgttgcttgagtttttataatgtgtttggtactcagttctgagtgtgtaatgtgtattaattcatataatcatcacaaccctgcgaggcaggtaatattaccccaagttttcacatgaaactgaggcgcaagataattaagaaacttgctcaaagtcatatagcttataagtggtagatctgggatttacgccctggcaatctggctctagagctgtgccattcagtatggtagccactagccacatgttgctattgagcacttgaaatatggctagtccagattgagatgcactgtaagtgtacagtgcataccagatttttgaagacatacaggttgagcatcacaaatctgaaaattcggagtccggaatatttcagtaagcatttcctttgagttgcatgttgctgctaaaaatgttttggatttcagagtatttcgggttttagatttttggggtttgagatgctcagctggtaagtacaatgcaaatatttcataattcaaataaatgtaaaatcctaaatacttctgatcccaagcatttttttttgagatggattttcactcttgtcactcaggctggagggcaatggcttgatcttggctcactgcaacttcagcctcctgggttcaagcgattctcctgactcagcctcctgagtagctgggattacaggtgcccgccaccacacctgactagtttttgtatttttagtcgagatgggctttcaccatgttggccaggctggtcttgaactcctgacgtcagttgatccacctgccttggcctcctaaagtgctgggattacaggcgtgagccaccgcgcccagccccaagcatttctgataagggatgctcaacctatagtataaaaaaagaagtgtaagttatctcattttatatttttaaatgagataaaagatatctcattttttatattgattgcatgctaaaatgattttgctatttgtgggttaaataaagtacatatttattaactcaataaatgaatgtgtaattaaatgttactaaataaatttcaccaatttctttttacattttaaatgtagctgctagaaaattcaaaatgacatatgtggctcacaattgtgtttctcatcatatttctttctttcttttttttttttttttttttttttggagacatagtctcactctgttgcccaggctggagtgcaatggcatgatcttggctcactgcaacctccacctcctgggttcaagggatcctcctgcctcagcctcccgagtagctgggattacaggtgcatgccacgacgcccagctagtttttgtatttctagtagagatggagttttgccatgttgaccaggctggtcttgaactcctgacctcaagtgatccgcccacctcagcctcccaaagtgctgggattgcaggcgtgagccactgcgcctggtcttcccatcatatttctattggacagttgctactctagagtctgagtgtttaacattgctgccttaaatatgtaataaaatatacagtcattaaatatcatattttaatataatatgtaattaatataaaaatgttagtgatataatgttgtaaggaaaaaactggaatacaaaactatatgattttttatacatagagaacagtctggagggataaccagccactgggcagtagtggttacttccagggagttttagggagagccaagcagagtgtgaaggatgatttttatctttttattctaggtgtttttttattatttaaaaattttgccaggtgcagtggctcatgcatgtaatcccagcactttgggaggctgaggtgggtggatcacttgaggtcaggagttgagaccagcctggccaacgtggtgtaaccccatctctactaaaaatacaaaaaattagctgatcatgttggtgggtgcctgtaatcccagccactcaggaggctgaggcaggagaatcacttgaacctgggaggcggaggctgcagtaagccgagatcactccactgcactccagcctgggcgacagaatgagactctgtctcaaaaaaaaaaaaaaaaaaaaaaatttaaggctgggtgtggcggctcatgcctgtagtcccagtactttgggaggccaaggcaggaggattgcttgagctcgggaattccataccagcctggacaacaaagtgagacccccatctctactaaaaatcaaaaaattagcccagcattgtggtgcatgcctgtagtcccagctactcgggaggctaaggtgggaggatggcttcagcctgggaggtcaaggctgcatgatagtgccactgcactccagcctgggtgatgaagtgagaccctatctcaaaaaaaaaaaaaaaatcctcctcaaactagatacagtatgatcccggttttatgtaagagagaaagagagagagagactatatctctatttatatccaaacaaagcaaaaaaaaaaaaaagactgtacagaaagcaactaaatgatagacttttcttttttttgagacggagtttcggtcttgtcgcccaggctggatttcagtggcgtgatctccactcactgcaacctctgcctcctgggttcaagccattctcctgcatcagcctcccaagtagctgggattacgggtgcccaccaccacacccggctaattgttttttgtatttttagtagaggcagggtttcgccttgttggccaggctgctcttgaactcctgacctcaggtgatccacccacctcagcctcccaaagtcctgggattacaggtgtgagccaccgtgcccagccgtgataggcttttcttcttttatcagcactgcatgttccgaatgttttacaggacttttataattagaaaaaaggaacattaaaaacaaaaaacatggggggagcggggagggatagcattaggagatatacctaatgctaaatgacgagttcatgggtgcagcacaccaacatggcacatgtatacatatgtaacaaacctgcacgttgtgcacatgtaccctaaaacttaaagtataataataataaaattaaaaaaaacaaaaaaaaacatgatgagaactgtgttctgctcccaccccctatccctctagtcctcagggcccctgctcattccaaagcaaatctggagggcttggtctggggttcatggtatgcaagtgcatctgtccccagaattcaagaggcctgtgaacttggatgggaaaataacttcatctttaatttaacctccaactgagatttggcattttcttcaattacgaatgtaggcactgaactgtagtagtagtagtgatacctgtgactttgtcaccaatagaattataaatatttttatatcacattgcagttgttgcagatatcctagaatgtcacttctgctcgccactactttgaaatcctttgattattagacctggtactagatcttgttatagaatatattaataaataagcctgtgtattactatatcacaaatttgtttttaaaatatttttggagtgcattttgtataattagtttctttgagtctggcatatattgtattttattcatttagaaacattctgagaaagggaccataaagatttccagactgctaattctcattcctggaatttactgtctttctctgccctccagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctca

SEQ ID NO: 34804 - DNA, 4383 bp, Homo sapiens
cccgggagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 34805 - DNA, 11825 bp, Homo sapiens
gagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcaggtaagtcaatacctggggcttgcctgggccagggagcccaggactggggtgaggactcaggggagcagggagaccacgtcccaagatgcctgtaaaactgaaaccacctggccattctccaggttgagccagaccaatttgatggcagatttagcaaataaaaatacaggacacccagttaaatgtgaatttcagatgaacagcaaatacttttttagtattaaaaaagttcacatttaggctcacgcctgtaatcccagcactttgggaggccgaggcaggcagatcacctgaggtcaggagttcgagaccagcctggccaacatggtgaaaccccatctccactaaaaataccaaaaattagccaggcgtgctggtgggcacctgtagttccagctactcaggaggctaaggcaggagaattgcttgaacctgggaggcagaggttgcagtgagctgagatcgcaccattgcactctagcctgggcgacaagaacaaaactccatctcaaaaaaaaaaaaaaaaaaaaagttcacatttaactgggcattctgtatttaattggtaatctgagatggcagggaacagcatcagcatggtgtgagggataggcattttttcattgtgtacagcttgtaaatcagtatttttaaaactcaaagttaatggcttgggcatatttagaaaagagttgccgcacggacttgaaccctgtattcctaaaatctaggatcttgttctgatggtctgcacaactggctgggggtgtccagccactgtccctcttgcctgggctccccagggcagttctgtcagcctctccatttccattcctgttccagcaaaacccaactgatagcacagcagcatttcagcctgtctacctctgtgcccacatacctggatgtctaccagccagaaaggtggcttagatttggttcctgtgggtggattatggcccccagaacttccctgtgcttgctgggggtgtggagtggaaagagcaggaaatgggggaccctccgatactctatgggggtcctccaagtctctttgtgcaagttagggtaataatcaatatggagctaagaaagagaaggggaactatgctttagaacaggacactgtgccaggagcattgcagaaattatatggttttcacgacagttctttttggtaggtactgttattatcctcagtttgcagatgaggaaactgagacccagaaaggttaaataacttgctagggtcacacaagtcataactgacaaagcctgattcaaacccaggtctccctaacctttaaggtttctatgacgccagctctcctagggagtttgtcttcagatgtcttggctctaggtgtcaaaaaaagacttggtgtcaggcaggcataggttcaagtcccaactctgtcacttaccaactgtgactaggtgattgaactgaccatggaacctggtcacatgcaggagcaggatggtgaagggttcttgaaggcacttaggcaggacatttaggcaggagagaaaacctggaaacagaagagctgtctccaaaaatacccactggggaagcaggttgtcatgtgggccatgaatgggacctgttctggtaaccaagcattgcttatgtgtccattacatttcataacacttccatcctactttacagggaacaaccaagactggggttaaatctcacagcctgcaagtggaagagaagaacttgaacccaggtccaacttttgcgccacagcaggctgcctcttggtcctgacaggaagtcacaacttgggtctgagtactgatccctggctattttttggctgtgttaccttggacaagtcacttattcctcctcccgtttcctcctatgtaaaatggaaataataatgttgaccctgggtctgagagagtggatttgaaagtacttagtgcatcacaaagcacagaacacacttccagtctcgtgattatgtacttatgtaactggtcatcacccatcttgagaatgaatgcattggggaaagggccatccactaggctgcgaagtttctgagggactccttcgggctggagaaggatggccacaggagggaggagagattgccttatcctgcagtgatcatgtcattgagaacagagccagattctttttttcctggcagggccaacttgttttaacatctaaggactgagctatttgtgtctgtgccctttgtccaagcagtgtttcccaaagtgtagcccaagaaccatctccctcagagccaccaggaagtgctttaaattgcaggttcctaggccacagcctgcacctgcagagtcagaatcatggaggttgggacccaggcacctgcgtttctaacaaatgcctcgggtgattctgatgcaattgaaagtttgagatccacagttctgagacaataacagaatggtttttctaacccctgcagccctgacttcctatcctagggaaggggccggctggagaggccaggacagagaaagcagatcccttctttttccaaggactctgtgtcttccataggcaacatgtcagaaggggtaagtaccctgtcctccagggctctcctccacccaccttccctctcttctctctcttccctctccctccctccttacttctctatcttatgctctgcccgggaatataggcacacacttctataacccctgtgtgggtcctgaccccacaaaaggaggaggcttaacaatgaccttgggcaaaagaactgaaggtctgagcaggcccatttccctggctggctcaggctgatgcggttggctgttcctctttttcctttctctgcccaggtgggcacgttccgcatggtacctgaagaggaacaggagctccgtgcccaactggagcagctcacaaccaaggaccatggacctgtctttggcccgtgcagccagctgccccgccacaccttgcagaaggtgaggtggctgacagtgcggagaggagcagcctagggaggcaacatgaggggaacatgactgcattctctctcctgtgaaaagggtccagcctcggcactccagatcatcctggacctgatagactggccggttctaaggtccttcctggtggtcacggctatggcagcaactgggttgaccagacacccagccaggccagcccaacccaagactacagcccagagcctcggaactagggccctctaaactagactcaatatgagaagcattggtttggaaatggccccggggaacaaggatccaactgctgcccctgctagacaggcaagagacttgagttccagaaccagacctactttcagcttgctgtgtgaccttaggcagattgctttccatctctgggtcttgccttctgtatctatgaaagacggttggtggactagctcagaggtgatcagattgtgctctgtggaggctgacagagctgtcttagggctgctggggaggatgagaagtggctgagctgagcctgggcacccagcttccatctctgcttccttgggcatctcaagggaaaggtgctattagctccttcacactttactccccctcctttcccttccctcctcatgctgtccaaggagagagctgcctgaggcgcacggaggagttctcctgacccagcagaggggaggaatgtgaggctctgggcaggaggcaggctgccatctgccagagagccgtgtttttgaaaaaatcagaatcaagcctgggaggcagcagagtgaaatgatggaaagaggagtcccagctccactcctttctctctgggtgaccttgagcaagaatatcttcacctttatgagcctcagtctgctcatctgagagctggggataagaacacctaccatgatggtctgtggcaaagattaaaaaacacagtgcatttaaaggacttagcaggttgctaggcaaaggctcagtgagtgtaggcagtcatttttagaaacttttagactgttggccatattctgcaaatatgcgaattctctccacacacaacagtctcaggtgttgccagtgcagatgctgcccctggggcagaaaagcaaagctgcggctgcagacccctgggcccccttggctggtctagctctggcaggagactcatcacctgtgtgtcctgcccctcacccgcacctaagtttaacttcatgcacaccccaccctgttctaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggtgaggccagtgcttggagggacggccctgggaagacgggaggccatgaggatgctatccgctctcatcctggcactgaacaggcctgcttccatactgtgggcaagtcagtttctctgagcctccacatccttacctgtaaaatgggtcagctctgataatgagcgaacgaatgaatgaatgaagtgtgtcaggagcagatttctggaggtctgagtcctctcaactctctcccagtcttgggattcaatgagtaaaacttgggtaccccatttgggtgacgaggggaggaatttcccctccagacccccaccatgagaacctaagctttggctctggaatgctgcaggaaggtggatagtgcctctctcagggcagttacctaagcctcatgtgcagtggaactgaagatggtgtcagacctgggaatgaaccccggggacagaaccgctctggcactgctggctggatgaagacaggatgcctcaagaaatcatcggccggttgcggtggctcacgcctgtaatcccagcactttgcgaggccaaggcgggcagatcatctgaagtcgggggtttgagaccagcctgaccaacgtggagaaaccccatctctactaaaaatacaaaactagccgggcgtggtggcgcatgcctgtaatctcagctactggggaggctgaagcaggagaatcgcttgaacgcaggaggcagaggttgcggtgagctgagatcgtgccattgcactccagcctgggcaacaagagcaaaactctatctcaaaaaagaaagaaagaaaaaaaaaaagggggtggttccctcaagaaatcgaatcttgggcactggtggacggaaatggggtctgagtgggccctctgcaggctaatgattttccttttcctacttcttccttctccaaatggtaattcagggccatgctgtgccaagaactgttttaggccaagggatgcagtggagacaaaacagacaagttccctgccctggtggaactcatattctaatggtggaaacaatacatccaataaataaagtaaaattatatagggttaaataatggtaaggaataaggaaagaaattaaggaggtggatataaagtcttgaggggctgaagttttagataaagtggccagggaagtcccagtgcaaagggaattttgaagaaaaacccgaaggaaatgagatatctgtggggaagagcagccagggcagaggcaacagcaaagacaaaggccaggggttgggaggtgcccagagtgttccagagcagtgagcaagttgatgtggcagtctcttggcagaggtgcccaggtcctctaggggctcaaatttggtggtgcaggccacagaggtggggaactgctcaggatgggtaaggatggtgtttgtggaccgtagaggtgctgctggaatcaggagctctgtgtcctgcttggggtttggattttacttgggagcttctcctcagccctgtgcacacctcaccactcagcttatcctgtgcccagctgaaaaatctgtgtcttgtccccatggggaagaaaataacaagtaatgattatcctcatatttaagactatgcctcatgtttgcccaagcttatgatgatgtttacaccttgaatctcatttgattgccacaacaatttggtgagataggccactatctagactatctagaatagataggtcaatatcgagatcccattttttggagaggaaacatggggctcggataggttgagtagccagctcggtcacacataggacctggcaggaggtcaggtctctgagtcccactaggagggatggggtagggatgggatggctccctgagggggttcctctgctctccttcctccaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgaggttagtgggggctcgcctggctcccaccctgtgggctgggttccctccctcaaccctggcctctactgggccctcattcctggttctccaggaggcaaggtctgtagagggggaaaggtgggcagccacctgccacctagccctttccaggcagggagagaattcctaggatgtgccagggcagctggaaaacccagtagctttgcaggtggagcttgatggtcaataatacatggctcttcctgggtatccctgccaagtgccaagtgggggtaacagctgtgtgccatgagctgggggctgccctgccacatgctaaatgctgagagcaacagagagaacagggattagtggactataggctggaagagattctggaaagcacaggttccaatctatttaggagcccgagttctttgtgctcgcaaaattgtgtacgcaattttgcttgtctgagccgttaagggggctgccccaagttggggaattagggtttgtcttgggagaactttggcatgcgccactgagcctgaaaaagattcctttaatttaaaaaaaaaactgctacaaacttattttattttatttatttatttttgagatggagtctcgctctggtcacccaggctggagtgcagtggcatgatcttagctcactgcaacctccgcctcctgggttcgagcgatcctcaagcctcagccttccaagtagctgggattacagacgcacgccaccatgcccagctaatgtttgtatttttagtagagacggggtttcaccatgttggccaggctggtctcaaactcctgagctcaagtgatccgcccacctcggcctcccaaagtgctgggattacaggcataagacaccgcacctggcccaaactaattttagataatgctatctagttgtgccaacacaatttattaaaaagtccatcttttttcaatgacttgaaatgccatctttatcatgttttatattttcgtatgtgcttggtctatttctggactttctattctgttccattggtctctttatctattcatactccaatatcatactgtttcgatgatagagattttgtggcatgtttaatctgttagggctagttttgtccttagtgatctgctttttggggggcttttctagctacttttgcatgtttatttccccctatgatcttcagaattaatttgtctagctttaggagaaatattaggagtatgttttggggataatattaaacataaataacaagcttggggagagctggcttctttcagaatgtcacattcctggccagttgtcctatccacaaatgtgagatgccttctgttttcttcaagcctacttttgagttttcaggagtgttttaaagatttcttcataagctatgactgtgctactgcacttcatctggggggacagagagagactctgcttctgaaaaataaaaaggttttaaaaattttttcctcacaacgttgtgcacatttttcattaaatttgtcttaggtattaattttgttgtcattgctaaaaatggggctctttcttccattatatcttctagttggttattgtttgtataaatgaaggttattgtttttgttttttaattgtatatccccctattttactgaactcttttaaaatttatgttagttttataatggattctctggggttttctaagtatactataatactatctgtaagtagaggagatagtttttcttctccctttccacttcttatgcccctgatttttttttttttaacaaattgattgcattggttagtactttcaatatagaattaaatggtggcagagatggtgaagtctttatctaattcctgatcttagtaaggatgcctctagggttttcccatcaaataagacactggctgtaggactgaaatgcacacctgcctatctgtgtgtattaaggaagagacttaaatatatgttttttcttattacgtaagtgatatctactcattttagaaaatacaaaaaattggctgggcgcagtggctcatgcctgtaatcccagcactttgggaggccaaggtgggtggattgcctgaagtcaggagttcgagtccagcctggccaacatggtgaaaccctgtctgtctctactaaaaatacaaaaattagccaggcatggtggcaggcacctgtaatcccagctacttgggagactgaggcaggggaatcgcttgaacctgtgaggcagaggttgcagtgagccaagatcgcaccactgcactccagcctgggtgacagagcaagactccatctcaaaaaaaaaattacagacaaatttaaaatcatttgcaattctactacctagagagctctactattgacatccttccaatcttttcatacatgtatgcacgcacatacacacacacacacacgcgcacacacacacacatttttctttttttttttttttttgagacacagttttgctcttgtcgcctaggttggagagcagtggcgtgatctcggctcactgcaacctctgcctctcaagttcaagtgattctcctgcctcagcctcccaaagtagctgggattacaggtgcctgccaccatgctcagctgatttttttgtatttttagttgagatggggtttcaccatgttggccaggctggtcttgaattcttgacctcaggtgatccacctgcctcggcctcccaaagtgctgggattataggcgtgagccaccgcacccagcccacacatttttcttacaataatgggattatattctacaataatatatcatgcacattttcctgtattattagtcttctgtattgtttttaattgttccagagtattccatggcataaatgtaccataatttcaccagttcccattgttggacatttaggttgtctccaatgttcccactattgcaagagtactgggataaaccttctggcctctaagcatggatgtgacatttgaacttgttttcttggtatacattcacagaagtggaatgtccgagatcaaagcctgcagcaaattaccccagtgaagaatgtaccaattagctctcccctcaggacctcaagccttaattattgttgcgggttagatcttacagcctgttctctctgtgcccaagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggtgaggcttagagttctgtcgcacggcagcctcccacagctggggaggctgagaggctgggcctcctttcatggtgcttgcagggaactgagaagttggaccacctcgcgccataaagagcagtgacagccacagtcccaaccataagcacctgcatagtgattgacagtttgccaagtattccctttcattcttccatcgactccttgagagcattctctccctccttccctgcttcatttttcaaacctggaaacgaaggctcagagatttaagagacatctcgaggtcacacagcaataaagcggcagaggccagacttgaacctgcatcttctgacctggaatcccatgttgtctgtccacatatgtcgcactgcctctctttgaatgtggattcaccccgagaaagggattatcactaaccctctgataactcactcctatatgtgctgacatgtcaggagtcctttcttagagccatcttagatctgctctgtgtattgggaaaggaggggtgggaggtggaggttgtgggaggggctgatggacaatgagggatgataatactgttcctgtcgtttgtaatagtttgcagtcccttcggcaggcaagtgggtttgaaaaaactcaccaaaaggtcaagcaaggctactttcatttcttttcctaattcccagtttaatttgcatcagcagggagagggttgggtcttatgaatcttggggcttcctccgtgcagtctgggccacagtgagccagggatccctagttgctggcctggaaataggaccttcagtgggcccttctccagggcagccctgtgatgctggacaagtctgttctatgccatgaggagaggcagcagggaatgagtgggagcctctgaggtcactggggccatggggaacggggtatctctctgtcaccgcaggattccttcccagcccggttcaaagccatccacttcatccaccagccatggtacttcaccacgacctacaatgtggtcaagcccttcttgaagagcaagctgcttgagagggtgagtacgtgggccgcccagacaatgagacaagagggctgagggtggggcctcacctgagccctcctcacactctaccatggtcctgagctatgtggatcccactgacacccaacatggagacctgcggagagaggtgtcgccaggcaaagactgcacatgatggggctttgtcctcctgcccctttcctccctcaaccctcatccttagggcacctcctcctgctcagttctgtctcccttgcttccctgcaggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagaggata

SEQ ID NO: 34806 - DNA, 26636 bp, Homo sapiens
gatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcaggtgagagcggacgcggcctcccctgtttcccaggcggaccccttgaggcacagcaggtcagcggggcagcctgccgggggtccagcgccctcagccgcggcgggctcctttccccgccaccagtgctggcctcgcgacacgggacaacccccgggtggaagggcccgagcggtggtcagccgaggcaggggcagcgggctgccggggtgggtgccgttcccagccccttaccttctgctcagttgccgcctgggtctcggttggggaatttgcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagaggtaaccactttatatccttgtttctcaacctcgttattcctacctacccccttcccataaaatttaataccactagtacgctgtgtatttgtttctgtggccacaaaccattgtaatagctagatttcttcactaccaccccaagccaattttttttttttttttgagatggagtctgcagcctctgtcacccaggctggagtgcagtggcgcgatctcggctcactgcaacctccgcctccggggttcaagcgattctcctacctcagccttccgagtagctgggactacaggcctgagccaccatgcccagctaatttttgtatttttagtagagatggggattcaccatgttggccaggctggtctcgaactcctgacctcaggtgatgcgctcacctcggcctcccaaagtgctgggatgacaggcgtgagccaccgcgcccagcctacccccagccaattttagtcccacttgacaatgcgtgctttacatctcctcatttaagtcctgtgaggtagttaccacctccttgtttggcaccacaaggtcgcataagtaataaataggtcaagcctgtctccagtgcacacagcccttgccactatttgtgtaccctctccaaaagcaggagacccagggagttccaggtcgtagaacagaggacaggaccaactcatacctggcagacaggagctgccacactagacccctagccccaggttgctcctgggaagggactgaatgggtgaggagccttcttgaaacatgtgacatctgaatgaggcctggacaatagttagaacttacataggaagggcacgccagacagagcccattgtcaggagatacttcatttctatcttgtagctttcacaagccactagttgtatgtaattatcaatctggttttttttttgttttttttttttaatttgagacggagtttcactcttatcactcaggctggagtgcaatggtgcaatctcggctcactgcaacctccacctcccgggttcaagcgattctcctgcctcagcctcctgagtagctgggactacaggcacatgccaccacgcctggctaatttttgtatttttagtagagacggggattcaccatgttggccaggctggtctcgaactcctgacttcaagtgatccaactgcctcggcctcccaaagtgctggaattacacacacgagccactgcgctcagcctaatctgatgttttttaacattttaattgacttacctctcaatgtcgttttgtctctgctggcatcgttcctccaggggtctcagcctttgaggcttgggaatgtttgctgaccaagtctgtgagtttgagaagctggttaggcctgattctgcatctaatttctggagaaaaaccagactctgtcctgggcaacaaactgaatcctgaacttgaggccacagggcaggtgtgaggagcggagggcagcaagagtgagagggaggcctgtggtcattccatacacgcaggagggcaattcctccaaggtcaggggacagagcacagggatccagcgccaagagcaaggcccccagaggaggccagagagtaggtacggggtcattcccggccggtgagaagggtctcagatgaggcagacctgcagcaggcaaagagagaaccctggaggagacgggccaacagaggtcagacagctggagcagccagggagacttcttgaggagtgtgtaagggagatgtccggagatgctggaggccttggggaaactgaaatcagagtgggaacagggatgtctccacacagaccttacccagagctccccacagtctgcaggaggcccgtgagactgtgtactgaggcagcacggagaccaagctacagaaatccatgccggcctggctgctcttgacccactgttcacctgctgtgtcttgggtttacaggaatgcagctccccatcttccacactaaaccaaggacttgctctggggctcatccctccccgagtcctccttgtgaatgaccccagccagtcctggaatggtgacacttgtcaaataaagtcttgacaggcgcggtggctcctacctgtaaccccagcactttgggaggctgaggcgggcggatcactcgaggtcaggagtttgagaccaggctggccaacatggtgaaaccccatctctactaaaaatacaaaagttagccgggcatggtggggggcacctgtaatcccagctactcaggaggctgaggcacaagaattgcttgaacccagggggtggaggtttcagtgaacagagttcgcaccactgcactccagcctgggcaacagagcaagactctgtctcaaaaaaaaaaaaatttaaatatgtatattaaaaaaaaatgtttttttaagtcttaagggtcagttggtgtcatcagcccttagactcttatcccaggacaggaaaggaaattaatttccttgaggtttataggttcacaatgtcaaatatctgaccacagttttaacaacttttggagaaaaagaatctcaagccagtaaaattgcattctttctttctgctaactaagtttttacaaaaagcaattgaagagggaaaaattctggtctttgttcacttcctcaggggggcactttacacaacccatttatctgctcggagcccgtttcccctgtatatcaaagaaagataagtcctctctagggtgtccctctgaggccgtgatgcaaagccctgaggtcacagctgtcaggtggcagtcctttatgagccatccatgctccagagggcagattgtctacagggagctgagctgattcaacattcccctgaacttctctcttgctgtttttcttcctagttctgagaaatcgagaaacatgataaggaattggctgactatttttatcctttttcccctgaagctcgtagagaaatgtggtaagtttagaaatgacacgtcaactttgtaaagagggaaatggtggctagaggaaggagtaatctgatctgtttgttgccaagggtttagaatcattcagaccacatgtctctgtctgcctcttggccatgtggccactggggtggtggagcagacccaggtctgggatccaggtgttctgcaaagagccagatagttccacatataattggccttctgccctggtatctctgtacctttctgtaccaaagtgaacagctggttcttaaggtcagactatgcagctgattctcaaagtcaaacggtagagctccaacaacctgggataatatcttaaagactggctcaggctggagcagtggctcacgcctataattccagagctttgggaggccaaggcaggaagatctcttgaggccaggagtttgagaccaacctgggcaacgtagtgaaaccccatgtctactaaaaaataatttttaaaaattagccatatgcagtggctcgtgcctatagtcctagctacttgggaggctgaggcaggaagattgcctgagcccaggaagtcaaggctacagtgagttatgatcacactactgcactccggcctgggcaacagagttgagaccctgactttaaaagaaaaaaaagaagaatggcttatgcctctgccctgtggacctcacagagagagtcttgggtcctgggaaacactggggaagcagaagaggtagccaccctgttgtacccggttctgccaggcacagatcacctgaggagtctgcccagcatccccttgtaagatgagaaaacctgtcccttagagaggggctgaggaacagggtgcaacagcccagcagggctaggggtcagttggaacacaggctgggatggagtttacacgtccttgtaggaggaatgaccttcagtgcaggcctctttgaggcccgtgcccttctagcaattctcccactgcccaaaacatctctggaattccttccataaagagccatgtttagcacttcaaaggtgccaggcccattcatttgatcctcagcttgcctcttgggtcaaatacaaaaatcagatacatatatatatatatatatatatatatttttttttttttttttttttttttgagacagagtctcactctgtcgctgaggctggtgtgcagtggcacgatctcagcccactgcaacctccacctcccgggttcaagcaattctcctgcctcagcctccctagtagctgggattacaggcacccgcaactacgcccagctagttttttgtatttttagtagagatggggtttcaccatgttggccaggctggttttgagctcctgacctcgtggctcgcctgccttggcctcccaaagtgctgggattacaggcatgagccaccgtgcctggcccagataccttaaattcccatttcaagtgaaccttgacaaacaatacaaatcctgcagaggtttccccagagcctagcaccattgccgttatctggcctcttgcatctctgaggaaacatggtcacgtgatcatctcttccaggtttgttaaacaatcagtaatgtttgtagtcacactttgtggataagcaatttccgggaaaggcaggtctttcagaccctggaacctggtgtttcttaatacagacgtcagaaccctgtccccaccctgtaggatcagactttgtaagactgaggctggagcatgtgcgtgtgcctgggagtgtgcgcgcgcgtgtatttgcctgggcctgtgtgtgtgtgtgtacccgggcgtgtgtgtgtgtgtgtgtgcctgggcgtgtgtgtgtgtgcctgggtgtgtgtctgcgtgcatgtatgtgtgcccgggcgtgtgtgtgtgtgtgtgtgtgtgcccagtcgctcatacatactctttaaagccccattagtaatgctaacacgctcccctaggagaaaaacaaaaaatccagctaccaccactccagttacctggaggggaagcaggcccagagagggtagaaggcttccccaaagtcacacagctagaaagtaacaaagctgggacctgcataggatccctgctgcatgagatcactttgcctcctttcctgaatgccattagaaaagaatgggccaggtgctgtagttcacgcctgtaatcccagcactttgggaggccaaggtgggtggatctcttgaggtcaggagttcgagaccagcctggccaacatggtgaaaccccgtctctactaaaaatacaaaattagctgggcatggtggcgagcgcctgtaagcccagctacttaggaggctgaggtaggagaatcgcttgaacccgggaggcaggaggttgcagtgagctgagatcacgccactgcactccagcctgggtgacagagcaattccccatctcaaaaagaaaaaaggaaagaagaatggaagccaccataaaatcaagtcactggaattgaatctccaacctcattctgcccttgctgtttctttcttctctttgctttgggtagtaattatgaaggaccacagatgagatgattggccttcagacttgtctgtctctgacttctctgggtggaatcttgaggcagtgcagcctcatggcaagaacctgggctttggactagacaggcctaagtttgaatcttgccctcaccattttcaagctgtgtgggcaagaaacctttcctcttagaatgctcagtttcctgaaatgtaaaataggaataataatgcctacctcggcctggcgcgttggctcacgcctgtaatcccagccctttgggaggccaaggagggtggatcacaaggtcaggagatcgagactatcctggctaacatggtgaaatcccgtctctaccaaaaatacaaaaaattagtcgggcgtggtggcgggcgcctatagtcccagctactcgggaggctgagacaggagaattgcttgaacccgggaggcagaggttgcagtgagtcgagatcgtgccactgcactccagcctgggcgacagagcaagactctgtctcaaaaacaaaaaaaaatgcctacctctcacttttgtaataattagaaaatgggagctcggtgtatagcagagtagctggtattgggtaggtgcagagtgggagagaggcctataagaattaattttaaaaacctggccaagcatggtggctcatacctgtaatcccaacactttgggaggccaaagagggaggatcacttgggcacaggaatttgacaccagcgtgagcgacatagtgagaccccatctctacaaaaaaaaatttttttttaaacggattctcactcagttgcacaggctggagtgcaatgtggcgtgatctcagttcactgcaacctctgcctcccgggttcaagcgattctagtgcctcagcctcccaagtagctgggtttgtagacgtgcgccaccacatccggctaatttttgtattttcagtggagacagagtttcaccatgttggccaggttggtctcaaactcctgacctcaagtgatctgaccgcctcagcctcccaaagtgctgggattacaggcgtgagccaccgcacccggccaaaaatttttttttaattagctgggtgtggtggtgcatgcctgtgttcgtagctactgaggtgagaggcggcagtggtgggaggatggcttgagcctggcggggtcaaagctgcagtgagccatgatcactctctttaggaggaactcaggatggtgttgtgactcattttgtaaatctgatacaatgtaaagattttagacttggggggccagcttcctaactgcctcccaccttgggctaaaaatatcctgcagttatcatgtgatgataataatagtaacaattatttagcatctgggctttgtggaaaacatgttacaaacattgctacattgtatcttcaccatgactcattcagataggtcttggtattctccccactgtacagataaggaaatggaggctcagagagggtaagtaccttacccatggtcacacagctaggaagtgtcagagccaggatggaactgcgtgactttggagcccaatatctcagttgctgagcacctcagttttctgtggtgctaaagaaggagggaataaacattctctggtctggttcttggagtgttcacaaactcctattttatttttttattttattctattttgttgagacggagtctcactctgtcacccaggctggagagcagtggcgcaatctcagctcactgcagcccccgcttcctgggttcaagtgattctcttgcctcagcctcccgagtagctgggattacaggcgcctgccatcacgcccagctaattttttgtatttttagtagagacagggtttcactatgttagccaggatggtctctatctcctgacctcgtgatccacctgcctcggcctcccaaaatgctgggattacaggcctgagccaccgcgcccggcctaattttttgtctttttggtagagatggggtttcgccatattggctagtctggtctccaaatcctgacctcaggtgatccacctacctcggcctcccaaagtgttaggattacaggtgtgagccgctgtgcccggccctcaacctcctatatgcaaagattgtaggagctctgtagccatgtagatctcccactcaccttgacctccactacctctggcagagccctagggatccagagtctggctggccgcccagcatcactttcagcatcctgtcctgagcagtggctggttgtgggacttgcttatctggcatggtcctcagctctaggcagaattgaactggtggtacaggaagtcccagctatgcaagcccagaagaaatcctcagaatgacctcagaacagtgagcctgaaaaagaagggcagactcgccacagcggcttccaggctctgaggctccacataaggaagggactgccttttgccgctctgagcaccttggcctctgcaagggccaggggacatcctgttctgaggagcccagccagccagcaggggactggagattgtggactgtggggacctacggacttgggacagagcttccatctgtattcacatgtgctgagcatggagaaggcagctctcagggtctgagaggctctgggtagcagagcctggcctggcagggcaagcttcaggctgtgatctccttagaggagacgaggttacagaggaagagaaactaccaggtaggagtattgaggcggagaatcagaggtcaaattgggtaactttaagtttccttccgggccaggtatggtggctcacacctgtagtcccagcgctttggaaggccaaggcaggcagatcacctgatgtcaggagttcaagaccagcctggccaacatggtgaaacctcatctctactaaaaatacaaaaattagccagacgtggtgctgcatgcctataattccagctacttggaaggctgagacaggagaatcacttgaacccaggaggcagaggttgcagtgagcaaagatcatgccactgcactccagcctgggcaacaaagcgagactctgtctcaaaaaaaaaaaaaaaaaaaagtttccttccaacccaagcgtctaaaatttcagatctcaattcatctgcctttgaggggtctgagtgacagggtctgggtggggggaactgggcctggggggtctgagtgacggggtctgggtcggggaaccgggcatgctggcagcctctgccgttgcaaagacgctcctcatcacagtcatgcacctgcttccccgcccggcctagagtcatgaccataaccccaggctgtgtgtaaccctgaaggcaatcaggcaggggaagtgagatggcaggtgtggcatgagccttccagtacccctgggagcagaggctgggacggggctgcacaaagaatacaggaagcacacaaagagaggcttactcagtccggtgctctgggctagttggccttgcaagagggttttctttcttttttttttttttttgagatggagtctcgctctgttgcccaggctggaatgcagtagcgatctcagctcactgcaacctctgccttccaggttcaagcagttctctgcctcagcctccaaagtagccgggactacaggtgcatgccaccaaacccagctaattttttgtatttttagtagagacagggtttcaccatgttggccaggacggtcttgatcctctgacctcgtgatccacctgcctcggcctcccaaaaggctgggattacaggcatgagccaccacgcctgcccagttttctttctttttttaagaaaatattctgtagaaacagagtctttctgtgttgcccaggctgatctccagctcctgggctcaagcagtcctcccgccttggcctcccaaagcgccaggtttctaagcgtgagccaccacgcccagccccacgatggttttctaagaccctaagacccagatctgcttcttccctcatctgggggcctgtttgtcaacttgattctgagttaacagcttaatgccaagaagaaatctcagagtgaaacaactattcacccttcctcctccagtaccccgcagatagtcagccccaggaaggggaccagtgccagggtgagctgggttgggaagggaccccaaagggctccttagaaactcattagctgggcccatgtgtctctctgagagtgcaggaaaggggctggcccagttcttcaggaccattttgacttcatgaacagaggagacccctgtgctttcatctgaagaggtggttcacggctgccttttacgctcccaggtcacgctggaattcccctgtaatgatttttgggctccatggttctctaacaatctctggttaactcagccgcagactctcagagcctgtcatcgcagcgggaggaggacgctccggcgtttcctgctcaggcctgttttcctccatctctgtctctggcagcaggtggggaaggaagctaaccagggcctgtgtttgcagtcccatcacagaatagggctcgtcagagagtcagagctcaggagttcagatgtcaggggtttcggcccagttttctgtcacaggcctgaactctgacccagtgcctcatgtcattgatttgggtccttccagagtcaagcgtcagcctcactgttcctcctgtcgtaaagctggagaacggcagctcgaccaacgtcagcctcaccctgcggtaagttcctgggcctggcgctgtgctcagctccgctcaggccccgcagctgggtcagggctgacccctggctcagtctgttcagatttcagatgcgctattcttgcctcttacctgtaagacaagccctagaaaaagggatggtgctagccccgggctgcaggatgggatcgcaaaggctgacccccaccctgagtcctcactttccctggcaggagaaggaaggggtgcttctcccagagacgtgcgtcttttccccgcatgggaagagtcctgtgtgaccggtgttgaggccagatttcaaagcgattctttctaagactaagtatttgaagagagccctgaaggtcaaggggcagggagctgagctgctggttggcacttctgaggttgctttcagaagcaggagtggccacgtcgggtgaatgccgctcatgctgggccttgtctgggagtctcacttgctgccacctgctggcttaggcacaaacgtcgcgacctagtccagtctgtgccagggaggctgcctctgccttctctgctcttagctgctttgtccttcccttgcctcccagccgtgaggattccctgatgaagaagacctagaaccctctccttctctctttatgcctttcccccttcctcgcctctcctgcgagatctggcctgaaagcaaagctttggttccgaggcccctagcaggcctgccattccgctcccagctccttctgtctctgcacaccctccccctgcaaatcttacaagtcatctcttaccacaactgtccaggcccctggagtggcctcccactgcctttcagattaactccaggcctctaaacccagggccagggcccagaagacggcttccagccagcacatctgccttctcccgtcagatgcctctcccagctttccaagtccggactgctccctcctcattccctgcctgagccctctcctccttcagtcaaatgctggccctcacacaaggccccactcagacccgactctctgggaagcctttcccaccggagcagggagccacggtcctgggcctccagatgcctcatttgtcattcacacccaccttgctttcttctctgttctcaccctaccctgaagggacagacacctggtctcctgattaagacaggaaggcctacgggagcacgatttccacctggctacccatcagggtggagcacctagcatttcctaagcctaactgcttgagagttgaaggccagatgtgaaatccagagggttggttgagatctcactgtccagcttctcagcagtaattagactcttgtcctccacaggccaccattaaatgcaaccctggtgatcacttttgaaatcacatttcgttccaaaaatattactatccttgagctccccgatgaagtaagtaaccaatcttaacggatgggtagggaaatgctaggtaacagaacacatttgaattaagagctggtggaaacaggtctcctaggcggcccctgttccatcaacctagaaatctgtgattttggctttgttggtgtcttttggggatgagtatcacatgccattagatggaattaagaaggtgatagtgaggaacctgaggcaaaaatggttctgggaatgtaaacgttcttaccgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccaggaggcggaggttggggtgagcctagatggccccactacactccagcctgggtgacagagtgagactccttctcaaaaaaaaaaaaaaaaaaagttcttacaattttcaaggcctggctgctcaaagggcattcaaggaccagagaattgggcttccttaggaacacagcatctcaggccccatcccaaacctactgattcaaagtcagcacactagcaagatccccaaatggtttgagtccacattaaggtttgtgaagcctcattctgagacaccactggttgggtgtcgtttccaaaaaccagtgccagaggccgtgtgatctaatagcgatcattacccatagctttatgcatgtatctatttgtgtgtaccctgctcccaccttactgagcatttgagccagttgctattcaattagataaaaagcatccacagaggaggtggcaaataagggtttaaataacaagatgaacgcaagtcactcagggcgcataacttctggagagctattgtacaacctggcgatatagttaacaatcatgtattactgcatgcctaaaaactgctaagagatagatcctaaatgttcccaccacagctgggtgcagtggcttgcacctatagtcctagctactcacgttcgtaacaacaacaaaaaaaagataagtatctgagatgatggatattaattagcttgatttagtcatttcacaatgtatgcatacatcaaagcatcacgttatatactgcaaatatatacactttttatttgtcaatgataccttaataaagctggtggaagcaggaggagaagaatgcagggatgagatcagtagccatgaggcacatcaagatgggctgcaaatcagctctgagccccctaggaagcaaacaggagtgaaacacgatcagtctccagcatgtgggaacctgtgatctgaaaaatatagcatcgctggctgcagagatgtgcacctgtaatcccagctacttgggaggctgaggcaggagaatcacttgagcccaggaactcaaggctgcagtgagccatgactgtaccactgccctccagcctgagtgttggagcaagactctgtctctaaaaaattaaaaataaaaataaaatgtttaaaaataacagcattgctgagaggggatctcggagtgtccagctaagaggaccccgcatgagagggagctctccccgctggtgagcaccttgttagtgccatttcccacacctcccctcttgcccagggtgtgaggccagcatgcagagccggtgggttcccacagcacagccctctgatccacagattaaattctgactctgggaggaacagatgctgattgcttcgtttagggccaaacatcgaagtcaaagtgtcatctttttatttttatgtattcatttattttttattttatttatttgtttagagacagagcttcactctgtcgcccaggttggagtaaagtggcgcaatctcagctccctgcaacctctgcctcctgggttcaagcgattctcctgcctcagcctcccaagtagctgggattataggcgcccaccaccaggcccagctaatttttgtatttttagtagagatggggtttcaccatgttgactaggctggtcttgaactcctgacctgaggtgatccacccgccacggcctcctaaagtgctgggattacaggtgtgagccactggcccggccattgattgattgagacagagtctcactttgtagcccaggctggagtgcaatggcgcaatctcagctcaccgcaacctccacctcccaagtttaatcaattatcctgccccagcctcccgagtagctgggattacaggcacacaccaccacacccggctaatttttgtgtttttagtagagatggggtttcaccatgtttgccaggctggtcttgaactcctggcctcaggcgatccgcccacctcggcctcccaaagtgctgggattacaggagccaccacgcctggccaaagtgtcctctttttaaaatcaaaaaagataccaaacaagccttggctgtaggagtccttgaacctgaagcacaaacagatccagcaaatccatggtgtcagtcagggtagcagtgaccctcggggccagcggaggctggaggaagcaagcaggggttccgaggacttgggaatgtttcatttcttcatctgggagctggatgcattcagtctgtagacatttcatcaagctgtgatgtgtgtacttctctacctatatgtcatagttcagtttttaaaaaagtcttcaacagtgagaggctgggcaccgtgggattacatctgtaatcccagcactttgggaggccgaggtgggcggatcacctgaggtcaggagttcaagaccagcctggccaacatggtgaaaccccgtctctactaaaaatacaaaaattagccaggtggtagtggtgtgcgcctataatcccagctactcaggaggctgaggcaggagaatcacttgaacccgggaggcagaggtggcagtgagctgagatcacgccactgcactccagcctgggtgacagaatgagaccctgtctcaaaaaaaaagaaaagaaaagaaaagtctttaacaatgagagtcaaaccattggtgtgagatggcattgatgggcaccaacctaccttttcaggctcctgcctcactggcccttccccacccaactctcaccactcccctctactacccgtgatgctggaagcctctggttagaacatgggagttgagtggtctaggagccaggcctgtgagccttgggtaaggcacttcaccccaatatagcaccgtctccttattcgtagctgtacagtgaataatgtttacttgacagccttgtgaagattaaaagcacaaacaagtataaaatgtctaggattgactgggcacggtggctcatgcctgtaatcccagcacttcgggaggccgaggcaggcagatcacctgaggttgggagctcaagaccagcctggccaacatgatgaaacccagtctctactaaaaatacaaaaattagccaagcgtggtggcaagtacctgtaatcccagctacttaggaggctgaggcaggaaaatcacttgaacccgggaggcagaggttgcagcgagccgaaatcatgccattgcactccagcctgggtgacatgagcaaaactccatctaaaaaaataaaaaatgtctaggattgtccctggcacatagaaagcactcagtgaaaggtagcgattatcacttcattctgtcttgtatcggtcaatcgactgattttctccctgcctagttccagaagggatttagtggccacttaacaaatatgcaagcaacgttgcaaggaatatctgttaaaaataagaaaaagtgagtggcaggaaaataaaagagccaggagtggcacatgttatgaagatgtaccttgtgagacgtggacgtaagttggactccaggctttgctgcagccgctataccatttcagttgtcctgccaaagcccctgatttctgatgctaagaacaagaaggcagtgcttcaagggtcctcattaagaagccactgaaggatgtggtagagcgcctgtagtcccagctactcaggaggctgaggcgggaggatcgcttgagcccaggagttggagtgatcagtgagctatagttgcaccactgcactacagcctgagctacagagcaagacctgcctctcggaaggccgggcatggtggctcacgcctgtaatcccaccactttgggaggccgaagcgggtggatcacctgaggtcagaagatcgagaccagcctggccaacatggcgaaaccccatctctacgaaaaatacaaaaaattagctgggtatggttgtgggcacctgtaatcccaactactcaggaggctgaggcaggagaatcacttgaaccctgggggcggagattgcagtgagccaagatcatgccactgcattccagactggcaacagagtgagattccatctcaaaacatatataataataggaaaccactgcagtctaatgagccagatcctcacggtacctgcaatatgggtggagtattatccagggagcacagaagctggggaccaggggagacagctgggttcagtaaggatatcatcctgctccccatcactgcagcaggatttaagagtctcaggaagcactgggtgcggtggctcacacctgtaatcccagcactttgggaggccaaggtgggtggatcacttgaggctgggagtttgagaccaggctgaccaacatggtgaaaccccgtctctactaaaaatacaaaaattagccagacgtggtggcacacgcctataattccagctactcgggaggctgaggcgggagaatcgcttgaacccaggaggaggagtttgcagtgagctgagatcgcgccattgcactccagcctgggcaacaagagcaaaactccatctcgggggaaaaataaagtctcagcaggcatgcttgggagatcagatgttgtaggcaggcctccgggtactttccttgaagcagagcatttgccaaatattgcagagcagcaagggtgaaaatgccctctttgccaagtgcctcatgtatgtgcctcctctgctttgtcacttggcagccaggctggcacagggcacacatggttttgtggacaaggaggagcccagtgatgatggaagtggaagtgatggtattgtagtatagcagtggccccgtttgccatgcaccaggctctgtgctgtcagctttctgaacatcctgtcattcatggcagccctgaagggtagacacttttgttaactcgttttacagatgagcaaactgagatcagagcttgaataacttgcccaaggtgacatgtccagtaagaggacgagagccatccctccttccctcagagataagccaggggagggcatgaggacaagtccatagctctgctcagaaagtctcacccaggccaggtatggtggctcatgcctgtaatcccagcactttgggaggccgaggtgggcggatcacctgaggtcaggagttcgagaccagcctggccaacatagtgaaagtccatctctactaaaaattcaaaaattagctgggcatggtggcgcacacctgtaatcccaggtactcgggactcaggagcctaaggcaggagaaccgcttgaactcgggaggcagaggttgcagtgagccgagatcactccactacactccagcctgggtgacagagcgagactccgtctcaaaaaaaaaaaaaaaaaggaaagtctcactcaggccaggcgcggtggctcacatctataatcccagcactttgggaggctgaggcgggtagattgcttgagctcaggagttcgagaccagcctgggcagcatggcgaacaggaggttcaagttggctggtgggcgcagcgtctctccttttgcttagtaagctcttggaaggtgaggctgcgggtggtgcgtccctccgttccctagcgtgttgcatagagctagatgccagcggggtcctcggtaactgtacgtggcatcggattgaacctcagtcttcctaacaggttgtggtgcctcctggagtgacaaactcctcttttcaagtgacatctcaaaatgttggacaacttactgtttatctacatggaaatcactccaatcagaccgggtaggctggcctcagggtgtgcgggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcagggcgttccagcaaggctgccgatagcgcagcctccaacgtcccctctacccttctgtctgcctaccctttccagaaagttgtcccagtgcgaaggctcggagagcctgggtcggattcccgtgctgggcgtttcatcccttgcccagctcagcccctccctgggaaagcaggaaaacagggaaaaggggctccttagtttagtggagaatgggcgggggagggagggcagtccatcgtgaatctcctctgcgctgggtccatccgaccctggaggattgcggcgtcaagtcctgtagtctcggtctttgggacgaagctgtcccaccttgacttgcaaagacacaagctgtcctgcagtcaccctggccacgtcggcctcctgggtgatggcaagcagagagccgggagggagacgctttcttccgggggcctcctgactcccctctggagccaggacttgaggggcagggagatcttgggcaggggaggaagggaggagggaagtagctcttcaagagggcagggattaggtggcatccgtggtggtagcaggagggacctaaggacagtaccctgcttgagaagggccgagtcctccttccccgtggcctgggagccctgtccctcccattccccacagtggtgccagtcctcacccctggccctgccatgcccttccacccccgccagccctcaccccctgccctgcccctccacccctcgccagtcctcgcccctggccctgccatgcccttccacccccgccagccctcaccccctgccatgcccctccacccccgccagtccttacccactgccctgcccctccaccccccaccagtcctcaccccctggggtcctcacccctgccctgcccctccacccctgccagtcctcaccccctgccctgccccaccacccctcgccagtccttaccccccaccctgccctgcccctccacccccgccagtcctcaccctctgccctgcccctccacccccgccagtcctcaccctctgccctgtccctccacccctgccagtcttcaccccctgccctgtcttgtccctccaccccctgcagtgtcattggtctgagcttcgacttcgtggctctgaacctgacgggcttcgtggcctacagtgtattcaacatcggcctcctctgggtgccctacatcaaggtacggccttgcctgccctacatctctgcccacatggcgtggtggcccggctgcccctcaccacccagcttctcccacccaccaaacaggagcagtttctcctcaaataccccaacggagtgaaccccgtgaacagcaacgacgtcttcttcagcctgcacgcggttgtcctcacgctgatcatcatcgtgcagtgctgcctgtatgaggtgagaccagccctggccccccacaggccaccccagccaacacccgccaccccacctcacctttgacagaagacacggcagagcctgggaaaggaagggtgtgtgttcattcatccaggtcctgtgctgggcatagaagacacccatgagtccaggccctcagagccccccaagtctggggtgagggactcagggagaggcagtgcctggactcaggctgagagccgtgcacagaggagcacagacagctcatggaggagtgcaaggccctgagccctgccagggaggagggaggagggcacagaagggaggagggaggagggcacagaagggaggagggcagaggaagacgcttggttgggctccaaggatgagtgaagttcctatggaggaggggaggggccagggtgggctcctggaggggtcaggtcacagaggccaaggggcatttgagagggaccctgagcaggcgggtgcagctgggcttcagggtgccaggagggggcccgcgtgcaggcggagacacctgtattcagctttgttgctggaagccatgggtgtcggcagggcagggccccaccaaggctgggtccggggacccctgatatgacagctttgctttcccttctctcagggagttcccttcacactgtaaggccagctgggggctgtctggccccacccgtatgaaccttctaggctttcttagcttttggtgtgaagcgagagtgaaggtggcccacattgggcccgtgttcagggaaaggcaaggcgaggggacagattcctgagatcctcaggctgctgccgggtcgtgggacgagtcagtacctggctgggagaggcaccaggccaccagagttccgaccccacgtctccaagtgagtgctgagaggcgcccagttctgccaagtaggaacaaagcagacagagcttgagagtccaagcagcctgaacaggaggccctggcgatgagaaggtgtggttggtgctggggatgtccagcaccagcccaggtgtgatgctttctgtggtccacatgttcccctgccacaaccccagtgcagcccccaccttgcaggggctccttcaaggccagggtccagcctccgtgcccctctctaagcccgccctatccggggccgtccttgctcagccccggcgtggcctctgtgtgggtccacatctctgccctcctctcgcccccagcgcggtggccagcgcgtgtcctggcctgccatcggcttcctggtgctcgcgtggctcttcgcatttgtcaccatgatcgtggctgcagtgggagtgaccacgtggctgcagtttctcttctgcttctcctacatcaagctcgcagtcacgctggtcaagtattttccacaggtacctccagggccctgttcacatggccggtggcaggagaggtgagagctacatggcccaggccctgctccggtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatcaggtgtgcgggtggttccccttctccacaccccagcctttcctgatgcctttggctctgccctcaccactgcctccatttccacagcaggacactctggagaggtgaggtgggaggagggagccccttcccgcgcagagctcagcccgtcctatgagcatagccggtcctcttcagatccggggactcagggtccagcacatcttgccccacagcctgggacagggtcagggctgaagttgctgcacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacggggcggcagtgaggggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacggggggaaggaaaggtcacagcagtcagaggacccacagggctctgcagcatgggaggacgtggggcacaggcagtcagactggggcgcatccccgcagacccgcccccccaaccagacccaggaagccccggccaggcctgtggggggcgttaaccccgctctacagacggggaaaccaaggctaggagaactgtcacttgcccaagacagcaggctccggtgatggagccaggattccaaaccagaagtcccactcccaccagtccctaagcacatgaagtccaggctgagtttggggacagccttgcctggaggtgagaagaagaatcatagctacagggaaactagcacagggccttggccccagggatgtggaggagacggggaaggccgcatcggccccgcctctgctggagctgtgaggtgtggggggtgcggggcctttgcttgctgtacatgcagatgagacgcctacccccaggaccacccaaactgttccttggctgaggcctgtcatagcccaaaggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacggtgagtcagccagcgggctgctggccaccctgcggctggggcatcgggcggggccagccttcccgggaccttccagccagggctccacccccacctgggatccaagccaatccagcccccaaggagagacccacctaggggccttcgtagctggaggctttgtggttttctgggacccccaccgcccaccaccccacaagctccagctgcctcaggagctgccaacctaacaccagcttctgtcccccggctgctaacagaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagattagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggccaggtcagtctcccaggctccgtgtcttcacggttaccagggcacgccactcaatctggatgtgagccggggtggatgaggttctgaagggcacaccagcactgggagcgggggcagtgggggtcttattctccagacgcttcctctatctagttgtaacaaacgtcaaagaatgtcaggtcttgtttctgcagagcagactttggcctgacggggtccacagacctgtttcacttgcaacacccagtaaatgtgttactgggtgccctactttaaaaatcagagatttcaaatgattgacttttccggctgagtgcggtggctcacgcctgtaatcccagcactttgggaggccaaggcagatggatcacctgacatcaggagttcgagaccagcctagccaacattgcaaaaccccatctctactaaagatacaaaaattagctgggcatggtggcgggcacctgtaatcccagctacttggttggctgaggcaggagaattacttgaacccaggaggcggaggttgcagtgagcgaagatcacgccattgcactccagcctgggcaacaagaacgaaactccatctcaaaaaaaaaaaaaaattattgacttttctttaaaatctgatttggcagtgctaggtaggtccaggagtgctaacaccttcccagaggtggtacgcaggtagtcaggtgctctctgactcacccccatctggccagatcacggcccccagcaacacgtggggttgtgtccctcgctgggatacacggagtgcccttataggcagggagtcttataggcaggggtctctcccaggcacctctgggtgtccctacggcccctcccaggtgggagctgaggctaggttgcaaaaaggaggttgggagcaagtaggggcttcacagtaacacccaagaaagcacacgcaccccagggtcccaccccagtgctcccagacactcccacagatgtggttctggtcaggcgcagtgcagctgctgcggctccaccagccccgggctttcaggcaggtgggcctgggagtagttgagctttgtcccagaacagtgggggatggggccatcattaaaaccacagctctggccccaatatcccaccgccacccccaccccgatatcccagcccatgcctcagcaaagccccctgtgaattccagcatttttattgagcgcaccacatcggggaggggcggcagtggtttccacggtaaccaaagtaaggcttgtgcacttgctgagcttccagatgcgaattagtaaaagctaaattcaaaagtagaatgggcatctccaaagagtacgataaaaacattttgtatcaaacttgtgattaaaaaaatacaaaagttaaaccca

SEQ ID NO: 34807 - DNA, 11966 bp, Homo sapiens
attatgcaacccgcctccccgcccgcccggtggagcttccactcggctgcgggctggagcggcggcgggcaggcgtgcggaggacactcctgcgaccaggtaggcatctctgcggccatcctggggccgatctccgtccctgagccggaccgctgccacttccaatctgatgggctactttcggcccaggcagagggcacactgtcgtccttaccgctacccaccctctccctgcccccaaggaccgaagtcctcctcgaaatcttgcaccgggagtctgcactcctgacccactcatcttacctccagcttgtccccacctccccgtcccagctttcccggccccacagccgactctcagcgggcatgccccggtcttcttgctcgttactcgaggggccccaggtttgccccggtaccaggaccctattaggctttcagcgctccccgtgtctctgttctccagtccctggccctgcgccgcctgtgatgtcagcccacttcggactagaacatcccgttcccagcgctggttcctgctgttggccacaaccttcccttttcccctggcgctcagaaaatgctcagtagtaggggtgtggttggacggggagtaggggaagaaagatctgttggctgttgtgtgtcttctgcccaaggcttggggttggtgggggggtctggccagaaaagtaggggactgaagagagaggatcctcgggtccttgacgatggcaggttgccggcttcggtccttgtggtggggaagcagcgcaggggctaaagaaggaaaggttgtgttgtcttgaccagaatgactgggatccaggcgagagtcaggttgaggggcttttgcgccgagggcagtggccgttgtgcttcgtcctggggaagccaggaccaaccctgggatcctaataggccgtcccacttcttacggccaccgagccatcctgggactggggatatgtaagggatgcgtgacccccccggccgcgcccaccagtgtgagagtgggccgttcccccacttccgccgggaaatgggggaggggtcgctcctcccgccctcctgtggtccctccagcaaccgctgagctcagcagctgacgtcggtttccctggcgaccgtggcggcggcggaagcgcgtggtggggccgcgcacgtcggcgcgcatgtgcagcgggggtggcaccgcccccggataaaattagcctggaggcctaaatataggaggcgaccagctcacctcctgctccgaggccttggaggcccaggcagagtggacacctaatgggaacttgggaatgggaagtgtccaggtttttgtctacagccgtggttctcattgactgctcaggccatggtggcaggggatgtgaaggaaggccccggagaaccttctcccgctggcagtccccctaagggtacaggagacatcctgactccccattggaagccccaggcctgggttccactcccatcagtcctgcaggaggccaggcagggggaaggtctgagtgaagccagcaggtgctctggagttaaaccagctttctgcaagccctgcttcctggtctccctctccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagaggtgtgtatggatgtgtatgttgggtctaggaatggtcttgtgagcaggcagagctgggtgacaggcctcgcactgctggccctacctgtaactgggcctgttgctgtctcctagcacaaactctcagagcccatccccacccagcagttccattgcctacagcctcctgagtgccagctcagagcaggacaacccgtccaccagtggctgcaggtacgtcgggtgaggctggaggagaggtctgggggcccaggccacactctgggactaatgtctttatctctttcttccctgtgggccccgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcagggtaagtggtgtgtcccaagagggaatggcctgggcctgggctcccgtgttgaggcagcctccttactgaatgcctcactgcctccactctgcagccaaccaggaatactaccagcagtggagcctggaggagggcgagccttgctccatggacatgtccacctataccctggaggagctggagcacatcacgtctgagtacacacttcagaaccaggtcagcggcggcctggcctctgcatcccgacgcacccctactccttctcccacagctcttgaatctgctcttgctctccccctcctgccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggtgaggtgcccaagcgctgtggggaggcatgagcagtcccaggaaattcctgctgtgaggggccggggaacccagactttcccttagtggattcttcgcagcctagggaaggggcaggaagctgtgctcactcctctcctgtctgtcccaggttcaggcctcagggactttacccaggagaagtccgtcttctgccgtatcaggtaggtgaggggaactggagaagacctctgcctccttttttttttgtttttgtttttgtttttgctttttgaaagggagtctcactctgtcacccaggctggactgcggtggcacgatctcggctcactgcaacctccgcctcccaggttcaagcgattctcctgcctcagcctcccaagtagctgggattacaggcatgcgccaccacgcccagctaatttttgtattttcagtagagacggggtttcaccatgttggccaggctggtctcgaactcctgacctcaggtgatccgcctgccttggcctcccaaagtgctgggattaaaggcgtgagccaccgtgcccggcctacctctgcctcctcctgccccctccccagcgtctttgctgttgtctgctgtgaccttattgttggaggagtgggtggctctctgttgaaagtccctaatgctcctctctcctttgctagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaaggtgggcaggtcagggccctggcctggtgggggctgggaggaaggacatttcctcatggccagacatgaatttgggaggcatgaaccacaccctttgaattttggaacaagaaaagctattgtaaagatgaggatttgagctcctcttagaggtagagttgaataaggtgcccaagctagaggagggcagagaagaatgccttgcttgctctcagtcatgttactgatacagggcataggattggcccagaccatctttgggcccatagtgcccggggcagagctgtgtggcagatcatcagccagcctgggcccaggcagagtggagggctgaggagttgggcattctggacgaaacccagtgaccacactctctgtgcctcagctccccggataccccctgacaagaggattttcactacgcggcacacacccagctgcctcttccaggatgtggatgaaaggtgaggataggacctagaggagacgagggcagccagggctgaggccacggccactctgatgcctccttcccgttcagggctgcccccctgctgggctacctgccccaggacctcctgggggccccagtgctcctgttcctgcatcctgaggaccgacccctcatgctggctatccacaagaagagtgagttcctctcgccctgctcgcccttcccactgtcctgggcttttgagtggctgcccttgtggttgtgtctcttggtgccttggtctcctggatctctagtggcatggcctccctcttactcagctctccctccctttgaccgctcctcctttcccacttccatcagttctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacgtaagtgggccatgcccccgagctggcgttggggatagggcagtgcggtgggggacaggaccgggccagggctggattcactcttcactctacagggcccccctgaatgaggacgtgttcactcccccggcccccagcccagctccctccctggacactgatatccaggagctgtcagagcagatccaccggctgctgctgcaggtgagagtagcggagagggagcctgggaggtgagaaaaggtgtgggaagccgggtcaagccatctaacctgccctctccctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgagtgacctgctcctacctcaccctctaatcgccctttcccctctccttcttggaaccagcactgccagtcccagagtcttgcccgatcctcctttgccctctccttcctgccttttccttcttgtcctgctcccatcaaggcgtctgtgcctccccactggtaccttcttgttttattgtgcccttggcccctgacactggcgacaccccctggttctgctcactgtggtgctgtgtcccacaggtgactttccagcagatctgtaaggatgtgcatctggtgaagcaccagggccagcagctttttattgagtctcgggcccggcctcagtcccggccccgcctccctggtgagttgatgatgatgtgtgggtgaagagacagacctggggggtcccctgaccttcacccccaacccatttgctgtttttttccatgtgagcttgagaaggctattttcctctttctctctttgccccagctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtaaggcctgccaggcatcttctccacctcgggctctaaccctgcccaccccaagccctgctctgatgccctgtgctgtgtccatccccaggtacctggagagctgcaacctccccagcaccactaagcgtaaatgtgcctcctcctcctcctataccacctcctcagcctctgacgacgacaggcagaggacaggtccagtctctgtggggaccaagaaaggtaaagatccaatgcaccctgctcccactgccccgtcctggcctggtggccctgtgtcttttcccttctgcttctgggccctcttgctctgccctgctctcctccccagcctcctggtctccagactgttccctctgttccctaccaccatccccttccccttttccctgggatcctctctcctgacttcccagtgggggtggggatggtaactggcaccatctctctgcacagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcgggtatgggtgtggaattggggggcagtgcttgggctccaccggtctcccagctagagctccctcctgcctttcccctcccctctagggcctgatggagagaaggaggcctcccttgacctggggcttggggctactgcttcttgctctcccctccctgccaggcttctcggctttgcccttcccctgttctgcttctcgtattgttactgtcagttgaaacacagagtctgggatagagggtttgccctgaggtgctgaccacacagggtctgaaggcaaggaaaattgaacatccctgaagggtctttggatattgaccttgaaaatcatgaggggctgggcatggtggctcaggcctgtaatcccagcattttgggaggctgaggtaggaggatcacctgagatcaggagctcgagatcagcctgggcaacatggtgaaaccctgtatctactaaaaatgcaaaaattagccgggcgtggtggcgcgcgcctgtagtcccagctactcgggaggctgggacaggagaatcgcttgaacccagggggtggtggttgcagtgagctgagatcgcaccactgcactccagcttgggagaaagagtgagactccatgtcaaaaaaaaaaaaaaaaagaaacaagaaaatgtgtgagggaaggccaaggggtgggcttctcttccaatgagagttgtgacggggtcatcccagtagagttcctggcagggagtggccactggaggggcctgagtatcgtctcttcttctgggccagctttgcatggagaggaggacccagggccagccgttggcagagaggtgaccaagaaacgtacatggagaccaggcttggctgtggggcagagctgccaggggttggctaggctatcagacagggagggtgtggtatggatgtgttgacccctgaagtggttctgatgacctttccctatctcactctcctcagacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggtgagcactgacccctgcgtctgcctgccagcccccaccccagccccgcccctctgccaccctgtgctgcctgctgtctctgccaggctggcgtctcagcctccaggaggtggagggagtccccagctgaatttctgaatgaggcagaaattggctacctcctctttgaagggacagtcctgtctgtctgacaggtggtgaggacatctcaataacttctgagagagcatctgtcacttggaaagggtctggcctcacatccccactcttcgccagctttcttctctctcagcctggccctactgtcacgaagtggggagcagagaccactggggttggatgtgcctctccccacaaccagtaagagcagttgaagggaggcctaggtgctgacccctccatccctccttgcccccctcccctcctccaggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgtgagtaccccgcctccagcatctcccagggtagggcagtgattggggagccgggagcccaggccccgtcttggcggagcttcctaaggccactgggatggacatgtggcctttgagggaggccttgtgaggtcccaggagtgggcatgcagccggcctgactcccattggtctgccccccacttcacaggcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccaggtgaggcatttcagaggccttcttggccttcctttcagaggtagtagtgggggcagttttcttttctggggctggctctgccctggataggataaacgtttctatctttcttcctgctccttggagccctgttactagttcctcccaggaggagagcaggtttcctggtcttggaagccttgacctcgcatagcactagtttaggggaggagcatgaggtgggaagctgtggtagaggaaggatgccagcttcatgggtcctggtccgggtcctggatcccagcctctgccttctgaaccccttcttgggcagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggtgagagaagcctgggacggggagaaaaaagaattgagctcaagttcaagggggagaaaaaagaattgagctcaagttcaagggggagaaaaaagaattgagctcaagttcaagggatcgaggccaagagctgatctccttgatgtccttggatcattaattctgaagaatgttgattccactaaatttgctgtggattatagaatattaagccgcgtgagtctttgcagaacttttcacagcctatcctatgctaatatgcattgtgactgtcctgtaacggcatctgggtagagggcacaaggcactgtccaaccttgttggaccgcaggtgcatctgtgtggactggtgcttcttgggagtacatttcgggaagcacagtgggctgggggtgggaagctgcgctggcaggttagcagtgagaaccctgtctgactctctcatgtccatttctctcaccaaggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgccca

SEQ ID NO: 34808 - DNA, 8740 bp, Homo sapiens
gcaggcagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggtagggagggcacaggtggcgacctcctgaggggtgctgggacccccctgcttcagggaggaggccgtgggggtctcacggggagtggtatcgtgtctgtgcgttcacatgtctgttctgggctgggggtccatgtgggacatgtgtggccactcagggtgtaggtgggtgggcctcgggccatgcccaggcgacccccactgaggggtggtggcttcagggtcagaggcaagggttcctggcctttctcagcatagctggagaatgtctcagccaagccctgggcagctgcggagtctgagactggagaggtgtgggccaggcgatgggcagtgcccagcaggggcaggaggcccacagcctggcctggtgccatgaggggcatgtgggcaggaggctgtggggggtccatatctccccttctttttctccaccccattttctggacttcatttatttatttattttttgagacagagtctcgctctgtcacccaggctggagcgcagtggcgtgatctcggctcactgcaagcgccgcctcacgggttcacgccattctcctgcctcagcctcccgagtagctgggactacaggcgcccgccaccacgcccggctaattttttgtattttttagaagagacggggtttcactgtgttagccaggatggtcttgatctcctgaccttgtgatctgtccacctcggcctcccaaagtgctgggattacaggcgtgagccaccgtgcccggctgcattttctggactttaaaggaaattggggaggagcccagggtagggcagggagctggggatcgggcggggatagcaccaccacgtgcctgaccagtggagcctcgtgtcctcaggagtgggggggcttaaggtcagctccagtgatggaggacacggtgggcaggcagctttacccggggcctgggctcctggtggggaggcacctccctgccccagtggggcgtggcctggctctccccagttcccaggtcaccagttgcctgtctgtgtgactccctccaccgcctatggggtgaaccccagcagttcctccttccccacaagctgagctctgagggaaaagccctggcccgggcagtcactacccacctgggctcctggctccatgcaccccagagtggctcggaggtggtctgaaaaggcgaggtggggagagccgggtgcatggagctcctcctcccaactcaggtccttccagaccagcatcagctgggcaaggagagctcccctgtctcctggcagctcccaggtgcccaccaagcccccaccctgacggatgtccaggccccctgggtacactgacactctggggccagatggcagaggccccaccctgtgcatggagaggggagcccagccatggctatggggtcctgcacctgcagttggcatcctcgggcctgtcccagcagtgacagggtcccaggagtgagaattcaactgtggatgcacggccatggcccttccttcctatcacagcccacagtccagctgtaatgcctgctggcctgggcccaggccgggcatgtggcaatccttaggtggttaaagggggtaagtgggacagtggcagtgagaatgcttcctccatggaagccaaagacactagacctttaggcatttgtatatggacagcttggaaagcagactcaaagtggcagtcatggccgtggccgtggcattgtggtgtgatgtgcatggtggcgtggaagtggaggtgaggacggtggtgacagtgtggtggcagcagcgacaatgatggtgatggtgatgatggtggtgatggtgatgatggtggtgatggtggtgatggtggtgatggtggtgatggtgataatggtgatggtggtgatgatggtgatggtgatgatggtggtgatggcggtggtgatggtgatggtggtgatggtgatggtggtggtggtgatgatggtggtggtggtgatggtggtggtgatgatggtgatggtgatgatggtggtggtgatggtggtgatggtgatgatggtgatggtgatggtggtggtgatagtgatgatggagatggtggtgatggtggtggtgatggtgatgatggtggtggtggtgatggtgatgatggtgatggtgatggtggtgatggtgatggtggtgatggcgatggtggtgatgatggtgatggcgatgatggtgatgatagtgatggtgatgatggtgatggtgatagtgatgataatggtgatgatggtgatggtggtggtgatggtggtggtggtgatgatagtgatggtgatgatgatggtgatgatgatggtgatgatggtgatggtgatgatgatagtgatggtggtgatggtgatggtgatgatggtgatgatagtgatggcgatgatggtgatgatagtgatggtgatgatggtgatgatgataatggtgatgatggtggtggtgatggtggtggtggtgatggtggtgatggtgatggtggtgatggcgatgatggtgatgatggtgatggcgatgatggtgatagtgatggtgatgatggtgatggtgatagtgatgataatggtgatgatgatggtgatggtgatagtgatgataatggtgatgatgatggtgatggtggtggtgatggtagtggtggtgatgatagtgatggtgatgatgatggtgatgatggtgatggtgatgatagtgatggtggtgatggtgatggtgatgatggtgatgatagtgatggcgatgatggtgatgatagtgatggtgatgatggtgatggtgatgatgatggtgatggtggtggtgatggtggtggtgatggtggtggtggtgatgatagtgatggtgatgatgataatggtgatgatggtgatggtgatgatgatgatgatagtgatggtggtgatggtgatggtggtgatgatgatgatagtgatggcgatgatggtgatgatagtgatggtgatgatgatgatagtgatggtggtgatggtgatggtgatgatagtgatggcgatgatggtgatgatagtgatggtgatgatggtgatggtgatgataatggtgatgatgatggtgatggtggtggtgatggtggtggtggtgatgatagtgatggtgatgatggtgatgataatggtgacgatggtgatgatgatgatagtgatggtggtgatggtgatggtggtgatggtgatggtggtgatgatagtgatggtgatggtgatgatggtgatggtgatgataatggtgatgatggtgatggtgatgatggtggtgatggtgatgatggaggcaatggtgatgatagtgatggtgatggcgatagtgatagtgatggtggtggtgatagtgatggtgatggtgatgatgacagtgatgatggtgatggtggtgatggaggggtgctgacagagtggtggagggatggggactgtatggaccatttttcagtctcttgatcctcaaccaccctgcatctgaccctatcatccctttgaggggagaatcccctactcaagaccagctcccatctcccactttagaagcaggaagcagcagccactcgcctccctgccttcaacagggctgagggtgaggacccaaccaccaggtgtttcaggctctggattggcggccagggctgtagggagcgggacatggcatctcagtcctggggcatggaacctcacggcttccaaggcagctgcagcgtgggtggtgccatagcatcacccctacccggcctctgtggagtggctacatggcaggcccttcatcgaggcatctccctggctgggcggcccctaaccctctcttcccccctgggaggggagtgagcacccaggcttgcatgtatccccccccatcggccagagcctgctcatttctgccaacagacagcatggcaggcagtgtctgatgctgccagtaacagaaaactggccacaggctggctcaagcagtgacactgatcatctcctgaaacgggagtccagagagccctgggcatggtgggttcccaggcagccactatcacccgctcagcagcttccccggagtcctccgttcttacctcctcaccgaaccactctcctgggtcagctctgacctcagcctgacgccctcacggtagtaatgtggctgctggtattccaggcctcacatccaggcaggacaaagtccagaggaaaaagaggcactggctctgcttgtgtcttcataggagtaagaaaacttctcccctaagtcctagcagacacttcttcacactcatttgccagaactgagtcccccaactgctcagctagcccctctggaggggggtaaaaccagtgttgcccagaccaaggcggactccactcctctcctattttgaggccatgtccccggaagcaggtggctgaatgagtagccccagacagcatcctgtctgaagggggtgtggggcaactctggggacaccaaagtgctggcctgggaggtgcagtggcggggggagccctgcgatgctgtggcttccttcagtgcccgcagggacggcgttcccacacctctcatgggcccctcctgcgggctcctgctgcccccgggtaccgtgtcagtgttgccctccactgggcccaggcagctgcttttagttcagtatttgccaggatctagagctggtggcagtggggatgctggcacgaatactcggtcacagtgcaggggacatgccgggtgctcctctgcgtctgatcagtgatgagtgtgagggagatcccagcctggggcgtgaggggcagctttggggctggcagaaggcaaaaggtcccaagctgtctggcatggtcacagcctggcatcctctcccctgggcacagcgtgggatgggatctggccccaccctcaggccctgtgggggctctgcccaccactccctcccagtccccagctggacaggccaccagagtccctgggccttgtgggaagctccgcaatctgacacaccactcccagtgtctggctgccatgcaaacagggaggtggtttgtgggaggagccagggacttagttcacagaagatcctgggtaggctctggtgcctgctgtccccatgctgggcatgggtgcccctccatcccctcgcaggaaccccagatggagcccggggcagtcttgtcctcccccaggggtcctgggagaccaagcacagatggttggggaaagctgcagaggtgacagggaccagcccctggctggagcccaggggtgccccatcaccatccgcaccatccccttcattaggtcctgcctgtgcccatccagcagcttagggtgagttataaatagaggctggggtaagccctgggtcaagagagcagggcaaggagattaccagctgattactgattagcagagagtgggggctgtgccaagcagaagggcctggctcctgggggtgtggagggaggtcagggctcccttggggacagtgtgcagggtccacagacggcacatatggccctggggcagggttcccagggtctctgagaggtgccttccaaatcttctcaagtcaagagggttctagatgagacccacctctggcttcaggggtgccccccaaaatatgccccctcccctgctccctacccaggagaggcgtgaggggcttccccatctcctccctccaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtgtgagtgcacacatcccttcctcctccatcatccccatccccaccatcaccatccccatcatcaccatccccaccatccgcatccccatctccatccccaccacccccacccccaccagccccatccccatgaccaccatccccatctccaccatctccatcaccatcatcgccatccccatccccatcatcaccatccctatcaccaccatccccatcatcaccatccccaccatccgcatccccatctccatccccaccacccccaccaccaccagccccatccccatcaccaccatccccatctccaccatctccatcaccatcatcaccatccccatctccatcaccaccatccccatcaccatccccatctctatctctaccatgcccatcaccatcatcaccatccccatctccaccatccccattaccatctccaccatccccatctccatccccaccatccccatctccatccccatctctgccatccccaccatcaccatccccatctccatttacatccccatccccatccccctcaccatcctcatccccatccccctcaccatcctcatccccatctccaccatccccatctccatcaccatccccctctccatccccatccccatctccatcaccatccccctctccatccccatccccatctccatcttcaccatccccaccaccgttcccatcacctgcaccatcactcccaccaccatcactgcctcggccatgaggattgccgtagcagctcagtcagaaaggaaagcccactggggcagggtagcgcctgatggtggtgggtgtgtcagtggagggcaggcttctgtcccactccttggaacctgaggaggatggggaagtgagaccctgcacccccatctcctgctgtcctgaggagaccttttgctgctccctccagttctgccaacaccatgtttgagatggagtggcgtggccggcgggtagcactcaaagccagcaacgggcgctacgtgtgcatgaagaagaatgggcagctggcggctatcagcgattttgtcggtgagcactctgcctgccaggtactggggcaggggctgtctccacccagggaaaggacctgcccagacaccccatctccaccaagagctggaccctccccagcccacggaacgggtgctgtcatggagtcatacttgctagtcaagataactcgtcttggcaagggaaacaggtctgaatgtccttatctccgctgctgggaaccccctaggcgccttgccaaggccgcacatgaggcaatggcaggcctgggtccctaagtccaggtgtggcgtttcccagggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggtgcgtggcggggcgggtgggcacgcgggagcgggggtggcagcgggcaggtgggcacccccgccgacgccgtcccgtcccccaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgca

SEQ ID NO: 34809 - DNA, 413663 bp, Homo sapiens; identical to SEQ ID NO: 6286

SEQ ID NO: 34810 - DNA, 9030 bp, Homo sapiens
tgtctatagtaggtgcggagaagaaatgtttggcagatgaagaaaatgaggtgcagagaggatttaagagattctctcttactgcctgttcagggtcagtccagaattgagggtctccgggggagggcagaggctttgccctgcaggggatctgtgggagggggttaggagggagcagatgagcccaggatgaatggtcagagtcaggtgctgcccggcggaggtcacgagtccagggaggggatcaacatggccgctgcaccccggactgtgttgatctccggctgctcatcaggaattggtctggaacttgcagtgcaactggcccatgaccccaagaagcgctaccagggtaagaagtgcagggtggcactaggaggcagccgggtggaaacggcttccccagcactgtctcccctacccatccctcccagctgcacttgtgggcttggggagacccaggattccctccaggaatcatcccctcatcctagaaatatttcttgagcatcttctgggtgctctgaatgctggcaacacaactggagatgaaatagacaaaaatctcagccctcaggacgggtgtcatgtggggaggagagggagaatgggtgataaacagataaaaagaaattgttgctctatctggtgggaataagtgctgagacacaaaataaagcatgctgagagtggcagggggtgggtgggggttatttttagaagggtttcactagggcatttcctagattggaataatcactaccctgatgctcactcttccacgtctccccagattattgcttttactgagataagcttcttaagtgctcctgaccttgggggttgaagggatggccttctagttctaagaacttgcccttctgcacctctagaataaatccctgggacctgcatcctaaccaaccaggagaacccctgacccagagggagcatgctggagtcaaagtgggcaaagggttgttacttacaaagaggcgactgggggtgagggcattgccccagttggcagggctgcttctcccagccctctgccctctgttttagagacgcacacagctttgagcatgacagcctgaatgccagtgtgcagggaataacgtgtgtccctatgggcgggcagatgggtgtatgaaactgctggaggctaatgtttatggagcttttacaatgcaccaagctgcattctaagtgccctgaatccaggaagtcatttaatcctcacatcacacccgtgaggcaggcacaatcattcaccccattttattattattttattatttatttattttgagtcagagtcttgctctgtcacccaggctgagtgcagtggtgcatcttggctcactgcagcctccacttcccacgttcaagtgattttcatgccttgacctcccgagtttctgggattaaggcatgcaccaccacacccggctaagtttttgtatttttaatagacaaggtttcaccatgttggccagaccggtctcgaactcctggtctcaggtgatctgcctgcctgggcctcccaaagtgctgggattacaggcatgagccaccgtgcctggcctgccctattttagaaatgaggaaactaaggtgcagactgtgaaaggtctttgctcaaggtctcccagctgcaaagtagcagagctgggatttgaactcaggcagcccatcccttgcacccatgtttcccactatatcacatgtagatgcaagtgaccccattcacgtgcctgctacccacaaatcacactgacccgaagacaagaggcaaatgcccccaggagtgttcatgggtgattatgggtgcacacattgggggatatcaaacacgtatgctggtgcatgtgcagacatagtacatatgctgaggtcctgcttaagaacataagcttgaggctgggcacagtggctcatgcctgtaatctcagcactttgggaggcctaggtggacagatcacctgagatcaggagtttgagaccagcctggccaacatggtgaaaccccgtctctactaaaaatacaaaaaattagccaggcgtggtggtggatgcctgtagtcccagctattcgggaggctgaggcagaagaatggcgtgaacctgtggggtggagcttgcagtgagtcgagatcatgccactgcactccagcctaagcgacagagcatgactctgtctcaataaataaataaataaatatacaaaaattagccaggcatggtggcagtgcctataatcccagctacttgagaggctaaggcaggagaattgcttgaaccgggagacagaggttgcagtgagctgagatttcaccactgtattccagcctgggcaccaagagcgagactccgtctcaaaaaaaaaaaaaagggcataaaagcttggccaggtgctgtggctctctggctcctcacgcctgtaatcccagcactttgggaggatgaggtgggcagatcacctgaggttcgagaccaggctgaccaatatggtgaaaccccgtctctactaaaaatacaaaagattagccaggtgtggtggcaggcacctgtacccctgtaatcccagctactcgggaggctgaggcaggggaattgcttgaacccaggaggtggaggttgcagtgagccgagattgcacccctgtactccagactgggcaacaaacaagagtgaaacttcgtctcaaaaaaaaaatatatatatatatatggctattcacttcagtgttcatatatgcacatatgttggctatagttgtgtatgcatttttttcatggcaatctgttttatgtttatatattttattgtcttacctactaggctataaattccatgaaggcagaaactttatcttatttatttatttatttatttatttatttatttatttattttgagacagtctcgctctgttgccaggctggagtgcagtggcgctatctcggctcactgcaagctccgcctcccgggttcacgccattctcctgcctcagcctcccaagtagctgggactacaggcgcctgccaccacgccaggctaatttttttttttttttgtatttttagtagagacggggtttcaccatgttagccaggatggtctcgatctcctgacctcgtgatctgcccacctcggcctcccaaagtgctgggattacaggcgtgagccaccgcgccaggccgcccggccttattttttattttttgagacagggtctcactctctcacccagacggtagtgcagtggctccatctcggctcactgcagcctcaacctcctgggctcaagcaatcctcccaccacagcctcccaagtagccaggactacaggtgggggccacccaccacacctggcaaatttgtaaaatataatttttttgtagagatgggatctcgctatacttcccaggctggtctcaaactcctggggtcaagcaatcctcccacctcagcttcccaacgtgctgggattacaggcttgagccaccacacctggtgactttatcttatttcatgccatagcctcagcacctagaatagggcatagtgtatagtagatgctcaataaatgtctgttgaactcatggttggaaggatggatataggtacgtggagatgcgtgtacacaagtgtgcacttgttggctgagtgataaatgtaggtgtgtaaacttgtgagtttccatctctctgtgacttgtaacgcaagatcacagacacgtggcgcccacaccaaggggaaaggagctcagtgcctgtccctgctttactctctgccccgcagtcgtggccaccatgagggacctggggaagaaggagacactggaggcagctgctggggaggctctggggcagaccctcaccgtggcccagctggacgtgtgcagtgatgagtcggtggcccagtgtctcagctgtatccagggagaagtggacgtgctgggtgagacttcacagcccctgattcactaagccccatcctggtctgagtatagaccctcaatatggcaaggtctgagcaccagctctctggcttcttcagcaatctctgaacctgggcagaaggggtagaccagttggccaagaggggtagaccagttggtcctaccaattgatttattaagggctgggtgcagtggctcatacctgtaatcctagcactttgggaggccgagacaggaggattgaccagcctcagcaaaatagtgagactctgactctacaaaaaaattaaaaattagccagtcatagtggtgcatgcctaatcccagctactcgggaggccaaggtgggaggatcccttgagcccaggagtttgaggctgcagtgagttatgacagagccagtctggggagacagagtaagaccttgtctcaaaaataattttttttttgagacggagtcttgctctgcgcccaggctggagtgcagtggcgtgatctcggctcactgcaacctccacctcccaggttcaagcaattctcctgcctcgcctcctgagtagctgggattacaggtgcctgccaccatgcccagctaatttttgtatttttcttagagacgaggtttcaccgtgttggtcaggctggtctcaaactcctgacctcaagtgatccgcccacctcgacctcccagagtgctggaattacaggcatgcaccaccacacctggccaaaaatcaattttttttgagatggaatttcactcttgttgcctaggctagagtgcaatggcgcaatctcagctcactgcaacctccacctcctgggttcaagtgattctcctgcctcagcctcccaagtagctgggattacaggcaggcgccaccacacttggctaattttgtatttttagtagagacggggtttctccatgttcatcaggctggtctcgaagcctgacctcaggtgatccactcaccttggcctcccgaagtgctgagattacaggcatgagccaccatgcccagctcaaaaatcaatttttttaaaaaacaaaaatattagagacactagtaacaatctgaggcctggaggtggggcagattttatggaatagaaattctcatatatggagaaagccatatgtggttgggaaaattacttggatgagtcacttggggaagacagcatgatacagaaataagtcataaggtccctaaccttcgcaggaaggtgggtgtcgctgtcttgatgtaatttggggtcagaattgaattgctcatggattaaggggggcactattcccagcagcccttcctcccactcagggctgaggatcccctatgacaaatgctaaactgtgtttaaaggttaccaaggtttcatatttgtccacccaagataccctggactggccttggacttggagtacggggtgaggtgcttcagggagtgtctagaagtaatgctagaagagtgagggactttaaggtaacccttagtacctcttctcttagtgaataatgctggaatgggcctggtggggcccctggaggggctcagccttgctgccatgcagaatgtctttgacaccaactttttcggagctgtccgtctcgtcaaagctgtgcttccaggcatgaagaggaggcggcagggccacatcgtggtgatcagcagtgtcatgggcctgcagggtgagctgtggggacccaaccctggaaatcccaccagtgtctgatcctccccagactgggaggatggcgaatgggttttagatcatattctaaattagcatggaccctgggcacggtgattcatgcctgtaatcttagcactttgggaggctgagacgggtggattgcctgagctcaggagtttgagaccagcctgggcaacatggtgaaagcccgttcctactaaaatacaaaacaatcagccaggcatggtggcatgtgcctgtaatcccagctactcaggaggctgaggcacgagaattccttgaacctgggaggtgtaggttgcagtgagccaagatcgtgccactgcactccagcctaggcaacaaagtgaaactctgtctcaaaaaaaataataataaaataaaataaattagcctggagaattgtgttcagaaggattctgaagttcagaaggaaaaagtggccagacatggtgactcacgtctataatcccagcactttgcgtggcctaggcaggagggctgtttgagctcaggagtttgagaccagcctggtcaacacagggagtcctcatcactactaaaaatttttttagaattgggccaggcacggtgactcatgcctgtaatcccaacactttgggaggccgaggcaggtggattacccaagatcaggagttcaagaccagcctggccaacattatgaaatcccatctctactaaaaatacaaaaaaattagccgtgtgtggtggcacacacctgtagtcccagctactcggggtgctgaagcaggagaattgcttgagcccaggaggcagaggttgcaatgagctgagattgcgccattgcactccagcctgggcaacaagagcaagactctgtctaaaaaaaataaataaataagtaaacaaacaaacaaacaaaaaacaacaacaaaactttggccagatgtggtggttcatgcctgtaatcccagcactttgggaggctgaggctgatggatcacttgaggtcaggagttggagaccagaatggccaacatggtgaaactccgtctctagtaaaaatacaaaaattagctgggtgtggtggtgtgcacctgtagtcccagctactcaggaggctgaggcaggagattcacttgatctcaggaggcagaggctgcactccagcctgaacgacagagtgagactccgtctcccccccgccaaaaaaaaattaaattaaataaaaaaatcagccaagcatcctagtgtgtgcctgtagtcccagttactcaggaagctgaagtgggaggatcgcttaagctcaggagttcaaggctgcagtgagccatgattgcaccactgcaccccagactgcagaacagagcaacaccttatcaaaaaagaaaaagaaaaagagagagagagagaaggaaggaaggagggagggagggagggaggaaggaaggaagggagggaggaagagagacaagggccctaatgaagagaaaaatgaaggggatccccaagcggccccaaaggtttagagaatggagggaaataggggagtttcctgggaccaggtggagctgggaggaggtggcacccggcacccgagaacaacctctttctgaccccatatgaccccatcacacaatgccatacacccatcatcttggcaccatgtatctgctttctctggttcccacatcctctttgctctgtctcccaaagaccccatcaccctggaacccacaaagcccacctcccagaccctcaaagagctctcctccctctgaccctcacaggtgtcatcttcaacgatgtctatgcagcttccaagttcgccctggagggattcttcgaaagcctcgctatccagctgctgcagttcaacatcttgtgaggcgggcacgtgggcagagggggcttggagccagtgatggggaggtggcatcgaaagggggagaggagagatgaagacaatgaagctgagtgcagtggctcacacctgtaagtccagcgttttgagaggctgaaatgggaggatcgcttgaggtcaggcatttgagaccagcctgggcaacatagcgagacccccatctcagcccaaaatttaaaaattagccaagggtggtggtgtgtgtacctgcagtcccagctactcaggaggctgaggcggaggattgtttgaacccaggagttggaggctgcagacagctatgatcatgccactgcactccagcctgggcaacagagtgagaccctgtatcttaaaaaaaaaaaaaaatggacaaaataggtcagggagtggttggggcatcagacttacactacccatgcctggtcgccagcatctccctggtggagccaggccccgtggtcaccgagtttgaggggaagcttctggcgcaggtttctatggctgagttcccaggcactgaccctgagaccctgcactacttccgggacctctatctcccagcctccaggaagctgttttgctccgtgggacagaacccacaggacgtggttcaggtgagtgaagggcccagagccccaagacgtggctcaggtatgttgcggggtgaggccctccctgggtcccagcgctcagggcctccattctgcaggccattgtcaacgtcatcagctcgactcgaccacccctgcgccgacagaccaacatccgctactcgccgctgaccacgctcaaaaccgtggattcctctggcagcctgtatgtgcgaacgacccaccgcctcctcttccgctgtccacgcctcctcaaccttggccttcaatgtctgtcctgcggctgcctcccaacgcgggtgcggccaagatgagcagaacagagcttcacgatccccatccctgaacaaccagacctcttcattccacatctaattcaaaggatgaacagactcttcatttattcattctgcaaactccccctcccctcctctgtgcctagacatggctagaatcccagaagggcctttattttcaggcatagactcctctgtggtcacagctggagcacagagagggaccctgggaacttggcctgggaagcccagagcaggaagccacagctgtctctgggaaagcaagggaggcttcctggaggaagcggcattgttatgagccttgaaggaagagacagactctgctacattcaacctcgtgacttcatgatcctgggcctgagaacacaggaatgattcatagcccaccccccacctccatgcatacaccagagctctgtggaccaaggggtcattcctggtcacacactccatcagcaaaatgtatttgagcacacaccagcaatgtatgtatattttttccattaaatatatatttataaccaca

SEQ ID NO: 34811 - DNA, 5492 bp, Homo sapiens
ccggggaccacacgccgcgctgtccccagcacccaacccaggttaccatggcctccctgttctctggccgcatcctgatccgcaacaatagcgaccaggacgagctggatacggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggaggtgaggaggggcagggagggcttcctggaggagggggcatgttcgctgaaagtgaagcatccattctaactagagtgaatgagcagcccctgtgtgccagtccatatactgggaactagggggtacagacaggggtgcccacttccacatgctggcttccatgccaccccagggagcttagagccgagtgagaggaacagatgcaaaagacagaatcaactatgtaatagcaaggccgggcatggtggcttaaccctgtaatcccaggactttggcaggccgaggtgggcagatcacctgaggtcgggagtttgagacaagcctggtcaacatagtgaaaccctgtctctactaaaaatacaaaaattatccaggcgtggtggtgggcgcctgtaatcccagctgcttgggaggctgaggcaggagaatcgtttgaaactgggaggcagatgctgcagtgaggtaagatcgtgccactgccctccagcctgggtgacagagggagactctgtctaaaaaatcaaaaaacaaatatataatagcgaattgcagtagtgctcagaggacaaagctaggccacaaagtggaaatacaatgagggaaaccttggtgaggttccggggtcagaggatgcttccccgaaaaagtggctttaaagagagacccctagctgggcacggtggctcatgcctgtagtcctagccacctgggaggctatggtaagaggataactggagcctagagtttgaggctgcagtgagctatgatcgcaccactgcactccagccagggcaatacaggtagaccctgtctcttaaaaaagtaaggccaggtacggtggctcacacctgtaaatctagcactttgggaggccaaggtgagcagatcacctgaggtcaggagttcgagactagcctgaccaatatggcaaaaccctgtctctactaaaaatacaaaaattagccaggcctggtggcgcacagctgtggtcccagctacttgcgaggctgaggcaggagaattgcttgaatccaggaggcgaaagttgcagtgatccgagatggtgccactgcactccagcctgggcaacagagtgagactctgtctcaaaaataaaaataaaaaataaaaaatgtaataaataaataaattacagggagactccaatgagaagaaagataggaggatggagaatgaggaaagggaaggggttccaggcagagggcacagcagaaaggcttggaggctgtcagagaaagaacaaccagttcagggagactgtaggtaattccggagaggatcaaatttacaatgttattgttactgcccacgcatttgtcataatcttctttagatgtgacaggtctgtggtgcagagccaccttaacaagtatagacatgatcctcagagtagcagggagccatggtggacattagaacagagggagaggtagtcggattcaagctttataaggagatgtccagccaggcatggtggctgacacctgcaatcccagcacttttggaggctgaggcaggaggattgcttgaggctgggagttgaagaccagcttgggcaacacagcaagacaccaccactcccatctctaaaattataaaaaagaaaaattatgaaaggtggcttggtgcggtggctcatgcctgtaatcccagcacactttgggaggccgaggtgggtggatcacgtgaggtcaggagttcaagaccaacctggccaacatggtgaaaccccgtctctactaaaaatacaaaaattagccagacgtagtgttgggtacctgtagtcccagctactcaggaggctgaagcacgagaatcgcttgaacccgggaggcggagggtgcagtgagccaagatcgcaccactgcactccaggctgagcgacagagcaagactctgtctcaaaaaaaaaaaaaaaaaaaaaaattaaaaagatcctttaaaaaaatttacaaaaggagctgcccaatgaaacagtattatagcttgactttttattatgaaaaaaacgttcaggctgggtgcagtggctcacgcttgtaatcctagcactttgagaggccgaggcgggcggatcacgaggtcaggagatcgaaaccagggtgaaaccccgtctctactaaaaatacaataaattagccgggcgtggtggcgggcgcctgtagtcccagctactcggagaggctgaggcaagagaatggtgtgaacccgggaggtggagcttgcagtgacccgagatcgtgccactgcactccagcctgggcgacagagcgagactatgtcacaaaaaaaaaaaaaaaaagaaagaaagaaaaagaaagaaagaaaaaaaatgttcaaacatagcaaaaagttgaaagaagtgtacaatgaaacccatcgcaattgttaacattttgccatattcactttgtctacaatacaaatacgtgtctatagacacatatacactttgtctacaataaaaatacgtgtctatatacacgtatatgcatacgtgtatagtttgtgctaaattatttgaaagtgagttgcagacttcatgacattttcccaatgtcatgccttttgttactcaacaagttggaagtttctggtcatcatcagaatttggacatcatcagagtttggacactgaatcctgcccactgccctcggcagctgaggagattcctccctgacgctagcaacgcttccttccctggggcagagacgccagctgcagacaaatgctgaccttctctgagacagggtcctctcaacaaaacattcacccagactagtatgttatctgggcagttcccattccacatcccccgtagacgggatgtccagttaaatgaaatttcaggctgggtgcagtggttcatgcctgtaatcccagtgctttgggaggcagagatggaaggatcagttgaggccaggagttcaaaaccagcctgggcaacatagcaagaccatatctttacaaaaacttaaaaaaaaaaattaggtgtggtggtacgagcctgtagtcccagctacttaggaggctgacgctataggatcactggagcccaggagtttgaagttaccacgatctgtgttcccgccactgcactctagcctgggtgacagatggaggctctgtctctaaaaaaaagaaaaagaaaaaaaaattgagataaacaatgaataatctttctttagtataagtatgtcccatgcatttggctatacttacactaaaagattattcattgtttatctgaaattcaaatttaactagtgtatttatatatagaatagagagagatggggtctcgttatgttgctgaagctggtctcaaaccgttgggctcaagcaatcctcccacctcggcctcccaaagtgctgggattacaggggtgagccactgtacccagcctccaattttttttttttttttaagagagggagtgtcatatatatatgttgtttgttgttgttgttgttgttgagatggagtatcttcgcccaggctggagtgcagtggcgtgatctgggctcactgcaagctctgccttccgggttcacgccattctcctgcctcagcctctccgagtagctgggactacaggcgcctgccaccacacccggctaattttttgtattttttagtagagacggggtttcaccgtgttagccaggatggtctcgatctcctgtgagtgtcttatatttttaattactaaacctggcaatctactcatgggattttgtaagtatcatgggttctctttgtggcagcctggaaaagggccacggaagaatgcagcaggctgaaattaagaactgttaaccatgttggctaggctggtctcgaactcctggcctccggtgatccgcctatctcagcctcccaaagtgctgagattacaggcatgagccaccacgccggccaagcaggagaaattttaaaaaccatacatgatgttgggtgctgaaaggcactttggagaaaaacactgccttggaatgttatttattctattttcgagacaggatctggctgtgtcacccaggctggagtgtagtggtgcaatcatagctcactgcagcctcgaaatcctgggctcaagggatacttctcgagggaagtcccaggtacctcggcctcctgagtacctgggactacaggagcgcaccaccacaccctgctttatttatttatttatttatttatttatttatttgtagagacagggtcttactacaaataaatgtagtaagaccttgtgtcttgcgatgtgaggtctccatactacagggtcttagcctgcaaatgtctgaggagagcgctccagacgtgggcacagccagcacaaatgccccgaggttggagcatgcctggggtgctggagacaaagcgcggggaccaaagtgtctggccctgtcccggtcctcgtgtgcacctacccagtgcccggcaagaggcagtgcacacagaaggcgctgcctaagtactgggaggagggatgtggggctctctggttcagcatcagggatgtggatccgtccagactgacctgcccgctccgcagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtaccgcgtggaaaaggcggcgcgaggcgggcgcgaccccgggggagggggtggggaggagggcggggccggggggctgttctgacccgctagggtggaggagaggagtggggtttgttgatgaacctccacccccaccccacccccgcacgcctgtaatcccagcacttggggaggccaaggcgggaggatcgcttgagcccagaggttcgagatcaacctgggcaagagagtgagaccctgactctacgaaaattaaaagttagcccggtgtggtggcgcgcacctgtggcttagctaccctgaa

SEQ ID NO: 34812 - DNA, 21490 bp, Homo sapiens
ccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggtgagcgtctgcaggagaggcggaggggaccgaggaggggagaaaaaagagaggggagaagttgggtttatcttattcgtggctgtgtttgccgtgctctgcaggtgatgtttgctgaatagtcacacacaaaacagaggtgccgtcctggcatttgtggaaacggggctaggctgtgattgcagcaggagggagtaaggttagacagcagggactggctgatggcactcggggcattgggaggattcagggtggcttgtgggcaagggggtcccctcaagccctgacggcatccggggttgggggcttctcaccgtggttctaaggcaactcctcagcataccgctctgttggatgttctttaaaactcttagcactgcctgaaattttcatttgcgcgatgatccacaaatggcctgtctccctcccttgttgagcactgatttttccccagtgcccagcgtgtggttgggatttgcctaaatatgtgttgcatagatggatggatgaatgacagacaagggacggaacagacatatacgcagagagcccaggtctgtggctgcaacaggaagaactccgggtggacttgggcctgcccgagagagccaggaatgtgatgactggggatcactgtgctggtgaattgatcacttagggcctcaatgcacccagaggctctggctttcagcccaggctctacttcgggactggggaatcctcacgcccccgccctcttagcttccagcacagtcactctctctgatcttctttctgcaaagtttttttttgtttgtttttgagatggagtcttgctctgttgcccaagctggagtgcagtgccacgatctccactcactgcaacctctacctcctaggtccaaggagtccatccacctcagcctcttgagtagctggaattacaggcgcgtgcccccatgcccagctattttttgtatttttagtagagatggggggtctctccatgttgtccaggctggtctcgaactcctgacctcaagtgatcagcccgcctgagcctcccaaagtgctgggattatgggtatgagcctctgcgcccagccggtctcctgcaaaactcttgattgacaccttgtttcccgtctgcccctgtcaggagggctgaggccttgtctgtcttgctctcggctgtattcccagtgcttgggtcagtcctagacacacagtgagtgctcagtgaatatgcagggaatgaatgaatgaatgaagggcagaagggtagaagcaggtagacagactgccacagagaggaggtgtgatgcggttttcccaaaaggaacgagcgagggctgtgattgccacagagtgaggtccgacttcagggctgcccactgtgtgtgaatttctggatgcttcagggatcacattgttgatcacggagttgatttgctcaggctctaactgtgccgtggatcccagcttcccccaggtctcatggccggcagtgggtgcatccacccagctccttgtccccgctggacagaggagccaacagaggctgcagagagaggctggagtggctgacaagggagggccctgaatgtggctgagctgggagggtcttgccaagggctggcatgaagccacatgagtctggttttttttttttttttttgagacggagtctcactctgtggcccaggctggagtgcagtggcatgacctcagctcagtgcaacctccacctcccaggttcaagcgattctcctgcctcagcctctcaagtatctgggattacaggcgtgcaccaccatgcctggcttatttttgtatttttagtagagatggggtttcaccttgttagccaggctggtctcaaactcctgacctcaggtgatccacctgcctcggcctcccaaagtgctgggattacaggcgtgagccaccacacccggccgagtctgcgtttaaatcttgttcttttctcactgtgtggccttggacccctcatgtgggctctctgggccttggttgcctcctctgcaaagtggggacaatgataagctgtcaccatgatccagccagatgagccatattgcaggcctggcctgcagtgggagcagggcaggagaccagcctcattctgtttctagggtccctaggtagacttgggggtgaagagcggggctcgggggccaaagagatttaaattttacccctggttcttccactcatcacctgtgtgacctcgggaattgacgaaacctctttcagcctcagtttcctcctctgagaaagggacctctgagctccgtggggctgtggggagcatcctaagaggccatatcgccgggtgatcaggagggcaccggctccggggcaggtgctggcccagctctggctctgccgctgacgtgcgagacagaactggagactacacttctctcagcctcagtttccttctctgtaaagtggggatgataccagaagccgcctgggaggaagtttccatggagttactgttgcctgagatcttgttcccaaggtccatggtgcatgcagtgtgtgagaagctggggccccctggaggtccttaaggtcatcagccacctgaactgtgggcacctccctccctcccaggctcagtctcccccgctgtagaatggagttatctgcatgtctgccccaccaggtggctgtgagcattcagacctcacctgtgggaacaactgctcagctgggaacctgggacccagtgagtgccgaaccccacagctctgagaatcagcctggggcctcccaggttgatccccagggcagagacactgatattctttgttccaccccttgaaatcataaaacatcagtgtctggaaattgttgtcattgtgagatcttgtatataaagcctgggccaagtgtctgccgagtgatgaattcctggacattcttttttttttttcctccccaggagacaggtcctctttcgattgattgattttttttttttttttttgggatggagtcgtgctctgtcgcccaggttggaatgcagtggtgcaatctcagctcactgcagcctccgcctcccgagttcaagagatttttgtacctcagcctccccagaagctgggacaacaccatgcccggctaatttttgtatttttagtagacggggtttcaccacgttggccaggctggccttgaactcctgacctcaagtgatccgcctgcttcagcctcccaaagtgctgagccactggcctggcctgttttgttttgttttgagagaggatcttgctctgttgcccaggctggagtgcagtggctggatcatagctcactgcagcctccaactcctgggctcaagcgatcttcccacctcagcctcccagagtgctgggattacaggtacgtgccaccacgcccagccctcactggaggcccttctgtcatcagctgcctcaggttgctgccaaacccagggaaagatttcagtggatgttcaatattattattgttattattctctgctgacatcttgtctaggcagcactttatcattattatcagctgtttgatctggggcccacactttcctcctgctgagcctcctctcccctatccgttaaaagggatgatcctggccaggcactgtggcccacgcctgtgattccagcacttagggaggccgaggtgggcggatcacctgaggtcagaagtttgagaccagcctggccaacatggagaaacccaatctctactaaaaatacaaaaaaaaaattagccaggcatgatggcacatgcctgttgtcccaggttgggaggctgaggcagaagaatcgcttgaatccgggaggtggaggttgcagtgagccaagattgcgccactgcactccagcatgggtgacagagactccgtctcaaaataacaacaacaacaaaaacaaaaacccagaaagtggtgatcgtaaatgtgagctttcttggctttcctggaaggttaactgcttagccaggcaatctgactcagatttgacggcgaagacaatgaaagtgtgtgcttttgttccaggccctgcaaatggtccccagtggggcaggttcaccagtttccttgtctccactctctggaggttcatatttaacattattggtttttggagaagtgggagaggacagagggaacccaggttagggggctgggggaataggaccttcaggaattactctagccttgaaatcctggattctccactgccagcctgtgtgtgatcccgggtaagtcacactttcgagcctgaagatgttctctaaactgtaagcatcaggcaaaagcagtgtctcatgcctgtaatctcagcaatttgggaggctgaggcaggaggatctgctcaggccaggagttcaagaccagcctgggcaacatggcaagacacctctctctacacaaaaatttaaaaaattagctaggcgttgtggcacacctgtagtcccagctacttgggaggctgaggtgggaggatggcttgagctcaggaggtcgaggctgcagtgagctatgattgtgccactgcactccagcctgggtgacagagtgacatgctgtccctaagaccaaaaccaaaaccaaaatgtaagcatcatagtaatacagtctctacctcccaaggttgtgctggggatttaatgactacctgtatagagaaggcttgtgtattagttaactattgctgggtaacacttatcctaaaattgagcagcttcaaacaataaacatttctgatctcttatagtttccaagggacaggaatccaagagtggcttaactggattattccggctcagggtgttccatgtggttgtggtcagatgtcggccaggactgaagtcacttaatggcttggctgaggctggggaactaacctccatggtagcttactctcatagctgttggcaggaggcctcatttctttgccacatagacctctccgtgggatggcttgagcatcctcacaacatggcggctggctttccttagagctagccttggaagccacgctctgtcatttctgcaatatcctgttggttacacacgtcagccagcttgttagtagggactacacagggcatgaatatcagggggtaaggattattgggagttaccttggaggcagtttgattttggggatttaatgtagctgcttttgattttattgtcagcactgagccttctcgtgacattcctaccaggttttacttgttctttctgcttttctccatgatcaatctgctatggtcacacagggtgccttgtttcttctccaacaagaccaagttggagaccctgtcttgctcagggtgacggtgtgagattccagcctccaagcctttgcacctgctgtttttttaattttttttttttgcctggaaatctctattccagatccacacaaattcctagatgcctcacccaccccaaatgccttcactctcataacaacctgttttattttcctgggagttcttgaaactttctgaaggctttttttttttttttttttttgacagagtcttgctctgttgcccaggctggagtgcagtagtgccatctcagctcactgcaacctccgcctcccgggttcaagcgattctcaagtagttgggattacaggcacccatcatcatgtctggctaatttttgtattttagtagagatggggtttcaccatgttggccaggctgatctcaaactcctgacctcaagtgatcctcataactcagcctcccaaagtgttgggattacaggcaagagcccctgctcctggccatggcatctttattaaaaaaaaaaaaaaaaaaaaaaaaaaaaaaaaaaaggcagggcgtggtggctcacgcctgtaatcccagcactttgggaggccgaggcgggtggatcacatgaggtcaggagttcgagaccagcctggccaacatggtgaaaccccatctctactaaaaatacaaaaattagccaggtatggtggcaggcccctgtagtctcagctacttgggaggctgaggcaggagaatcacttgaccctgggaggcagaggctgcagtgagccgagatcaagccattgcactccagcctgggggacaagagtgagacttcatctcaaaaaaaaaaaatttttttttccttgtttgttattggtttctctaggaacggaaccaagaagttcaattctatgagaacagagaagctgcggtcttatttcttcctatattcctagttcctagagcagggaaggcattcaaaaaatatttactgaatgaacagtagaatctcaacttaaaataaacagaatctgtccccctcctcatgtgagggatgagaaggaaaggacagtgagaggaacggaagagtgggagctcacaataaacaccatccatttttaattctttttcttatgtttcaaatatttattgggggtgctggggacatggcaggaaccgagatattaccagtccctgaactcaggtaactgatagaatttgagggagagagatagataaacaaacatataaatatgtcgtttaatacaagctgtgtcttgaagaaaaggaggtagggagcgtgtgtgtgtgtgtgtaaaatccagtttaggggcgtaggttgctttctctggggaaagtagctgagctgagacgtggaggagaaggggttagctggtgagaggggctttggggtgggggagaggcgttcctagcccaggaaacggcttatgcaaatagctgtggagggtgagaggttttctgagtccatcctaatgagggcaatgaggaaccctcagagggttttcatgttctgtttgcttttttgaagattttattgttgtttttgcttttgacaagaacacacacacacacacacacacacacacacacacacacacacacacacaattaaaaagtaatccaaactatagagacaagatatggctttagcattccttcccagaggcagtcactggtgccagtagcttgcttccttcctgggaattttctacgcatatacaagtgtatattctacacatgagtaaaatcaatgcctcattttgtttattaattcataattataatacttattatttttgagatggagtctcactctgcctcccaggctggagtgcactggcataatctcggctcactgcaacctccacctcccaggttccagagggtctcctgcctccgcttcccaagtagctgggattacaggcatgcaccaccatgcctggctaatttttgtatttttattttattgtatttttatttttaaatttactttattattatgactctttttttgagatggagtttcgctcttgttgcccaggctggagtgcaatggcgtgatctcggctcactgcaacctctgcctcccgggttcaagtgattctcctgcctcagcctctggagtagctgggattacaggcgcccaccaccacgcctgcctaattttgtatttttagtagagacagggttttgccatgttggccaggctggtcttgaactcttgacctcaggtgatccatctgcctcggcctcccaaagtgctggcattacaggcgtgagcaactgcacctggcctatttattgttattattgagacaaggtcttcctctattgcctaggctggtgtgcggtggcatgctcatagctcactgcagtctccaaatcctgggctccagtgatcctcctgcctcagcctcctgagtagctgagactacaggtgcggaccaccatgcctgaccaatttttgtatttttttttttgtggagacagcgttttgccatgttacccaggctggtctcgaactcctgggctcaagcaatctgcccaccttgacctcccaaagtgctgagattataggtgtgagacacagcacctggccatctgcattgttttaaaaatcacaaatggttgcgaggtatacatactgcccagcaccatacttgtttcctttgaatatataaatattataattttataatatttataatatataataacacaaataataataaatatatatggtttggtcatatacaatatataaaataacattcacaaacacttattgtcaaagtgcaattaaatgggaaaaaaagaaaaacatttggccaggtgtggtggctcatgtctgtagtcctagcactttgggaggctgaggtgggaagatcacttgagcccaggagttggaggctgcagtgagctatggcaacgccgctgcactccggcctggatgacagagggagaccttgtctcttaaaaaaccccaaaaaacaaatctgattctctgacgcatatataataagcacaggtcaaagatttatttaagtcatgaatgaaggaaccagctgtttcaaaggagaatttgggccgggtgcagtggctcacgcctgtaatcccagcactttgggaggctgaggtgggtggatcacgaggtcaagagattgagaccatcctggccaacatggtgaaaccccgactctactaaaaatacaaaaattagctgggcgtggtggcgggtgcctgaggtcaggagttcgagaccagcttggctaacaatggtgaaaccttgtctttactaagaatacaaaaaattagctgggtgtggtggctcatgcctgtaatcccagctacttgggaagctgaggcaggagaataacttgaacccaggaggtggagtttgcagcaagccgagattgtgccactgcactccagcctgggcgacagaacaagactccattaaaaaaaaaaaaaaggagaatttgatgaacagaagttgataggtttagtcaggaaagacgggctggagaaaatttgccaggttagatacaaaactggttaaagacctacaggacaatacaactgtaacctttgaggttaccttttctaccagagagaaatcatttgcaaccaaacttcctggggttaccatttaccttgtcgaagtctagactctaatcaataatgaataacagaccgggtgtagtggctgacgcctgtaatcccagcactttgggaagccgaggcaggcggatcacgaggtcaggagttcgagaccagcctggccaacatggtgaaaccccgtctctactaaaaatacaaaaattagccgggcatggtggcgcatgcctgtaatcccagctcctcaggaggctgaggcaggagaatcgcttgaacccaggaggcagaagttgcagtgagccgagatcgcgccactgcactttagcctgggcgacagagcaagactctgtctcaaaaaaaaaaaaaaaaaaaaagaatagtaaatcaaatacaggtacagtcccttagaatagggtccccaacccccggtttgtagtctgttaggcatggggttgcacagctggtgagcaagcattactgcctgagccccgcctcctgtcagatcagcggtggctctagactctcacaggaacgtgaaccctattgtgaactgcacgtgcgagagatctaggttgtacactccttatgaaaatctaaggcactgcccactcccatccatggaaaaattatcttctacgaaaccagtttttggtgccaaaaaggttgaggactgctgccttggaatatgaagcaaactttgggtgggtctgttagacaagactcccagatgacttggaaatggcatgctgtcagctttttttgtcttattgccgagcctagaactttttttaatttttattttttttgagatgaagtcttgctcttgtctcccaggctggagtgcagtggcacgatctgggctcactgcaacctctgcctcccgggctcaagcgattctcctgcctcagcctccagagtagctgggattacaggcgcctgccaccacgcccggataatttttgtattttagttgagacgtttcaccatgttggccaggctggtctcgaactcccgacctcaggtgatccgcctgctttggcctcccaaagtgctgggattgcagatgtgagccaccacacctggcccctagaacaattttttaaaactatataatggagatcttttaaaatcagttcagagagcagccttatgttttttttttttttttttgagacggagtctcgctctgtcgcccaagctggagtgcagtggcttgatcttggctcattgcaacttctgcctcccgggttcaagcgattctcctgcctcagcctcccgagtagctgggattacaggcacgcgccaccatgcccggctaatttttgtattttctgcagagacggggtttcaccatgttggccaggctggtctcgaacttctgacctctggtgatctgcctgccttggcctcccaaagtgctgaaattacaggcatgagccactgcgcccaggcttactttaaaaaaaaaattaattttttgtagagacaggagagtttcgctatgttgccacctgaacataaatgctattttctttttcttttcttttcttttttttgagacggagtccgtagcccaggctggggtgtggtggcaccattttggctcactacagcctccgcctcccaggttcaagcgattctcctgcctcagcctcccaagtagctgggactacaggcgtgcacccctgtgcccagctaatttttgtatttttagtagagacggggtttcaccatgttgaccaggctaatctcaaactcctgacctcaagtgatctgcctgccttggtctcccaaagtgctgggattacaggtgtgagccactgcgcctggcccataaatgcgattttcattcccattttccaacaaggcgactgaggtatacattgaaggtgaattactaggacaaaagaaagatggcattttacttcaataacagtttgttacaacctgtactgctacctatctgccatgggagtgtgcctttccccacactgacaccagtgctggaagttatcaacctccttcatctttgccaacctgataggtcaaaagtgatcatggaagatccacactcgctttttttttttttttttttttgagataggggtctatttctttttcttttttcagagatggggggtctcactatttctttttctttttttcagagatgggggtctcactatgttgcctaggctggttttgaacttctgggctcaagtgattctcctgccttgacctcccaaagtgctgggattacaggtgtgagccgccttgcttagcccttactgtcgtttttttgtttgtttttgtttttgtttttttgttttgttttgttttgtttttgagacagagtctcgctctgtcgcccaggctggagtgcggtggtgcgatcttggctcactgcaacctctgcctcccgggttccagtgattctcctgcctcagcctcccaagtagctgggattacaggcacccgccaccacacctggctaatttttgtatttttaatagagatggggtttcaccatgttggccaggctggtcttgaacttctgaccttaggtgatccatccatctcagcctcccaaagtgctgggattacaggcgtgagccaccttgcctggcccttactgttggtttaatgccactctcccttagggtgaccaaccaatccagtttgcctgggaccattctggctctagcactgaaagtcctgtgttccaagaaacacccacctctcctccaacctgggcaaagagggacggttggtcaacctgcagtcctgggttataagtgaggctgagcgtgtttgcccatggtcaagaaagaagggatcttggatgagggtgtgtaacaggatcagatttgttttgtttttttcttagagtcttgctgtgtcacccaggctggagtgcaatggcctgaacacagctcactgcagccccaaactcctgggctcaagtgatcctcccacctcagcctcctgggtagctgggattacaggcatgcatcaccacacccagttaactttttaaagaacactttttttttttttttaagagacagggtcttgctatgttgctcaggctggtctcaaactcctgggctcaagtgatcctcccgccttggcctcccaaagtgctgggatgacagatgtgagccattgtgcctagccaggacgagatttttagagggtagagtaggaataagagcttgcacttatgaggcacatgatggcttcagctgtctgctttgcagagtctcaagaaagctctgagaaccttaagcagaggccattttacatgtgaggacacagaggtacagagaggtgagataaatggccaaggtcacatacctaagaggagaaggaggcaggatttgaatcgcagcctgcacgtcaccccatggtgagtaactggtaagtgagtgagcatccctcctcttctcttgcaggccccctgacttgggcctcagtgtccccgaagatcatgatggcgtatatgaacccggggccccactattctgtcaacgccttggccctaagtggccccagtgtggatctgatgcaccaggctgtgccctacccaagtgagtacagtcgtttctcttggcaccccaggctggcctcatctcttggaggacctctggggtccctttgcccccaggaagaaggcaatcacaggggcgacttcagggccatacaccagccctctgggttcatctgaaatgtatgtcacttagaaaaacattagcagtcctagaaattcaggacagaggttccttttggggtgaggaagaggggatgtaatctggaaggggaatcaagaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggcccggggggcactttttttttttaattttatttttgagacagggtctcactctgttgcccactctgaagtgcaatggtgcaatcacagctcactacagcctcgaactcctgggctcaagcgatccttttgccttggcctcccaaatagctaggattacaggtgcacgccaccatgcctggctaacttttttaagtttttgtagattttgcaggatctggattatacaaaacatagaaaaaattattattatttttttttttgtagagattgggtctccctatgttgcccaggctggtctcaaactcttgggtccaaataatccgcctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctctttgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgtttttttttttttttttttcaagaccgagccttgttctgttaccaggctggagtgcagtggcataatcttggctcactgcaacctctgccttctgggttcaagcgattctcctccctcagcctcccgagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgttgagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccaggcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtggggtggtgggtccctggacccctcccgacacttcctgtgatctcaggaggcctgcccggaacaaagagtgatgggaggagggagagatcacagagtgacagccaaagttataaaggggacaataatccctctccccaccatcccactgaccgcctcatggctctcattgcccctcgctcctctccagctgcgctggccctgacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgacggacactcagagtagtagaaaatggttaatacatgtttattaactgactgaatagacggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgggtatatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccggatgggtgtatttatgtatatatgagtgtatgcatgtatatatgattggactgataaataaaatgtgtgtgttagtatgattgtatataggtatgactggatggattaatgtatatgtatgcatgatgtatgtgtgtatgatgtatgggtgtataattgtatatttgtatgtttgtataatcagatggatggatgaacatgcatatgatgtatgtatgattagatagatccattaatgcatgtatgatgtatgtgtgtatgacctatgtttatataattatatgtataagatggatgaatctatgtatgatgtatgtgtgtacaattgtatgtatcatcagatggataagtctatgtatgatgtatgtatgatcagatggactggtgaatgtgtgtatgacatatatatgtgtgaggtatgtatatatgatcagatggatgtctacataatgtatgtgtgtatggtgtatgtatgtataattgtatgcgtgtatgtttgtatgctgtaggtatgatgttacatatatgtgcatacacacgtgtgtatgattggaaggataaatgaaatatgtatgtttgtgtgattgtatgcacatatgattagatagattagtgtgtagctatgtatgctgtatgtgtgtacaatgtatgtgcctataattgtatgtttgtatgtctgtatgatcagatggatgaatatgtatatgatgtatgtatgatcagatagctggataaatgtatgcatgatgcatgtgtgtatggtgtatgcatgtataattgtatgtatgtttgcattagatggataaatgcctgtaggtatcatgtatgtacgcatacatgcatgattggatgactggatgggtttatttgtgtatatatgagtgtacgcatgtatatataattagatggataaatgaaatgtgtgtctgcatgattgtatgtatggattaatgtgtatatatgtatgatgtatgtgtgtacaatgtatgtatgtataattgtatgtttgtatgatcagatggatggatgaatgtgtatgatgtatatatgtatgatcagatggctccattaatgcatgtatgatgtatgcgtgtatgatgcatgtacacttgcatgtatgatcagatgagccagtgaatgtatgtatgatgtatatgtgtatgatgtatgtatgtatgatcagatagatgggtaaacgtatgcatgatgtatgtgcgtatggtgtatgtatgtataattgtatgtgtgcatgtttgtattagatgggtggatgaatatgtgtatgatgtatgtatgatcatatagatgggtaaatgcaggcatgatgtatgtgtgtatggtgtatgtatgtataattgtatgtgtgcatgtttgtattagatggatggatgaaaatgtgtatgatgtacgtatgatcatatagatgggtaaatgtatgcatgatatatgtgcgtatggtgtatatatgtataactgtacgtgtgcatgtttgtattagatgggtggatgaatatgtgtatgatgtatgtatgatcatatcgatgggtaaatgcaggcatgatgtatgtgcgtatggtgtatgcatgtataattgtacgtgtgcatgtttgcattagacggatgggatgaatgcacatgggtatgatgtatgcatgtgttcatgcacacatgcaggtatgattggatggatagatggatggatgggtgaatagacgccccacagctggatgcaaagtagacagatgtgaacccagcacctctcaccaataagtgtcctcatccccgggcaccctgcggctctcctgggcctcttccccacttacccacccccatctccgctcttatcccccaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaa

SEQ ID NO: 34813 - RNA, 128312 nt, Homo sapiens
aggacacagcguccggagccagaggcgcucuuaacggcguuuauguccuuugcugucugaggggccucagcucugaccaaucuggucuucguguggucauuagcaugggcuucgugagacagauacagcuuuugcucuggaagaacuggacccugcggaaaaggcaaaagguaacaguuacugucugugguuuaaaaaugagguguggagcaaauaaacagguuggaaguguggggugggguggugggguagggugguggggcagggugggggguugugagcagucagugggcuugucgccgauuagcacugaagcaguguuuagcuggacggccuuucugugggccccucugacagugcccuucccaggaagauguguuucucuguccucagccacaugaaaaucuuuugccuaccgugccugucaauccauugccugcccgccccucccccaccccccguuuuacaccugccuguccagucuaccgcucucuagggcauccacgcugagcagugggaagaacuuuaagcccugaagagcaggccaaaggcaagcaagaacccccucgaacagcuucccagcuuagugaggccuuauuucauugauucucugaggcacauuguuuuuucacauguuagcauuucugaaauugggaugcagcucacgaucaagucacaguuuaacuggacacauuauuuuucuuucuuaguggugcagaaaaguaacagugugucuuacaauugacugcguccuagauucugugagaugcaauacguuauuaaccaucacgcacauuuccugaacucuuucaaugagcagacaccagccuggguuagacuggagcccuaaaagcacgacacagauuccacccuggacuggcuucuguucugccugggaaaacccaaaguacguuuggagaccaagagcaacauaaaguagcauagguggaauaguccaugagaagugcgagcaaaaggugccggagaucagagaacaccaagacuguacuuguaaaugacaacuggcuuugugcaauuuuuucugggaaaggauaaggagugacuauagaacuguaaagaaagaaugcacuuugcuacagccuugcagaguugugcaaaugccgaugacuaaaggagcugaaagaggaaggaggggauaagggaugggggcuggguaggggugagauuaggacccugggagcugcaagccacuggagagaucaggaggaaagggagggagaccugcuuuaggcgagaagagaacaguauuuguuccaaaucucgguucagaauaaguucauguaggugauggggccaacuggaacaggugaaggccuaugaaugagugucucaguuagggucuccuuagaguuuaauaugaaaagguguuagcuaaguacagagcugguaccugagagaguaaaaggaaacucuaagguaucauggagguagcaauugcaggacacagcucccaccccuagggcugagagaaccaagggaagagacaggaauuauuaagacuuggagcauagaugagaggucuguggagcugacauuaggacuugggaggaaggcgugcauggaggcugcugcuggaucucugaaccugaccucgggucuggaccccugaggagaaagcccuggcagguuggugcauguggggccgagggacaauagcuuaacaaccagcauaaaagagagcagcaugggacacgcuucaaccaugcgcauggauggcuccaaaaccuguguguggcuggcccaggacgcagggaggcugcagggggaagagacaaguuaaaccugacuugucugggaagcaccauuguccucaggucacuuuccucugucaagccuggugcugaaguuaucuguugucuccaggggccaaguauuaagaguaaucagaaacucaguccuuucuucuaggagcuucccuucuugcaugaaaauccugauaaaacuggaaaaaaaaaccucaugauuaaauuuuuucauguauucauucuuuccuucuaucaaaaaauaaucuccaggcaccgugcuagguucauugguauacaauggcaacaagaccucccagccccugccuaugugaggcaucuguggacugcggaggaaaauccaauaugccauuguucucucuuucccauaagaaauuacaauucucaguucauuuuauucucacugugcucuuugugacccucaaagggggucacaugauaacaggacuguagcugcuggccuaaaaugagcccauuccuguggcgcucaugucgcugugacagagaauaacccuguuuucagaaugcucuggugcccucccucucaaucuggccuuucgcuggcaugggugggcgacuccugcucagggacucugccuucuccacagugugcucccagggagauggagccacucgggcugagggccuuggccagggcaccucccagggcugggccuggucugggcuggcguucacuggaugccauccugauggccuggaaauugagauuucugucuggcacgccucccgauggcuccccaccugcuaccacauuccaggagcuuccaggaugucuggguaagacagaggcacccccaacagauucaguagcucugagagggaucuguggcuccuuccuaagcuugcgguucuucuggaaacuucugccucuagaagauggucccucuaagaaaaguacaaccacccagcccauaauucagcucccagguuuucccucaaaccuccaugucuccuguaagcagagcaagaguaaaaucagauaccaaauuuccucauuccucagcucccaaucccuaagggcauaagaugaaaaucuucagaucucugcuuuccucccucuuuuuuucuuccucuguuaacauuugucaaguguuacuaagugucuggcacuguacuaagugcaucaccucccugaacucuccgaacaguuccacgagagaggccucucugugauccccccgguacugaugaggucacugaggcuccagagaaggauuaguaacuggugggguuggaccugggauucacacccaugcugcgugacccaggacaggcaggcauggccguuacaccacacugacccccguggaucgagaucuauccaauagucuggucacugauaucacuaagauagaguggccauauaauuuaucauccaaucagggcaguuuugcaagugaaagggagcacuauuaauaauugcacugggacaauaaauguaaaccaacacuggaccuggaaaacugggacguguguuugcccuauaccaagguaagcuagacacagccacugccuucauggaguucagaaccaggcaggggcggcucccacguauaauuacugugcagcacaacguggagaccguggaguagaaggaaacacggaugggaggugaggaggaggucugugagcucagaggaggcaccggggcuggagagggugagagaagacuucccaaggaguucauccugauaacgugcauucccaaugacgagcgcucucuccacugcacaagacaaguauacaucugcccguguuggcuguggaccuggcgcugugucagggaggguuuaugaagaucacuaggugggucucuuggugucaucccuucaucccagcuucuggguuaggauggauaucugugggggggccugaggacucaugaaaguggggcgcuaaucauguuuuggacaccacacccuggagcaccugggacagcuguggccuuuguccuggguucagcaucaagccgaggauguggcaaguaaagagaggcugggcaccaacuccaguguacccaggcuccgggucauguuuguccaggcuaagaauucuguccugguucucagugcagaaggaagaaucauggggcucauuuuaggccuuggcugccuucuguuaaauugaaaacagagcaggaaggaagaaaauuuaacaggcucaguucuaaaacaacaagcacaacugugcccuugccagaaaccccuccuccccauguugauugaaugguaaagagaggaggggaggugagagggagagagagagagaggaagagagagagaaaggaaagaaaggaaagaagaagaaagaaagaaaaggaaagaaagaaagaaagaaagaaagaaagaaagaaagaaagaaagaaagaaagaaagagaaagaaagaaaggagggagggagggaaggggaaaagaaaagaaaagaaaaagaaaaaaagaaggaaauaccaguuugggaaaaaagaauuuuccaccagcccuucugagccuuggcugggcuuaauuaaaguuacagacauguguaaagggcaggguagggggagucugagcugcugagaaaacauguuuuuaauuauacuguggaauuucucccugggguaugccuguacgcaguuaagcgucaaggacagggaugccgcucuggggaggggaagcugagcaugauuuuggaagccggcagaagaggcuauugugaaaaccagaccugucaggcuaggaaaagaauggcugguggucuuugaccagggagugacgcgugaaaugcagcaaccgcccccgccccccgccaaaaacaaacacacucucacagaguuagaacaacagugaccucucaacaaauauuuuucaaagauuaccaaccaaccauuaccuagagcagcgguucucaaccuuggcugcacgguggaacuaccugagacguguuaaaaagaagaacccugaugucccaugccccaagauucugauguaguugaucugggguaugaucugagaccccggcauguuuucagccugcagccacaugagaagugcugaccuaaucaacaggggugaugauuugaggggcggggacuauaggcaaaaaaaaacagccuaauucaaggaugagaagagggcacaggugaggugggaacaguccuagggccagacaaagaaggaagggagaaaggaggugcugaucccuccccuacuccugagaggaggccuuuaagucaccgugccuuguggagaccagauucuucaaaaauacaagaaugagugagugagggaguggguggaugccaggagagugcgugacaagccuugcaagggaggaugacaaugcacuagcuugguuuggaaauuuuaccccuggaacaggcaggccaagcuggcugguccccucccugauacacagcccucccucuuuauauauggagcaggggacgguguguggcugguuucuuagcaagcaccaugguuccaaguuggcaacuggggaguucugaauccaaaaaggagggagaugaacguaaguggagggcaggccuacaagguugcagauaagcuuaauucugucuccuuacucuucugccuuugcaacaacccugugaucuugcgacaacccuguaaggcaauaacaaauggcucauguuuauugaguguuaccucaugccauauugugcuuucguguuuaacacaauugucucauuucacccucacgacugcucugggagguagguccugguaucacauccauuucacagaugagaccauuuggcacggaagaguugagugggcugcccaaggucacauagcuaagauggaacaggcuggauaggaaccccaguaacuugaccucagaguaaccuucucuuaacccugaguguacacuguaggaaaaaugagcagucccauuucagagaggacaaaacugagacucagagguuaagcaagccccaaagugguuguuaacccagaucuucccacuaacucccaaaucagcaucaguguuuaacguaccagaccucucccagauagauguugccgcauggaagacagccgaucuacgugauagaaagccaauauugcaagcagucgucuaaaggagucaaauguguuggauuugaacuggaugucucauuucuuuggugaagacacuggaaacaacuuccagguuucaucaauugcuccuaucacucaacguugcuaucuuacugaacuuguuccccagccuuacccacugauggaaugauccagaauggaagacaagacaccaauguacaugacccugggggaggcuguuucuuaaaucuacagacuguuggugaccugagccccaugucaccaaaggcuuuccuggagaagccuccuagaccagucuugacaaaggcucacucauuccguggauauuuauugggcaccuauuaugaguucugccccauguggggugcuggaaucacaguagugacaacgacagaugagguuccuguccucaggaagcuuacugcccuugagggcuucacuuacuuggaggagugaugaaccugaagugcgguguguguuaagaagcggaaguccagggccaggcgcgguggcucacgccuguaaucccagcacuuugggaggcugaggcaggcggaucaccaggucaggagaucgagaccauccuggcuaacauggugaaaccccgucucuacuaaaaauacaaaaaaauuagccgggcaugguggugggcaccugcagucccagcuacucaggaggcugaggcaggagaguggcgugaaccugggaggcagagcuugcagugagccaagaucgugccacugcacuccagccugggcaacagagugagacuccgucucaaaaagaaaaaaaaaagugccucacggagagucuauucuuuucuucccauauugugugugugugugcgcgcuuccuccaacacauccucccuauauauauuuugaguaaaacaucuuguaaaaaguuacagcuacauaaucaccaccugucccuaaauaguuuuugcuuuuucuuucuucaaugcacgaucauuuucccccaucaauuuauuuuuuaguuucuuauaaucuuguugccaguaggcuguuuuuuaaaaagcagaacaugguuuguucuuacuagcaggaaaggagcauuuauugagccucugcuauggugucuuuuauuuugcugagagccuauuuacauuucuuugagaggaaaacaacaaaggguuacaugaaagaccaugugaauagccccuagcugaucuauuaaacuugcuauuccccggccagcugcuucagaucuccuucagaucuuauguguuuccuuccuaaggucccuggaguaaggguugcauagaccuauucuacucuccaacucacaugucccucucccucuuccucuccauaauuccacaucuccaacccccaccccuaugugcaaugccacaggguguggacugccacagccacuggaucugcuuuuggaaucaagaguccuuaagcuccaaauggaaccgaaauuuaaauaccaacuuucaaccauauguuaacaucagcagccucuuccaauguaaaaacccauggcagugugcccugcuuuguuucuuuaagcaauagaaacuugaaggaagcauguugguaggccagauuuuuguuggcuuugcaauggaucacagucauuuauucacucauucauucacugauucauuaaaugaccacauuugcaagggcaagguaauggggagggccagaaaggacacuggccccagaaacaggaggcuggauuuugguucugaugcugccacugcugaugugacacugcacaggucaccugccuccucugagccucuuuccuuaacugcagagugaguggcuacagagaaaucuuuacuaccuguuagaucagcauuaccugggagcuuguuagaaaugcaagcucugguggggccauacugaacccaaaucugcauucaugugcauagugacagcuaaaaugcacugaagcagaugaucuugaugauccuuuaugaaagucucaugcuaaugcaguuuucuaaaauagaggcagaguggaacccagauggacacaaaaucugguugauauaauaaaacaagguagaggguguaugguggggaggggguaaaggaaggaaacuguuuagguaaagauaccacaaccaaaguccuacugcacacaugggaucugaggagggcugugucugcucugguuacguuuucuauaaucucuuagcaccacugaacuuucucucuuuuuguuuuguuuuuccagauucgcuuugugguggaacucguguggccuuuaucuuuauuucuggucuugaucugguuaaggaaugccaacccacucuacagccaucaugaauguaagcauagcaggguagcuugggcaagcccugaagagacuuuggucugggccuuuugucuagaaagaucuuggggugggaguguggggaucagaucugcuuaucaucauuucaugucuaugaugcauguaacagauuuaucaauguuacacaaauuauaauuuuuaaaaagucuuuagagacagggucucacucuguugccgaggcuggaguacaguguuaggaccauggcacacugcagcuucuaucucuugggcucaagugauccuccugccugggcuuccaaagugcuggaauuauaggcaugagccacugcucccagcuaauuuuuuuguuuuuuguggagacagagucacuacauugcccgggcuggucuugaacuccuggccucaagugauccucccaccucagcguucuaaagcacugggauuacaagcaugagccaccuuguccagcccaaauuuucauguuuuaauccuacacauucuaagcaaauacuuguguguaguuacuaagggacugugcacuuauuuuuguuugcuuuguuguugcuaguuuuuauuuuuuuauaccuaaacucucucguuuuaaagagaacagauuuguagaugaguucucgaaaauauuucaggaaucaauauagagaauauguuauacauggugccagagaaaaaugaggacaagagaugcuauacaaucguacugaagaaaaauuuuauuucuuggaccccugaggugucugcagaccugaaaggaaccuagugagagccucuuuuacacucugccccugugggaaagccuucaccugguuuccggcccucuauguggugaauguggaagccucaagcguuaugcaaaucugcccaguccucuauucuugaucuucaccuucucguucaugaguuucaggccccaguucugaaucagccuccuguccaucagacucuucuuuaccucuccccgaggagcccauaaccugcagcccuacugcaugcuugggguaggugcucaguucaccgugguugaaggaauagacgagcgucugcucaagcagcagcagcaacugcguggagucuucuugaacuaacacuccuaugccccucucggcacaaaaugacguguccccccuugcuuccccuucacauuuccacccaugccuauuacaacauccgucugucuccccacuacaccgggagcuugagagaagaggccaugucucuagcacccagcacagggacuggcacacaugagaugcuccugcuucuuaaaugcugagaaugaaggaggacaucagaggggcccgggccccuucccaaaaaggccaacuccuaggucugcauccugcuuggucuccaugacuaaucccgucuuguccucauuuucuguuuuaaaggccauuuccccaacaaggcgaugcccucagcaggaaugcugccguggcuccaggggaucuucugcaaugugaacaaucccuguuuucaaagccccaccccaggagaaucuccuggaauugugucaaacuauaacaacuccauguaaguguugagaucccuaccaugcaggggaggaaguugcacaccccuucacgugcugaaaugcacacgugcgugcacggagcauggagcacugaguguucuuguggcuuugcugagccccuaaccucuuaggagcagagcagguuuccucucuggaacauucuguuaacugucagggcacuuggggagaaaucuccaagcuaaggccacgugcacaaaauuucuugguccuuauauccccagaaugugaccuggagucugauggcagcccgcugcagagauguguccacugccuucuggucauugaccugcuuggguggagugaaucauuguaggagaaaaacucaguucccucacccugaucaaccuggacagaucucucuuccuuuaaaagcuuucuuggacaucuaagggcuaggaaaaaugucagggagcauugggaagguaaaugaagucagguuuacaaagucaaguuuacuucuugggagaaaaauacaauuuccaaauccucuguuauaauugccaucggcccccuggaguggugagaucucggaauauggcucgggugcaguggcucuucacugugggccugcaggcuauucugaaaagcugaugaaaaccaaugaccccucuuccaagaaaaauggccacauaccaaacauuacacuguacaucugauuucagggaauuguagaugccagguuaguagccucaggucuagggucaaaauucaagucgaaucccacaggaagagggucugccuucggaauucccuuucagagcauugggagaacaucaugggagcauauucuagagacagaggcuuaggguguggacagggccaucccucacccacugugcugaccuuaagcagcaccuugugcagcccauaccugaaggccaccagcaaaggccuguuggggagcaggcuuuacccgaccuguauaaacaccaggcuaggugaaaacugagauaccugguuacuuuaguuuuuuccuugggggagcucaguaugauucuuccaggagaagccugcuuuuagacuaaaaagaaaaaaaguuugauaggucaaccuaaugauuggagguggccuuccccacugugaacaaacuauggcugcaugugcccuacaauggcagaguugaguaguugugauagagacuguaugaucuguaagccuguaauuuuuauguuugcugaccccuggauuaccagaugauagaagaggaaacaucugucuuccuagcaaagucaaggaaguggcauuuagcaggacucauauugcugcaagcacugccuugcaguuuuaguuuacaacugcacuuucagcuuaagaaacaccugcccauccagagagaucguguggggucacauggugggaucagggaggccugaagacagcucaguggaggcugcauggagcuuuggugggaacggcccuggcagugucuauagauguuauugcggaaaacugaggggugggaguuggagaagggggcuccagacucuagcuguacuuggcauuugaacccggaaaguuggguuucauguuuugcacucacauuaugagugaaauauuggcuuauucaagguucuuuugcuugcaaggcacggaaacccauucaagcaaucuuaaaccccagaaggaaaucuaugauuuggauacuagacauucucacagagccaagggcagcaaggcggggcucaggagaggcaggccaagaccuggagagcugucaggagcugcuuccucaacucucuuccaucugggccugccagcccuggccucuguaucuacuccauucaccucucuccauggaccagucuccccugcuccucaaugccugggcugccauuguucaugcaauucacaauaccucggccugggcaaucagaagcucaucucugaacaccauccaaauuccugggaacaaaucggguugacccagcuuuauucucccugucccaucagccuuggcagaggcgugcaugugcaugcgugccaaugugugugugcagggagguccuuguggaugaagcauggcugucagagccuaccugcgugaauggguggaagggcaggucucagagaauuggguaaaaacuggauaaacccuccagugauauccaccaaugucacccuguuuaaggcuucucugggcaagagacacacagagcaugggaccgagaggcgagcagacccugccaaaacugggagacugaauagaucgcucaccauccuugucaguuagccuauauguacaaggaaguaaaauuaucucuuucuccugccuuggcaguauuguaaggauacucaauguaguagcuaggccagacacauaguaucuuuaaauauagcaugagauggccaagcacgguggcucaugccuguaaucccagcacuuugggaggcugaggcggguggaucacgaggucaggagaucgagaccauccuggcuaacacgaugaagccccgucucuacuaaaaauauaaaaaauuagcugggugugguggcgggcgccuguagucccagcuacucgggaggcugaggcaggagaauagcgugaacccggggggcagagcuugcagugagccgagaucacgccacugcacuccagccugggugacagagcgagauaaaaaaaaaaaauagcaugagauauuauuacuguuauaaaaauaacagcuauuuccuuauuaaugaggcuuuguccuuacagcuuggcaaggguauaucgagauuuucaagaacuccucaugaaugcaccagagagccagcaccuuggccguauuuggacagagcuacacaucuugucccaauucauggacacccuccggacucacccggagagaauugcagguaagcaugacugcagugcucucaagcaucauuucccucaccuauggagagacugaagauauaggaaagaacagggagaguuggugaaaaauauacuagcggaggcaggaagggauggggucuggaggcggcuugaacaucaccuuggugaagaugccucuuccuccacagaagccuggaagguaggaaguugggaaggaaggcaggaaaggucucauccacguuaagucuagagacagaaagaaugcuaagagagauggcacuaugggaaguaugaggcuaggucaagggcuagaagcaggggagacgaguuuacagaguuucguaaagauauagagcaacucucacagaguucuagagcgagagcuaaccaggaacaugaagcagcaaggccaacuaucauuaaggagccagggaggucagagaucauguauuaucaugacauaaauaugcauaauuguacuauuucucccaguaauauuuagcacccaggccccgaggcagagcaaguggagagugggugaugcagggcuggggguguguauggaggcaccacagaaggucaacaggcagcgggcugaaggcagggacuggacuacaugcaucaaguccaggcugcacgaggaaggaugagaaggcagaugagcacggaaauggacugggggaaaugaagaggcaagggaauagaagucucagugggugccaugacccuguuuaagugauugagaaaaugaacaagaugaaaagguuaauggcuguggucagaaagugaaauaugugaauucaggauuucgaagguagggugggugaugacuggcccccagaugcggccauggugaaguggggcaaaggugcaggugcauggugaggggaaggaggaaaugggaggugaugauguuggccccacacggacaccacgguugugcaggaagauggcaggagcugggcaccagggugggagccaccuggagucaggaagagugaagagaaaggaugaagaggcucccucuccugugucucuccuccccaggagaagaacaagaaacaauccgaaaguaauaacaccaaugugccuuuacaaagugugaguggguguugugugcugucacguguguaguaggcuccucuguggauggcuagagggacuggacauggccacuggaucccacuugcaagagcagaggaaaagaguggucgugaggaaguaaagccccccaaaauccagggguugcugcagcuuuggguguggagcgugcccucugaggaaaggcugcucugggggagauugcccaggaaacggggcucagaggccacgaaagcagcuguuaggggcuucugggagaugugugcuccuaggauuagggaguugacucuaaggaugaccuuagagguuaacagggaugagaaaggggucaccaaggggucuaccaggggaaugggagaggcuguauugauagaacagcuucugcugcagguuccaaacaagaaaugugggagaaugguugaaaucagccccgggggcaccuucccgugcaugcgugcagcuccuucaacauucagucgaccuucagugccuccugugagccaggcacugggcuagucucuggggguggagagaugagucaggcaaaugccagcccucagagggcucacagggcagaaggugagagaugagugagcagaaaaugaccacagcgcguguggggcccaguggagggaaggaggggauucaggagcacaggagagucaacaggggaaacuucuccgaggagaaucugauccuccucccaucuggccaccuucugaagcccucucuccccauccaagugagaaaggacaggcguaugaccagauugguguaugaagaugcugaauuacguucucauuguuucaaacuaguaaaccauagauuuuauguaguaacuucuacaaacugcauuacaaacacuccauucuuuguugcccuggguagaaguuuauuuuagugagcccaaguuugaggaaccuuauaugguaugaguacaauuaccauuuuaauaguaagaaaucccccuuccccuguguaccaaccagaagguguuuuuuuccuaauuuaaacaaacagaugcagacgugggcuguccagcuccuggcgggaugacauaccucaugcauccaguggguuugaugaugaggcagacauuucacuuaagugccugaucaucagauugaguccugcugggaggaagugugaaggaaguaauuucaaaccacaguuucucuguggcuuuuacaauguggauaugagaaccaaaaucacuacuucuuaaccccagagcaggacugauuuugaauugguaugcaggcgguuccuucugcaggcuucgggcugugagaagucccuaacagagcaaaucuggggacaagggcucaggaaagguuggccacggcccccuaggaaugggggcucugcaagaucccuggccuuagaggcugugagagggaacagggguccauccccaaguaagggacacggucuuugaggaaaucccaggccagggccugaagggcacugucaggaacacaggcuguuucagucuguugagauucaccggggcgcugcucacugugagcacggacuccucaggccaauguggcagaagagcccaccuuugaaagcgagcggguggggguggcggggcuggugcuggugcgugcuucugcacagccaccugggaagguaugccgcugguugacccaggcagagguuuucuuucauggcaaaccugcaguacugcauucucagcagggaggauuaaugguaaaagaccaggcauggagcccccuucccucucccucgaagcaagcucuguggucucucaaucaucuuuaaaacaccuucuucccgggagccuccuacauucuccuggcuucccucccacccccacccucagcuccuggggccucagcagccccacccccaagccucuaaucuucccagggaagggaacaagaagaaccacauuuuaaacgaaauuuauuuuucuuuccucaggcucccaguucacauuucucccucaggagucuagggaagcuucugucugguaucggccuccucuucaccugggcccccgcccuccucagguguaccagaagccagcacacucccccuucccccccagagccacagcagcccugucuccuggguggucuugugugccaagccugggcaacaucacucccagcuuuucuuguuuugccccuucuccccagcaagauauuuguauguaaggucaggugagugaguuaaagaauaacgaagagauaaacagucaaauggaguccugacugucaggucaagacaacaguuauuuacugaaugccucaugucauucaacagacauuuauugagacucugauuggaugucagucuuuaaugcugggugucagagagaggugacuucaagggcuugcaucugugcacccagcauugcuagguacaaugaggaguauaauaaaagcaggagccauagcccccaacucucaagagaucucccauguguguaugucugcauaugcgugcgugugcaugugugcgcaugugugcaugugugugugcaugugugugcaugcgugugugugugcguguguuggggaugguguugguggagugagaguguacaaggcuguguaugaagggguaauugggaaaagaacaauggagcuggcacccagggacaggaggaaaagcaggagggcuggguuuggaagacagccggauuuauguuuuugaagagggaagacuagaauauaagggagcagcccuucucagagcccuccuccucccuucgggcccuguguccagcuuuccccaaaguccuuggaucuuuccuaugcaaaggggagugacagugggcaccacucucagggaacccauuacugugagagaagccacugugccacuguguggucgaacuucaagaccggcuuccccugccccagcugcauggacaggccugugggguuggcgcaagacccuuccagaggaaacuagcugcaacauaaauccggauauggugcuguucagggaaaggcacaaccuggggaugagaaggguggcuguccagcacacaggggcaggccucuuggccacugggggaggggagaauuuggagaggaagaggaugggaugccguggaauugggaccaggaaagaauggggacaugugaugguuaaagcuaguuagagaagaacugggagauaaacagucacccaugccccugaagcacucggggugaagagauuggcauuuucacgcaccccagugcuuucccuuuguguugaagucccuucguagacauccaggcccauaaggcucuucucuggccagagccucaugaacuauagcacuagcaggguugaggccaagcauuggcccuggaagccagccgaggaggagggugcuugugugaaucucccaggagggguaagaauuauauuaauucgaucauaauaagcauuuauugagugcuguuuugaggccugggagcuaagcacuucacauuccuuaccccgcaucaacaauccuaugagguagauguggaaaaugcagacacggggacaggcucaaucacuugccccaaggucaccuuaacuguuagguguucuuuaugccuccuuauaaagaaacccugcuucccacagguguugagaggagcuggagggagcuugacuagggcucaucaggcaagccccggcaugugccuggcucuccucuuucuaccuggagcuuuuccugcccuuaauggccccaacucauuucucuuaguccaugucagugcccugagcaucucagcccaagcugagaugauagaaacacccagagggguccucuacccugugacagcugcggugugggaagagcacgugucuccuccaauccuagaccagaguuucucagccucagcaucacugacacuuggggcuagauaauccuuugugugggggagggaggagugucuugggccuugcaggauguuuagcagcaucucuggccucuacccaccagcaccuccccaguugugacacccagaaaugucuuuagaucuugccaaauauuuccaggaggaugaaauuccccuguuucaguuccccagccccaccucaaugagaagcacuguccuagaccaaccccacaaagcaucugacacccccauccagcccuggcuaacuuuuuccaccuucuuacuaaauugggcccagcugcuucagcagucaauguguugggggcagcccacuggcaagagccucaccucuaggggcucccagagaccccaagaacagaaccuuccucugagaguugaguuacaaguguuuccaaucgacucuggcuguuuuccuuuuuuugacccauuuccccuucaacacccuguucuuucucuuauucauauguaggaagaggaauacgaauaagggauaucuugaaagaugaagaaacacugacacuauuucucauuaaaaacaucggccugucugacucaguggucuaccuucugaucaacucucaaguccguccagagcagguagggggaugucacuggccaguggucccuggaggggagggaagcacccagccugagaaaggcaagaaauauauuggcuuuuuucuucuuucuuccuuguguucacauucagaauccaucacuuaaugccuuguauuuagaaaaaaaccgggggaucacuugagaucgugaucauuuucaacauaggauucgaagcuguacacauccuggugaccuuaaaacaucucagguuuuuauaacuggaaggaaccuuagagaucauggggcacaaccuucucuuuauagaugaggaaacagaaaucuauucauuuauuacucaaauauuuagggacaguuguagguacuagaacacagugugaaccagacaggcaaaaccccaggccagggagcuuccauuccaguggggccacaggcgaugcucagguaagcagagacuccgcugugugacuucuggcugugaugggugcugcaaggaaaauccgguagagucgaggguuagagagggacggaggggcagguuuaagggggaugcucaggaaggccuuccugaggaggugguauuugagcagaguugucugucagccacacaguaagugagaggggaguuccgggcuuggaagcugccagcacagugcuggcaagugcugggguggcgucccgaggcuacagaaccugagaugcugcagaagagcccacuucugcuuuccuggaccacuuccuucucagcaccaggcaaacuccuucuucuauccccuggcacauuucugaccuguguauacgcccccaauuuaucuaaccccuuuaaauaaucuccucuauuuaugcagagcauucuuaccacuaacucacgacuugcacaucccuuagcucccuuacuccucacaacaauccugagaugggucagagaaggaggcuugcgcgucuggugauggggugauuugugcacaguuacagggcuagaaauugucagagccagauggaauccagguccucucaauccuaauccaguguuucuuacuucaguccuguggcucucaaagcccagagaccagcagcaucagcgaugccugggagcuuguuaggaaugcaaauuaucagggcccacuccaggugaacuggguccaaagcccugggauaaggccuagcaaucugugcuucacaagcccuccaggugauuccgcaggcucaggugugagagcugcagcuguccucugggccuucugggcuccccgcccagcuucuucagugugaugaacacagcgagaaugcuagaucugcagcagcugauaucccagacacccucccgacucccuccuggcugggucugauccuccuccagacuccaggagagaacgagacauaaacagaacuucagagccuguguuaacccugagaucaaggucugcacagggugcugucugaguccagaggagugagggaccccaccccaccuggucagcaccagcuccuggaagcagguucucacacugguucccugcacaaugaaggagcucauaccugcuuuucuggcuucucagacccugagguuuucaccgaaacuagacaaggggaaccuagggucagccuggaggcagggugagcuuggcgccugcagugcccaggcccuggguggugcggcuccggccaggcccuguuuagcuuccucucccacccccacagagggggugcugucggcaccgauugcucauuuuccccuuugcuuucucuucagcucguaaaacucaaguccugacaaugccuugaugacuuccaguugguaauaaaagggagaugaagauaaggacaggaauuucggggaaauuucuuuccaguuccuuacuaaugugacauuuagaucucuaguacugugcuucuggcaucagugccaaggccuuucauguuggagaauggaggccggggucaccagguugugccuuuauuucauguugcuggcucugaugagcugaugcucugcugauuagcaaacgcugagccaucugcgcuucgcagaggcacguuccagccaacccggcccucccugcccacuucccaggaugcuuugccuugugggcucaccugucuucuagcuccugaucuguaucuccaccuccauccaguuccggggcuccuuaucagcacuguucccagaacuguccaucacgauggcaacguucucucugggcgcuguccaacaugggagcucgccucuguguugucacucaugcucauugaacauggauuuguguccuuuaccaucaggacuggauaccccuccugguccuuucugccuggggucuuagcacagcucagaaggaaccucaccauucccucucuccaucuagggaauuagaagaugacaggggcacaguucucuggcucacccccagcccaguaaacuccuggacaugcuucaaggcccagcucagauguugccuccucagugaaauaauuuauaaacccacccuucuuuguccugccuucucccucuucccuacucacuggagaguuaacaggugaugguuaagcucuggguucaaaucucacaaggccacacacuuagcuaugugacuucaggcaaguuaauuaaccacucugugccucucguuuccucauuuguaaaauggaaauaguaaaagugccuaccagcauggcaguugaaguuaaaagaaauaauauaugugaacacuuggaagggcgccugacacauaguaaacucucaguaaauacuagcugcuuuuaguggcuauucuuaacacacccucuucagugcucugguuucacuauguuuuaugggucccugagaucgaaaguguccacaccgacucauggucagcuguaaccugugccucguguggggaccaggcugccauguguagucuggacaguguaggagguggcagagcucaggccuguucugcccuccagcccagagagccacgucguuagaugucaugggagacuguggugccccgggaaucucacgaauuugcccacgguacucagugucuguccaaugcuaugggaguccaggacucuaggagccaguuaaggugcuggguggccacaggucccuggccaagguccaggccucuccccugccaccugauccucgagaggccaucacgaggguuguacuucaagaaccacuauccuugagcuaccuaggagcugcagaaugugcacucugcagggcuuagggccugcagacaagauagaugcagggugucuaguuaaauucgaacuucagauaaacaacaaauaauuuuuucaaauaauuguguucuauucggucccuauuugggacauauuuguacuaaaaaguauucauuuaucugaaauucagauucgacugggcaucuggugcuuuuguuugcuaaauccaagagcaaauuuguucuagcuacuucucaaccccaccuucagagaggaagccuugaugguacuguaacaucaugcuguaagaaggggaucccuugaauuguaaauggcacucugauaagaugagguauggggauuguauugguuuccuguugcugcugucauaaauuaccacaaacuuaguggcuucaaacaacacagaugcauuaucuuacaguucuggaggucacaagucugaaaguuagggcaucagcaggacugcauuccuuacugcggaguucuagagaaaaauccauuuuccugccuccuucagccuccagagacacgccacauucuuuggcuaguggucugcuuccaucuccaaggccagugggggcuuaucaagucuuucucacaucacaugacucuguuucuucugccucccucuucuacauuuaagggacccuugugauuacacaggggcccaccuagaaaagccaaaauaaucuccuuauuuuaaaaucagcuaaucaguggcuuuaaucccaucugcgaucuuaauuccugucgccauguaacacaagguauucccagguucuguggguuaggacgugggugucuuuccuaccacagggcaguuucuaguguugccucuucucccugcaguucgcucauggagucccggaccuggcgcugaaggacaucgccugcagcgaggcccuccuggagcgcuucaucaucuucagccagagacgcggggcaaagacggugcgcuaugcccugugcucccucucccagggcacccuacaguggauagaagacacucuguaugccaacguggacuucuucaagcucuuccgugugguaagggagggguuuggcugcucgccaauugcaaggugauuccugggguagcagagccucacgaauugaccuuggggagggcgugagccugguguucuggacaauccuugcaaaagcuccaggcucccagggcucaaaaaaucacaacugauaguauuucuagaacaguggcccagggacccagaagucacuaugagguucaccauuagguauguggcuguggcauguuuguguccacucuaaauguggggauaauccccuuuaccuccucuaacagagugguaaaggaaggaggaggccugguuugacucccugaccugcuauuuccuagccaggugaucaugguaagauauugaaccuuuucuggucccaguacucaucuauaaaacaaauauaauacuuuacagagugguaggaauuauacaagaaaaguauacgcaaaacauuucauaaauuuuaauaaaugauggccccaugcuucuuccucuggaaauggucucaaccucaaugguugguguuucuagagagaaaaaacgacagagaaaguuucauagucucaaaaauuuggaaagcccugaucuagcucaacccuuuguucuagaacugcaucccagacagacugcuugggaccugaaaauaucuccuccuuugcuagaaggauaagaugagaaggaauuagauaaaggagguguagagcagagguuuucacacugcaaagugcauaaaaaccaucagagggccgggcgcaguggcucacgccuguaaucccagcacuuugggaggccgaggcgggcggaucaugaggucaggagauagagaccauccuggcuaacacggugaaaccccgucucuacuaaaaaacacacacacacaaaaauuagccaggugugguggcgggcgccuguaaucccagcuacugaggaggcugaggccggagaauggcgugaacccgggaggcggagcuugcagugagccgagauugcgccacugcacuccagccugggugacagagcaagacuccgucucaauaaaaacaaacaaacaaacaaaccaaaaaaacccaucagagaaguugguaaaagaugcaagugcuaaauccccacccccaaucacugugauucagaagaaccaggccaggcccagaaucuauccuguuaccuuaggcgauucugaugaagaccauuguaggccacacuuucagaaacacucaaaauuagaauccuucagagaagguggcauauauaauauuucuagcauggaauuauguuuuuuuucuuuugccuacauuuuaauuucuagaacuguguuguagggaaugucagucacuaagaacuugauugaggaacuguguuuugucuguuucaugacugcucucucaagucccaggaaacucacuuucagcuugucuuaaaaagcaagcugaaggcuuuuaaaaaugaagcaacaugaaauaagacaccgcaguuucuggcacgguccacgcuuaauccccuucaaugugugacuuuccguggaaaguuacucuacgauuuucccagcucgucaggguggggccccagagugaguaugaagggucagagccuagggaugccaccaucagugagagcccaggaccccagaaaaggucucuuggcucaccacacuguaggaaaaauaaaaagcaauguaguccaaaugucucuauccaaaguuucaaaaagaacuugauuuuagacacgcuccuugacuuguuuucagaaucagacagaagagugaggcaacaaaggucccuuauuccaggcagcugaauaccagcacagccaggaguccagugcugguguuugcagagccaccagaggcucccucucagguguccagggcccgcaugcuuuguagaaugggcagaaugagcaaugucugugcaccugggcuuugcaggcagggccuggguacccagguucgugcaauccucucgucaccaugaagggagcagcaucauucuucccuucuugaagcaccuuggccaccaguauagguaaauuuaccucccaggacaugaccauugauucugggaugucaaugccagagauaguaggguaaaucggcaccuggguaaaacuuuccauuggagacuagaaccaaaacucaggacacuggcuuccaaauguuucuuuaucagacaagaaagaccaagucuuuccuuacgucuucacaugcugccuuggcaaaugcuagcauucacaaacccugggcuaccuugaccugucacccuugcagaccucagacggguccugggggcuugcuuucucgguuucuguaugcaggcacucaaaccugcaucaggcaccugugaagggccgggcacugugcugaggccaaggcuccaaaugugaaccuuccacccucacugaacucacagccagaccagagacaagcaaacaggacauuucacagcagugcagccuagaaagggccaacaccagcagcauuuguccccccgagcgguagcuuuuagaagcuuccccagugauucaauguguccuacaaaugccuggcccccacucccagagauucugagucagcuggccuagggugcagccuugacuucacuguguuaaaaagcuucccagauaaguccaauguccggccaagauugagaaucacugaccuagaguuuaauuuaccaccucagucucuauagaccacgcauaauaauaguaccccacacaccucugaggguccaaagaacuuucauuugaucacccaugagaccaccgugguguggagaugcuuucucucuccuguucucuuaacaaagcuggugagcgacagagccugcaguggaccgggagauggcccagaggagaaagcucugccguagucggccucaguuaaccacggagcaccaccccuaccugcucuccucucacuccugcuuccgucucgguggagaaagauccaaccgaagcaggacacaucuagucuucuggugccuuuaaaauguacuuuuccauuugacaaauggauuacacuaaaaacaaaaauuuacaaaaaaaaaaaaaaaaccugaaagaaauugcaggcauuaaaaugggacuuugccuuuauugcuccugggcccauccuauuuggguuuuuagaaaaacaagccugaggcaggcccagaaaggcucagggcagacccuccgauccucugaaaggagcaucaggcaggcagggguugcuccggggccagggaaggggccccgcugggacgcggcuguuauugcagcugguuggcgcgcagccaugcuuagcugcagugcgggaaugcugggccuucuguucugggcuguuucucauacgcacguaggccaguguauaaauaagguuuuauuaaaugccaaaugaguucucauuaacaaagaaagagggaaaaucucaguaaaccaccgugacggcaucuacccacuuugagucaggagcugggggugugagugcaaccuccgagacaagggaaccuguggagcccagagaaucggaggggggcgcugggguuagcaccgacugagaccagcuguguuuucucucgguuccuuggagaucagaagugaguguugucaucuucaaacaauccaaaggcaguacccauggccuuacuacaucccucccacaccaucccacccauccccgcgcguacacucacacgcucauuugcacacuaucgcacacgcucacuugcgugcgcacacacagauuggugaccuagguggacugggagagaaauaagagccaaaugacuggauuuucuccaaggaaauuuauuaauagccccucuugguuucaccugaaggagcuugucuucaccugcggccuuugcaggcuuaacgcccccagcuugaaacccagaagcucagacuugggcccaagguauuauuagugccaacacuaccugaaauguuucgcaccucauaaaaauggugugucaguuucgggugagagguugggacgcuucccaucugauuuggcccaaggcaugcaugccccuccuucuccuuccccuccuccucccccucuucccccuaccauccuuccuguuuucucuccaacucuggugcacagcuuugaaaucuugcugagaagcaaaucugucccuucugcuuugaauguuuauuuguggaaguucggcaggggaaccgaggcgggugccaagaccugccaugcugcugggaagucugagucucccucccuucccccuccuaaaugcuuguugauagagaaaagucagccuccucggcauuugggcucacgguuuuccuuugaaaaugcuuccaguguggcaugauucagcuuucuuuucugucccccaaccacugcucuguugucauuuuuacuuuucugauugcauuuuauccgugucucuuugacuacgggguggcuggacguugaguuccaggaagaaaagggcccaaucuugggguucugacuacaugcgcccaucaauguccuguuucauucuuggcucuggcucccugaauuccugagucacuggggagaagcguggguggaccgcccccuacccagugagaguugccacaguugcugcucuccugggucauugguugcagauuguuaaacuucaccuaugcauuucaacuuucggguggauauugcuacgucaagugucugggaaagcccccacagcuacaggauuuuacagugaggucccacuaaugacuugaugucaugacuuccucauucuuuccaauuucucccacuucuccauaaggguuuugggaaggggagaagagaaaggagugauuccugagugccaguaccagggaacagcagggcuguugggaggaaacaaaacuaaaucaggaagguuuuuguuguuguuuuugggggguuuuaugaaaauauucaagccacagcaaauauauuugauuuauagcauuaguauuuuuucugccugcaucuacaaaaaucuuuaccuauuaccaucaaaauauccucugggugaauggauuucaacaaagaagaaauaaaaaugaaauagaagagaggccccuucgugcacauugagccuacuggcuggauugucacuugccugccuugaugucuuuucagcuccaggcaggcaguaggccagggcuuauuuucaugacagaucagauguucuuuuauggauuuacaaagaaagaaauacugagaagucaaaacugaagucacuuaagacaagagcaggccccugggaaggcugccauugaggauaaugaguccugggguccuggccuuuguucaguaaauacgcacuaggcgccuacaaugugugcaccaaugugugaggcgucagguucucuccagggucaguugguuuuaagaaagguuuuggcuucugauauguuuuaucucuacagaacaguagcucuuaaccuuucuuauggguuaggauuaccuucgagaaucugacuacagcucuagaccuguucccuaaagaaaacuaaguucacagggacacacaggauggggcucauggagcagcugaagccagaccccagguuaauagccuuuacauuaaaauguuuuucuaccuaccacuaauaugcauucuuuaguaagcggucucaauauacaccgauucuuccuuaacucuguuuaugaaguauucagcauccucccugcccccuucagcauccucccugccccugagcacaggauccaauggcgugaggaccacaggccugggcagcugcuggggcauacaggcaucucuuaguggcugagagacugggcccuggcucuauguuggcuccuaacuugcugccauuuaaaggaaaucuuagccucccauccguaaaaucgagaaaauaagacuuguccuacacagcucaugaaauaguaaugaaauucacauuagagaagagauggaaaaacacuuugaacaaaaagcauuuugcucuuauaaaagcacagccucuuuugagaggcccuuugcuccccauuucuccuucuucagacccccccagacuaggagaaggucugucucauggagugaccuuuuggcugccucuagauuccaagcucaguuuugcuuucauuaaccacagauacugggacggacagaaaaagaccuaguuucuguugagccaaagagucucauaacuugucuguucacauacccaagagcccacccucuaguugagacacucaguucccucucauucugggagacugcaugucucugugaccuccugguagagaccguuugacaugucccccaaccccccagugauugagucugaauucuccacugaugacgcauuuccuagcacucaggguguccccuccugguugcccccucaccacugaagcccgcuuccucccuuuucauuugaugcuuaacaacugucaguuugcaagaaacaugcuucaaauccacauucucccaguugccuagcaacaacuucccucccggauaaauguggguuuccuguagcucagcccaggacugaacacagcagcacacacuucuguccacugcuucaacugcuuuucaccucuggucugcaugccuucaagacugcagcucaucccucccuucagaaccuuccauagccugcagaggccaugucugccccaaaaagacacauugaaccugaggcuacuuauuuacccuuguguuagguauauccucaacuuagaaauuaauacuguuuccagauugucuucuuugaaucacagaaaguaaaacaacaaaacauucaaugcuuaagacauuucaugugcgguugggugacaucuguuugaugaacacauuugauccaaagcaucagaaauacuaugccaacaagacuuuuuaggaggugauaaacaugucuguucuaccuuaagaaaaaaauauuacacagucccaagggagagacaugguuuugaucccagacaacccaagcagagaccucuuagggccggaaucaucuuggcugcugccuaggaccuuauaucaauuucuuaagcacaggaucaaggccuaaaggccccuuagacugaccucaguuaguagaggcagaucccuucacagccuuaucuuccuuagaggucuagucugaccuugaacuucggcuggcagugcugucaguugugaugugugacauggaagaguuauuuguuacuuggaaaauuaagagaacuuauuuggcauaggaaauugugugugugugugugugugugugugugugugugugugugugugugugagaugauguuugccauuuugaucugugacuuuuuuuuccagaaauaguuucucaguuccauuccaacuaaacuuacagucucuuccgguucuuugacagaaacaauucaugugaauuugaacagauaauagggaagggggaaccaaaagaagaggagagcccugggaaaguuauuuuauaauuuauggcaaccucagucaggcaacugugaacagguacauauggagggcucccucgggacuaggcaguauucagagauguaaggugugaggaccggacccucaucauuuaccauucccacuaaaaagagcugggaaggaaauuguagcuguagcaccaggcacguaacuggagcuuaguaacuauuuggugaaggaauauuauuaaauuauuaacaagauggaaaaaaggguauuaaccacacaaaaauacaucucaagcuauuguuucucuguucccuuucccccaaauuccuagucuugcucuuaucuggcugucucucuagucacucuuucuugcugacucucuucacguuccuuucuccaccuggaauuccugggcccuccccuuuuacugacagacacuguccucacucucacagucaucaguuugucucuuuacaaaccucagcucaagugucacuuccccguccccaggugaaacugacugcucccucccuguaagucaccaugaugacugcuauauauagcccucauggaaccuaaaaccucaacagacacagucucuuuccuacucuguuauaguuuauuuacucauuaauuaccacaacacguauuauugagcaccuacuguguaccaugcccagaagauaaaagacaaacaaaauaaaaccuauuccuaugcuuaaugaguuuacagucuaguggagagauagauacauuaaaaaauaacagcaaaccaaaauaaaagugguaaauaaaugcacugagaaagacaggaauagcuaggaggggcaccuaaucccuagggaaggaaagcuggaagagcauggugaugggggaagaaggcuuucuggagaaggugagguaguuugaaaugaguugacucuggccaguagggguagagugagaauggggugagacaggguggguuggucauuuugauccauuaguccucaaagugauaggacuaguggcuaaggacugcaggcuuuacagaagccuacaaaacuauuugagauuugaaguuuuuuuuuuuuuuuaauuggcuccaaaagaaaaugaaaaaacuuuagaauuauaaugaaugaauauuaaaugaauauuuaaggaagguaauuuuauucaacuucauuguuaaauuuaguuaaaacaagcccuugaguuucauucaacacuguuuuaucauaccguugaugagagaaaacaaaacugauuccuggccagggccacugucagcgugggguuugcacaucuuucccaugucugcuuggguuagcuccagguacuccuguuucccccacauccccaagaugugcccauuaguggaaacggugugucugcaugauuccaacgugagugagugugggugugggagugagugccccugccaugggagggcauccuguccagguuagauuccuaccuugugcccugagcugcugggauggaauccagccacccaugacucugaacugaaauaauugggugaauaauuaucuuacuuuuuaauuaaucuuugaaaauguauguauaguucacauguauuucaauauuuaauauuagaaguauuuuagucuuuauuuugaaguuuggugauuuauuguaaccagaaacaagcuauagaaacuuaauuuugggccaagugcaguggcucacaccuauaaucccagcauuuugggaggccgaggcagacgcaucacuugagguccggaguucaagaucagccuggccaacaugguaaaacccugucucuacuaaaaaauacaaaaauuagccagauguggugggcaccuguagucccagcuacuuggguggcugaagcaggagaaucacuugaacccgggaggcggagcagugagcagagaucgugccacugcacucccaccuaggcgacagugugacacuccaucucaaaaaaaaaaaaaaauagaaaagaaagaaacuuaauucugguuuauaucaauuagccugugguaaaauugguuucauuauagccauuucacuuaguugaaguuuccaauaaccuguggaugaauuaagugaggauuuacuauauucauaaaaucuuaaauuccaaagccuguuugcaguucagguuuuuccacuuuacaaacacuucuaaguauucacaaugauugcuuaaaauucauaccagauaaaucauuaaauaaguuguucaaagucaaauaauuucauaaguaaaaauuaggagcuuuuagaaaacuauaccuacauagaccuagaccuauagauagacagagaucugaauagauauggacacagaugcuuuccaaaguguucaugugaugugugguggaguuucaagaccagagugugccuggggccugcagaaguaaaggagaggggauggagagaagauuguccacauggccaugggcaaucucccacccacacucaagugaggaagacaggaaacaaauucagaaagaagagaaaauaaucaaaacugaugggagcuugugacugauuuacuuaugcgcagccucccuggagacaugaguguggcuguuccuuagguugugccucugggcuccuacccccucuuagaugccuuccuauuaucuaggaccugguugcuuuuugucugcauagcuucuuuggauuccagucuuugaugccagcuuccuccuaaaguagccuuucagaugucccuugguuacccucugcuaucuaagggcucauccuaccccacacucauucccagcaccaauuucuggaucuccaggcuggagauuuagacaaugggaugggaagaacccaugaugggucccagacagaaaguggugccagccacagaaagggcacacaggcacagaaguugguuugggguaagacgauguggucaguucagaacacgcuggaucuaggcagaugcccagcagacaguuggauauguaagucugaagcucuggggagaggucuagguuggagguacagauuuagaagucaucaacaaaaagguagcagauuaaaugauaaaggaaaugagacuauccggggagugugcagagugagaggagcaagggaggcccuugggaaccucagcacuucaggggaagguagagguacaguugcuggugggaaaggcagagaaguagcaaagcaaaccaggcaaaagcagugucacagacgaccagggaggaaaaggacaugaucaaaauguugagaaaagcagagagguuugaaaauacaagaagcaaaaauguccacuagacuuaaaaaccaggagaaaacugggggguucuugauaaagcaucuuaguaggauggugaggguagaagccagggaaguguuggugaggaagugaagucacugauuacggacuaugcuuaaaagaaugugggaaugaaggguggaagagagaaauuagacuguagcuagggagacauaagcgaucagagguagauucuuucucuccugugggagaaucuugcacguauacacagcaugacgacagugauggaagggcuggcgaagccucagggagacucuuggagguaaaccccaugaagggaggacuuuguuucauucacugccguguccccagcaccuggcacaauagcagacacucaauacauauuugucaaaugugggauuuuaucauuuagaaacugcaccuggcugugaguaacaaaagucagagaaaccguggguuucauuuuucuccccaggcagagucuggagcuggguccuccaagagggguuuggagcaccacagguuuccucaagacccccaggcugcccuguguuucccuccuucauccccagcauaugccugucaucuggugaccuccaaacaccugugcugccuccuccagcacauccauguugcaggcagggaccaggcaaagggcagaggggccuacuucaaaagaccauuuccagaaaccccauccuaugacuucuccuggugucuugguuaccauugugccauaggcucacccuguaugcaugggaggcugggccaggcauuaugacuuuuagcaauauugcauagauaagcaucaaucuuugucacugugacgaagccuagucacucagugcuaggcaagguuaauggaauggguuggugugugcauuauucuugaggucuuucuuaugcuucauguuauacauuuauuaggacguuuaggcaacagggggauaaaaaugaagaggagaugcaugcuaugaucugaauguuugcauccuccccaaaauucauauguugaaaucuucauccccaagaugauggcauuaggagguggggccuuucggaggcaauuaggucaugacugggauuagugcccuuguaaaaccccagaaagccagcuugccgcuuccaccauaugaagacacagagagaagaugccaucuacgaaucaggaaaugagcccgcaccaugcaauaaaccugcuggagccuugaucuuagacuucccagcugccagaucugugggaaauagauuucuguuguuuacccagcuuaugguauuuuguuguagcagccagagugaacuaagacagugcugaucucguauucuuggagggaacccuuagucuuuagggaaagcaaagccaccauuuggggcaggguguucuccaagugcugccacauaugcugaugugguuaaacugcaaacuaugguaaaaauguggaggucuguggaauugucaaucaggaaaaagauauaaaaagaaguuaaagucuucgugcuucuggaaggauaugugccaaauuguuaacauugauuauccuuggguagagauguggggaaguuugcagagacaguuuugccuuguacuuuauauaaguaaacagcuacuacuucguugucuuaaaaaaaaaaaacagccuaugugcucuucaugugacucagaacuaccuaggcaauacgauuaauugaauuaguaaaauugagugauuaugaauuuucaggaagucauuaauuuaccacuucuuuauuacauccacuucuaacaggacuucaauauaggggaauuugacuucaagauaaaaagaccaaauuuauuuacccuuuuaaaaaaagacaacuuaaaagcagacuugucuuacagaaccuuccuuaguuggacaucgaugaguguacagaaaaugcaauggauaaaaagcuuggugauacaaagauaaaaagugggguccuguccuuaaugaacauaccauuucauggaguaucagguguauaaacaauuauaaucaaucugcuuguuauucugauaagaucauuuacucacacaucaaauacugagugcccaccacaugcccagcauaccuagaagucauccaguaugauuucugucuacauggagcauagagucuuacaggggagauagaugacaaguaaacaccagaauaauuaccaauggugaagagcacaaggaaggaaacagaacuccuaaagagagcguggcugggcaggggugagcaagaggcauagaaaaaggggcaucuaaaucuacuugggaggaagcuguuucucacauaggucaucauguuaggaaugagacuugagggaugaguagaaguuugccaggcaaagaaggaaugggggggaauagagagcagagcuaggggcaggagacagcugacgugugagcagacauaaaaagaaguccacuguggcagcagagaagcaggagagaaggcaagugagggagccaggcaccagcucacagaggucaugugugucaaaacguaguaauggccuucucuucuggagacaguagggagccauggaagauguuugagcagggaaagcgacaugacuggauuggccuguuggguaacucagaccacaaugcauuggaagggagggggcuagaggcaaggggacuggcaagaaggccaguccuuuuucuaugccuauuuugaugaaauauucuagaagggaagugaacaaagguaguccuagagaggaagaacaaaacagauaggauacuuccuuaguauuugcucauucgacaauuuauuuuugcauauacacuaaaaccuuuuuuauuauuaaaacguuuuauuguaggaaaaaaguaugaaaguagagugaauaauaaaaugagcucccauggaucuaucacccagcuucaacuauuaucaauauuuggcuguucuuguuuuaacuguucuccaccuuuuuuuccugaaguuuuuuugaagcaaaucacagacaacauaucauuucaccauauguacuucccucuguaucucuaacauguaagaacuuguuuuaacaaaaucaccaugcuaugaucauacccaacaaaauuuaucauaaugucuuaauaauaccuaauacccauuucauguccacuuucccccaauugcuacagcugguuuguucagaucagaaucaaaauccaccuguggccauuuuacugcuaugucucucaggucucuuuucaucucuaauaaucucaggggagacaggagggaggacgggcaggacuuggggcuaacuugcuuaucgacacacaguuuugccuacuugcuuccucccuucacacccacucuucuucucagccccacccuuguauggaaaaaacagaaauuaaagugcuuugcccagcacccacugaagcuauuucgaaggaguuugaagaguacucccggcaagacaaaugccucgguccagugcucaggucaaagaggggagacgcuucucagugauguggugucaauagcagcuuaguuguucuuuccucuggaaaauucuacccaucugcuuuguaacucccauaccuaacaaggccuuuuauuucacaauuagaaaauaagccugaaauaugaaugcugccugaguguaccuacauuuauucuagaguuucagggucaaaaagaauacaaggaccucugcaucuacagccaagaggagaggggcaaagacacacagcuacaaaugagaaccuggcuggucaaagccuaacuccaccuguuugucagcacugaugcaaguuaggucagcccaaugaucauuuaggagaacugugcuggcaaauaaaaagcagaggcuuuugguccccagauacuuggaugagaauuacaaguccagcugguuaaaaggcacaugcccagugcucacuucacaccuacucaggaagcacacuugaguuggaaaaccacugucuuuacacuuagaacucaguccuacaugacuccucuaggaucagugauuccaucaguuuugaaacaugaagcaugaagucaaacaggacaugaccuugguuuccagaaaaccagauguucacaucagucucuggagcuuggaggcagcacaccuggggacuuccacauccccugccgagguggcaaaagcaggagcaguggugaguucacaugggcugggguuuccugaacacugcuggcaauuggagaaucugcaagggaacuucuccgacuccuaccagcagcugcuuuaaaauaaaggugauguagcuggucaaauccuccaugagagagcaguguugaauggaggaagagacacaaccugucugaaaauggcacaaaggaagaaagauguaaacaaugacgagaagacugcagugucuacaaagcuccgaggugaacagaugggcaccccaggcccgcagcacuuccuucagucucugccagcugcacucuguuuuccuuccuccaggaaucuuguuuggugucacuaaaacagcaauuagaaucacuuugaaauagugauaguauuuaauauaacuaugaaacuaucugugauugacaagugcagcaaggagucuuggaaugagagccuuuauuuuuucaauuaaauaaaagaguuuuuuguuucuaaaaguaaucuugcagaaaagauccugcgaucagaaagaaggagggggggaguuuucaaacauauaggagaucagacugugccuauguguguauauaccuacaaacauauauauauuuaaaaaauuguuuuacugucaauuacagcuucccacacuccuagacagccguucucaagguaucaaucugagaucuuggggaggaauauuaucugauaugucaccaagaauucaagaggugaguagccugaugguaguaauuauaauuucauuaugucuuuccaccauuuaccccacuuaugucaaauaauuuaauuguauuucaaaccuguucaaggaaaaguacauuugaucuuuccaucuagcaauuucaaagcaccuguucacaucccaaauuaucugugcucuuaaguaagaggcagaaagaaaggaaccacccuucugauuucacaucaaaaaagaaaugccacuggcaauaagcaacuugccugguguggcauaaaucaucagaagacuuacaguugaaucuaagucuuuucaguacugaggugguucauuauucuguuacagucuuaaaauucacauaaauauauacugccaauaauaauagcauacaccuuuauagcuuacaggcacucuucuucuaaguguuuuaccuauguuggcuuauuucaucauaaagaaaacaauggacuuuuguguuguuuuguaaaaagaugcgcacauuuuaauuaacaucugauugcacaagucuccucccauauagaaauggauucuuccacgcaauagauaagaggugcuggggauaugaugaugaacacacagauuuggucaugacccugugggaaagagagaugggaaaaaaacaauucucuucaagugugaugaguguuacgaaagggagggaaaaguugaaacagguuuuuuuccaaacuuuucucccuccauuauucgcagcugacuugggcuccaccaaccuggaaaacugcaugguuggaaucugucuuuauaaaacgcaucucaaccugggccgaguaugcacacugaugugggaaaguuagagaagagcccauuguacuaaugcucaccugcuacagugggagucucuguuaaacagucuuuucuucauagcauuaaaaaaauuuauaucacuacaauaagguugaaauugauagagaauguacaaacaauccccaaaguauaucaacacucuuaguucugaguagaaguuccagaaggcuucuugacugucuagauagcaagucuaaucauuugugaacuaaguuaaagcagaaggcccaguuuauaugaauugguauuacaccauuugaccugagaacagccccuucaucucugagugcuuugacuaaaugagcaacauaauaauaguaauaaccccuuacaagaugucauaagacucacuguuguugaagcaauuugagauuuugacuuuauugaagcauagauggugauuauaggcaugacucacuguguggauucucccugggcucaucaguuucagagggcaaguguuggcauguggacaaagagagggaugacacguaaacauggcuuauugcaauggggaaauauuuucagucucacugauugaauccuaaugguuuuauaaauuccccaguaccacugaaagcaaagcaaguaaucagguguguuuuaggaauaaaagcagcauuauuuuaauuucguauuuuccccuaaagcaaagccaaauggcauuaugggagccaagcuacuggcagcuccaccagccuucuccugaguucucggcauuacagaucuacccucaaaggaugaggccagcaagcaccacagggugcccacauggagaagagaaggccaccaaccuccucuuagcuggcacagaauugaaaaaguguuuuuccaggaauggauacuucaucuguucuguauuugcuagaauuuuaaaacgcacacacagacacacacaggcgugcacacacacacgcacacacacacgagaaaaccacaaaccacacauuucaaggaaauggaagaauucauugguaaaauuaagcuaauaagauuauuuuccaaauauaagaaacuaaauuuuagacuauuuagccaaagaaauuugcucugaucuugcuuuucuacaacagaaucauuccccaaucauuuuauuucccucuuuuucuccccaguauccccaucuuggugggacaacagaacccaagaacuggcuuaacaguaaaauauuuucugcauuugcccaaggacacauucccaacgaauucaaauaaaggagacuagaagaagagaggcuauacuacagugcucuaggggucacucugugauuuguuguuguuguuguuguuguuuugagacggaguauugcucagucgcccaggcuggagugcaguggcacgaugucuacucacuguaagcucugccccccagguucacgccauucuccugccucagccucccgaauagcugggaguacaggggcccgccaccauguccggcuaauuuuuuuguauuuuuaauagagacgggguuucaccauguucgccaggauggucucgaucuccugaccucgugauccgcccgccucggccucccaaagugcuaggauuacaggcaugagccacugcgcccggccacucugugauuuucuuuaaggcucauccuaguauucuccuagucccuaaguagauggcaguagguuuuguuuuuuguuuuucgcagcuggauuaaggauugcugagaauauauggauguuuucuuuuaaauguggaagucaaaccaaacguuggagcauuggccucacagcagauuaugacucuagcugccuuaaaauaaccugaagacuuugccuugcccuaguuuauccaucggccgaguaugcaggacuugcugugggugaccaggccccucaugcagaauggugguccagagaccuuuacaaagcugaugggcauccugucugaccuccuguguggcuaccccgagggagguggcucucgggugcucuccuucaacugguaugaagacaauaacuauaaggccuuucuggggauugacuccacaaggaaggauccuaucuauucuuaugacagaagaacaaguaaguuuucugaguccugcuuauaaauuggccucucauguugguuaaguugaugguuuaacacuucuaggugaaaccaaaccugggguugcaucugucuugucuugcugaguggccuuagguaaagagacuucucccagaaaguccacuuccccuugcagaaagggggcauugcuuauaagcaauucuggacaugaaccacagaaagaacugaggcccacuuggaaagggaacagaggggccauuucccacugauguaauugaacuagggcuaaguucaagaggaagagaaugauccgcaaggaagcaacccagaguuccaggugaagcucaggucagaagggcccuggcaaguaaacacggcugugggaugcuuuuacaaacacaauaucgugaaaaucuauguguguaguacugaauuacauuccaaauggcaaauuccuggcaaaucaucuuccccaccuuucacuauuuuuuuuuuuuuggucuucuaugggguaaaggaggaugggguggggaagaaauguaacuggcugccccucuaguuaaaaacugaaaagaggcagcaagggacaugccaaaaguaguuggacucuaagauagcuacacacaacaaagcagcuaagcagcuaauugaagggaaauuacugaggcucaagcugagauuccaagcgggggccuuguuuggccucucagucccuuucaucugagaaaggccucaguuccuagcaguaaucagaggcaggcuucucagccuccuucuccuaaagcagaauaaaccacagggcaagucgcauccuuuguuucucugaugaggccauuacugagagucacuguggcauuuugcuacuaaugaugagcuuguuauuggugggguacagccuauuaauuuagguuauucaucaaauccuccagcauggaguugaaugagacaugugauguggauacacuaaugacuauauugaguuacaagcaauggggaguuucuguaaaaucugucccuugucuccuggcagcauccuuuuguaaugcauugauccagagccuggagucaaauccuuuaaccaaaaucgcuuggagggcggcaaagccuuugcugaugggaaaaauccuguacacuccugauucaccugcagcacgaaggauacugaagaauguaagaucccagcugggcuugccuuguguacccuggaccucccagaagugugugugugugugugugugugugagagagaugugccuuccugguagcacaucucauguuuguuuuuugcuaaguggacucuugcguuuccucccccauccacagucaucacuggaaugcuuugcuucagugccccugccugggcccuccccucucuacugcagccuacaaugagguuuucuuucccauugcuugaauuauaucccuaauggaaggguucacaauucucugaauccuggcuacucagauaaagacagggaggaagggaggaaggguauuuucucccaggggguccaaaucuagcuuuaacgagggagguucugagaaaauaauaucaucaauauuacauggacuucugagauacuaagaaauuagauucugucagcccaggaaguugggagauggugaauuguucugggaaauagcaauagacugagaaaauaaaaacacuuccuugaaaagccuuucccuaacacuaagugauaggggcagaaaagacacaaccaaaaguucucucucacuuuucucucuguucgugucucugucuugaucucugucugguuuuaggccaacucaacuuuugaagaacuggaacacguuaggaaguuggucaaagccugggaagaaguagggccccagaucugguacuucuuugacaacagcacacagaugaacaugaucagaguaagggggguuggaggauggggaggggaggggaggaggaagcggugggggcaagaaaguuccacuuguuuccuuuucccaggaaagaguuaaucgcuauuggaguuagaucaaaauacaacaagcaggccccaaaggccuucauuccaagcagucaccaaguggggucacugacuuuggaugagaaauauguuucuugaauucugggagaagucuaaaagcugccacaagaccaguggcuuccuggaguuuccuacuuuuaugaauucacucaagggccucaaauucaaagaggcaucuccccaaggggccagcucuguaacuccaaagaugguggaauguguuugucuggucucauuuucagcuuugcaaaaugaagacaagaguucuauauaucagggacacucaaaagaaaacaaaaauauccauaagcaaaagaaagcuuuuuauacaccauauucaaugacccccaucuggccccuccuuugccccuacacaucuucccucuauucuagagacccauggacuuggggaaaugggauauagauagguauguuucauaguggaacaagcucaccagcucuucagggagccuuagcaucucuauccucaaucacuaaaaauuagaaauggcugaagaacaagaccaaagauccuauggaauuucuaagcagagcagugacuguauuucuucuucccaaggauacccuggggaacccaacaguaaaagacuuuuugaauaggcagcuuggugaagaagguauuacugcugaagccauccuaaacuuccucuacaagggcccucgggaaagccaggcugacgacauggccaacuucgacuggagggacauauuuaacaucacugaucgcacccuccgccuggucaaucaauaccuggagguaaggggcugcaagccccacagugggccccuugaagauagccccaugaguggggccagagcucccuuagcaagucaaguggucuugaauuuaagcuuucauuuuccccacugaagaaacaagaaucccuacauccccuguacaguucucauucucuaacagcuuauccauacuuaaaacuuaucuaugcugaaaacgguuuccucuucacaucuccuacuucucaugcugggcaccuccuccuguagcccccuuuaagcaucugugucuguccucaacccucuucugucugacauugcuugaguggccaucuauggccaguguccccucaaccccacaguccauugcuugcuggacacuccugcccucaaguucuacaagcacaucagccucaacauguccccuccaaaaacuguauguucuccuugcccauagaacauauccuucuccuauauuuccuauccuaauuaacguccucagcauuugcccgaauucucaagugagggauuucagggucaucccuaauuuuccuucuucacccuccacacaguagcugucacuuacugaguguuacuuuaugccaaguacugugccaacugcuuuuacacacauaugcuucauuuaauucucacagcuccaugaggcuugcaccauuaucauugccaauuugcagaugagaagccagggcuuaaagagguuaaauaagaucccacgcaugaccauuaagaggagcgaacaggauccagcucugggggugccugaguucagagccugccuuucugauuucucuuaccaagcuuugucuccucucccuccuaaauaucucucaacucugccucuugcauuccaggcucucugaggacuagaggccuugucaucucugcgccagcccauuccaagggcuuccuuccuggaauccaggguccagccucuguuggcccaggcauuucucuacacuggcaccagaguuacauuccgcacaccugcuuacguugcucucucacuuaaaaucuuaaugacucgacccccaaauaacacaggucccuuccaaaucuguccuaccccaccuucccagcccuugcucaacucugcuaccuggcccuuucacgccuacaggcauucccauuccaugaccucuugggauucuacccuuugcaaaugcuguuuucauugcccauuuauuagagcgcuuuuggucacaagcuuuuugcuuaaccaaaaagaaagcauuuauugguggacauaaauaaugaaguucaggaggauccaagaguuggaagccaccaugagaccccuguguccuuccaccucacuuuucuacucgccucugcucagcuucaucucuggccaggcccucuccucugcugaugcccuagcugcuuacagcccuuagcagucaucuauacaccaaaaaucccuuucccauagcagaagcaaugcuccuagagaguuucccuguuggucuggcuccuguacccaccccuguguacucugauugggaggccugggucagcugcccaccauggggccauuucuaugagcaggauuacugugaaguggaggaagauguuuccccaaaagaagaaacacaagguagaaaaguguauguccaccaaugccugaaaugacugucccuuuccucaucugcugagcuucuacucauucauucuuugagacucagcacucagcucuuaaaugucacuucugcuuugauggagguuuagucauucacuccucugugcuuccuggcccucucuucacaccucucucagaccccucucccagauagauuagaguuggcuguugacauguccaucucuggcugggcagcuaaacuggaguuauuuagaaucagggagcacaugucagucauuuucaaauucucaaccucauacucccaguaaaugacuccaucuaaggguggaccacucuugcccaugggccaggucugggucugugucaucuagaacuguuggaagguaggggcuucugugagcaguaggagagggaauaaacucgagggcccucgggagcaugcccucuugucucagacuugugaguccugaggauaacaaacuagugaagaaaagccucguucuaucugucaccuggugcucuugaggacuuucuguugcccuggugccaccacaauuuuccagagugugugacccucgcucuccaaacucuggaaguggcagccgaggcuccccaguggccuuucagaaggugccagucaugacagcagcaccaaacugcaggcaacuacuaagcgaucaccaacuugucugaagauaagaaugaccuugaaugcauuuuauaaaacaggauuuuuuuuuuaauuuuuagauuuucuuucuuuauuuuaccuuaaguucugggauacaagugcagaauguguagguuuguuacauagguauaugugugccauggugguuugcugcacuugucaacccaucaucuagguuuuaagccccacaugcauuagcuauuuguccuaaugcucucccucgccucgccccuaccccaccccaacaggcuccggugugugauguuccccucccuguguccauguguucucauuguucagcuuccacuuacaagugagaacaugugguguuuaguuuucuguuccuguguuaguuugcugaggaugauggcuuccagcuucuuccaugucccugcaaaggacaugaucucauuccuuuuuauggcugcauaguauucuaugguguauauguaccauauuuuccuuauccagccuaucacugaugggcauuuggauugguuccaugucuuugcaauuguaaacauacaugugcauguauuuuuauaguagaaugauuuauauuccuuugguuauauacccaguaaugggauugccuggucaaauuguauuucugguucuagauccuugaggaaucacacuaucuuccacaaugguugaacuaauuuacauucccaccaacaguguaaaagccuuccuauuucucaacagccucaccagcaucuauuguuucuugacauuuuaauaaucaccauucugacuggcaugagaugauagauacccauuugucagauggguagauuacaaaaauuuucucucauucugcagguugccuguucacgcuaaugauaguuucuuuugcugugcagaagcucuuuagccuaauuagauccauuuuucaauuuuggcuuuuguugcaauugcuuuugguguuuuagucaugaagucuuugcccaugcguauguccugagugguauugccuaggcuuucuucuaguuuucaugauuuuagauuuuacauuuaagucuuuaauccagcuugaguuaauuuuuguauaagguguaaggaagggauccaguuuaaguuuucuacauauggcuagccaguuuucccaacaccauuuauuaaauagggaauccuuuccccauugcuugugugugucagguuuggcaaagaucaggugguuguagauguguggugcuauuucugaagccucuguucuguuccauuggucuaugugucuguuuacaaaacagauucuuaagcaucaacccagaucgacuggcucagaauuuccagggaagaggccugguuaucugcauguuuacagaccuauuagauuugugggaccugcaguucccuuguacaguuaguuacucaauuaacaucucccuccucucauggugccucuaccugcuaagcccuuauucccagccaggcccaccaccauccacccacugcuguuauaacauaagcaggaccugugcgaggggguguggacggaggagagaggcucuguugcuucauuugugcagcauggaguucagugguucucacaauguuuuugcaaaguauauaaagaauacuccuugucuacuugacauucguaucgugacauaaaugucuuguuuuccagaaggauuauuuuuuccaagcagcuuguuccuaaugcagccccaggcaccaaacagauacuuaaaauauauuaauugcuuaaaugguuaagaauucagucucuggacccacacugccuggguucaaauuccuauuaucugugcccaguuuccaagucuauaaaauagggauauuaauagcacuuaccuaauaggcucguuaugagaauuaaaugagcuaauucaugcaaagcacugacauauaguaagcacuuaauaaauauuagcuuuuuaacaaaauacaagccaaaaaacacugcuuaggagaggaaaugauguuagugccuccuguaaauaggcccagccuccaagcuggugcuccucuaggaaucacaacgcugcaaaucacauccuccggggccgccaggacuucacgagggccucugagcagagggguaugaugggagcagaagcccagcagcugugaugaugugguuucugaucuuccugcccuuggggugggggaggaggaaagcaaggggcaaugaacagaaaggagaagauagcggggaggaaaugugugaggaagaaacacaucacuguggcuuguccuggauuuuucugcuucuguucucguguuuugggaagucuggaggagacuugaaaaucauucauguccccacccugaggauggcuuaguagcagagaggccaugaaaacucuuugcugauggcucugaaagcaaggauguugcuucacugggcugcugaaggccugccuggggguucugagcagagaguacaggccccucccaggagggcggccuaaccaccaugcuggcauuucuguggaccauggucugcugucucagacccccuccacaauagggucugcaaucucauucaccccauaaauacauucugucuuuccucugauccccucccauuagcagggggaaauaaauggaagucagacggcccaguuagaaggcaggcaguggaguaggaaaauagaugauggugguuuggggagccucacaucacucauggggagacauucauucccaugggccuuccaaucacccuuuucuccaaaucuaaggacacaggacaaauggguccucauacaggcaaauaucuuaaacugguauguguauucauuuauaguucuaauuuauaugugucuuuauucacauauauuuugcuucuggagaaaagcucaauuagaaaaauuaauacauuauucuucuuauugcccuucagcuaaaacaagcauacacaccccuccccuuuggauuuuuuguuuagcaaaagguuaggccuggcacagaugaaauacuauucagaguucacaguguauuuucauuucauaauauauuugauuuucaggucuugaauuucacaucaggaagcugauauaggaagcugaauucagccagauuuuaauacgaaaauaccucugaucaaggcauaaaauuguacuuuaaccaguaaccacuguauuucucuaagcugugaaaaaacaugcauucauuaacugcuuuuuccucugcugucaacacagucaauacaugugcauaacuccuuauugucuacauggugauuaucuugcugaugaauucucaaaggccagagauuuggacuauuuuuucucuguaaccuugcauguuccuggccacaugccaccaccacccaaacagaauguacgcagggaauguauuuuucaggauaaccuaagaaaaaauaggauuaagaagauaaagcugcugaucauguaauguacuuuagacucagauauauaaauauuugugaauuaucuguccuauuucuuucuucuauuaauucauugacucuagaugugcauuggaaggcuagggagaaaucaggggaucgugagaaagagcacagaagucugcaucacacaaacaauauuauuucaagagccaugaacuagauccuaagcaacucauaggcaaugaccucauuucauaccucuagucucuaagaaacauauaacuggccugaggaaggaaaaugugggcaagggguagaccggggucauggguggagguccaaauaguaaucaauggagcucauaggguggacugauauugaagcugcuaugagccagccacaugcugggcacuguuacaugucaucucaugcaauacucccaauuaccugccuaguaagcauaauugucauuuuauagaauuaaaaacagacucaaagagguugacagucuaauguaacacaacagcuaaaugggggaucuggaauuauaauccagagcugccuggcucugaugagaaagcucuuucugcugucauaugcagcccacauuaauagggggcucagaaaguauucucuggauaaauuauauaaugaauccaaugaaggaagacauuauuuuauaauaugcagcauaauaggcacuauuaugauuggauuuuccugcuugaaaguagcuagauuagaguaggaaaccaaaaagaugugaauucauucagucauucaugcauuugcauggauugagcuaccuacauuugaauaaaugcuguuaaucccugauuccuuggaagcucacauuggagagauaagcaugucauuaaauaaugccauaauagugguaucucagaggacuagcagaacauaauucaaucugacagaguagaaacagauuguacaaauccaauucaaaacaucauaaauccucuaagcacugucaauucuuccuccaaauuaucucugaaauuccuccuucuuucccauuuauggccuccauuuacagaagcguguacugucucucuuagcuguuugccaggccgccagucucuugcuguucagcucucaacugcuuccagcaagaucuuucuaaaaucccaggcuugccaagacuuagcgcccacagcuccacagugacuccucauugcuguuaagguaaaggccuucccagucuagcccuucaugcuucuuccauguucuaugggacugccccaggcuucccaccugguaccacugagccuuuccauccuucccccacucgacugccaggucaacacccacacccacgcuucaggacucagguccuauguuucgggccuucuucugugcaccauucccuucccuguagcccuugaucaugauuuguuuauacgccuccgcaccuucauggcccugaaccccucaagggccgaaacugccuuacuuuucuuuuugacuucccaacuuaccuuaguggagcuguagucacauagaauagacgcucauaaaugcuucucugggcuguaaagguugaauuuuccagcuaagcaaggaagaaagacaauuucaggcaggaggaagggcauaagcaaagugcagagaugugaagcucaagagaaauggaugggcugggcagagguguggcugcagcaucaggggagaagaaguagugccuggagucagcaggcacggcuugcaaaagcuucaccuauaggugaaaggacaccaucucuugcaccaauaggcucugugauuggaggcaacuuugcuguuuuacugccagaaaacugaggaugauaacccaaacugcaguucaaguggcauucacugguguggcugaaauggguguuuguggccagaauguggucugauuggucagugcccagcucuguugauuagcagauguuuugaauauaguagcauccaugugcccaaguuguugggaugauucaacaagaaacuuuaagagcucaagugcccugcaguugucagccaggugauucucuuccuuuggacccaguuagacgcaggcauuaccucguggcuuugccccagugugaaucuuuguccuccaacuugaucuuuuuauuuguuucauuauuguauuuaaguuguuuauuuuagagacagacauuuuuuaacagcugugcauuuccugucccuuuguuuuccagucgucauguguuuccuuacucucugugggugaacguuucagaugucuguuugcggugcccagcgugcaagauaaaauuuauugcagugccuucggccucuaacucaccauuccaaccaauucagauagcccaaggcuguuuuauccaguggauuuuuccauguagugggaaauaaaucuugaauguuacuguuuagauuagccaggaaacucauucugggauguuugcccacauccauuggcauuucucaaaaggaaccccaggugucuaccuugacaccagcagggccacuugagcccuccgcuggcauucaucgcccgcuuuguucucagccugaguuuaggaguuacagaugugagaggcgggauuauacagccaacaucucuaagcgggcaguggcucccuuacccucgaagaccucacuccuagcacguccuggauguauucgucaaaauauguccucuuaugccacgucagcacaggguugcuccccacuuugaucaucaaguuuaaacaaaaggaaagauuuucuuucuuucucugccucuacuggacaucauuucccaccuaacagauaauuuaauguaucuguuacugaauguguuugaauuacagacagagaggucacaguuaaagaaggaagccugcugcuacugcagcuuguccucccaaggagguguuugauuuagcuguguaaacaaaugacugcauucuccagagguccugaacacagcugccugcgcuggagagggcucaaaccucuuccgccagggugaacucugcuuccuggugagugccagcaaaacaaccaacaaagagcuguaggacuuguguggacuucaaaugguggugguccugccacuugggcucagccacagcaguuaggaaacuaaaggggaggaggaaagcccuuuccuugcuuuauugucauuggcugucauagggcauuacaaugguucucuuugagauucugagcuccggcuauaacauuugcccagaaucugccucugaggccuuaagacacuguguuuuuauucagcaaagaugcccuuugacuccuuuucccacuaguggugcuagguuugagcaccuuacacuggccccuuacaauagccaguucuugucuaccuacauucuucccuaacauucaugauugcauaguuacucuuaguguagaagcagacagcuuuuacacauagacuccauggccguagccucauagaaccuacuauauucuaacuugcaagcuaaucagaccaaauauaucaaaaucaaaaaccucugcugagaguuuauucauucaucucugucucccaaacguacuuauguacauacgugcacuaauauacauguccauuagccaagauuuugauuucagggaucaaagcaaguaccaauagggaaugaggucacuugcugcauggcagguggcuuccccaugagaaugcaaggccaccucaugacucauacuucagagggugacccaggaacuucugauucauguccaaagcagcuucuacaauugcucuaccuugaucuagggaagauguggggaggaugacauucgggauuagcuuuauaaggccuuccugugggcagaguugucugacuuucaccuagugaucaacaagcagcuagcaagcaucagugugugaggccccacgcccucucagcuccccuacugcccaccugggacaugggcuuuggcaucuguccauagcauuguucuaaccaaaugagguguuauggaucagcucaggaugggauauguucccagacauauuauuuaaagaaaauagcucccuuccuccccugauaaacagcugccauggcuaaaagguaaccuggcuggggcuuaaaagucuguugacuuucaagauauuuugcaaaaacagucauaaaaaugguauuuaucagauccuaacuauuugugagacgguuugguauaccauagugguuaaaaacacaggcucuuuccagaggagguuuacuuugcuuagucgugucuccuaagugaacuuggaccucauaagguuguugugagaaugaaaugggugaauaugaguaaaguccuuggaccaguuuuggccguauaguaagccuucagcaagcaucugcuuuuauuccuacagggaggcaauuguaagcccuucacaaacagcgucuaaugugauccuuagaacaaaccuaugagauagggcauaucucaauuuuguagguagggaaacagaagccacacaauuaggaaauggcaacagaucuguuagacucuuaaacacuaugcuacaccaauuugcaaggcaaggaagacaaagcaccuuugaaaaugggucagauguuuuaggguaaaugaacguuugagaaucuuuuaaguuuuuuuucccccagagauuaucaagguaucauuguagggggaugcaucaggaaacaugacuaugaaucagcugccugauaaaccagccaggauggagcccacgucaucacagcagucagcaaugccacugaaaaacaucagcugcuuauucccguauagauuuccccuuaagacaugaaaagggaguucaaagagaaugggccagauaucucugagagucauauuacuaaaauauauuuauuuuuacuagcuuuuuuguuuuaagagguauacugucauuagcacuguagcaaaaauucacguuuuauuaauuucuccuaguuuaucaugugauucuaggguaggaugcagaguuauauucaaaauacacaaaucaacucaacucaguaaacauauaucgaggcccuaucaugacaaaaugcuauucuagagaccacggcgaacaagccacggccccagccucaaagaauguacuaucuuuggaacugugcuggccaauacaguaaccagcagccacgcagggcuauuuaaauuuaaauuaauuaaaaguaaaaacacaaugccucagaugcauuagccacauuuuaaguguucaauagauauuuguggcuccugccugccauauuggacagggcagauauagaacaauuccaucacugcagaaaguucuacugaacaaugcugcucuggagcagaagaucuucuuguucagggauguuacacccccgcuuguggcuagaguguggcuuauccucagagcaaggauaggggaaccauggcacucugcaggcucagcacugaagacacggaugcaggcucugcuucugaccuagauugaccuugggcaaggcccuuugcuccucugaucccaauuucuucaccagccaaguaagaacaucagaccacaagcccucuagggcucuguccaaaugccccaugacugagugaacugguagaacauucuaugugugugucacaacaugaagagcaaagacuuucaucuccccaaauaauuuuguuuuucguuuuaggaauuaaauuucagauucacucuaauugccaauacuaaaauucucuauaugcaguucuaaacuugacaaaccaauaaaaaaagauuauuugacuacuuaucuuuguacaacauugaggucucccuaaagcaaauuuaaaugcauauuuuaaaaauguauucuagcaguucaguucagaagcccccuggcccaagcaucacacugucaauccuuuguccucaagcagcaugguuggguggguuaaguacugacaaacacugggugucaggcccauggucagggacugugcuaacagucuacauauuagaugccaccuacccccacccucaacagacccaaacuauuuauccaauagcaaaccuugcauuauuucuguccagaagaaacaaacauuuauugacaacuuuuggugugugaccuguuuaaguccuacaucucauuuaaggacuggucaauguuaggcuaggcaaugccuguuugugagagaaucacugccuaaagaaaauucuccauuucccuuagcucuauggugggugacuacacauacugguauuucuuaaagaaauaccaauuccauuuccuuuuaacauaauuauuaauaucucauuagcauggugucacugaagccugggcccaaagaaauaccaauuccauaucauuuuaagaucauuauuaauaucucaucagcguggugucacuuaagccugggcccuuuagaauuuuucauguaccuguguuccucugcccauaucagcuggaacacuaauaguuuucuuccuuuuuaucuagaagacugagaacauuacaugggaccugcccccagggcauggaggcugaggugggacaguuuaguucaggaggcccaagaaguguugggugugcagccccuuguucaaacacagccucugaaucgccagaggcuuccggugcauacucugaggcgcaggugggacucgggagugagagguuucggcgaaugaauugggauugccuacuucuucccagugcaguggagcuugguucuguggucagguccuuacgcccugucugccuuucucguuucuuuauuucucggguaguaguuguggaaucaaaugaccugggguuugauaccuacucuaccacgccucugggggagucacucagacucguugaaccuaaguuccggggcugccaagugaggauaaguaguaauugcugauccaccuacuugacaagauaguagugagggcccugagcgccaggcuguggauccagccuuucccacgguuccugguguggcaggaagaacucuaggccugaaggugaaauuggggagggagucccagcucugccacugucucucugggugaccucaggcaggucuccucaaaaaaauaagauacuuuauaaagcucaguuuccucuucaguaaaaugaggauuccagguaacucacagauaguuuguggggaugaaucuguuccuuaaagccugcaguacaucaauaacccagucuuccugcuugcuuuccccccucuccacuaccagugaucauagucugaucccauaggugauaucccagcucaaaacccuacauuagcuucuguggcuguuuaaggccugcccagaacuccccuggucuuagcacugaaagcacguguccggggaagcccugcauuggucguucauacuacugagucccgcagggcaaaccguccggucccacccuccuuucuagugcugcugucacacucaccucccuucacccuacacucccuucugugccuugcaauuaccuagggaguuuuuuacaagauauggaugcccuggcccugccacuagagauucugauuuaauugcuugggguagggccuggcauagguaucuuuuaaagcuccgcagugguucuaaagcacagccacagaugggaaccacugaucuauucuuguagguccccagauaccucaugugcuguucccugugccugagcugaccuuucccccacuuuccucuccucggcuaauuccugcuuauccuccuacucaggaggcucuuccuccaggcagccuucccugaucccuccaggaagacuuagcugcgucccuccgcugggcuuccccaauacacugggcuugcuuucauuagaaccugauccuuccacauuaugguuguugguuugcuccaauccucucccucauuagcucucaacuuucuuucaggaagagauguuuaucuuuccuucuuguauuccuagagucgaccaggcucuggcacauugcagauucucaguaugcauucagggaacaacuuaaucaagacaagaccaucugacuucuugugaguuacaugcuaagaaagaaaugucgacaccaauagcccucacaaugauaggaacaggagguuaaagaaaaggaaauagaugcaaauagcaauauaagugcuuuaacaaaucuauacaggaggacaaccaucauauucaaauuuucaaacauucuuaguucugcucuuuuguggguaaugguuuuuuuuuuuccucuuccaggagaagaaaagaggcauauuauagaaauuccuccucccccagcauuacuugucacagaauuguaauuggaagugauuucccugacuaaguuauuuuggcugucuguuauuuucucucuuccuccuugcucuucccucagcuggccauccuguguguuuggagagagccagaaagguucaaggcuaggaauguuucucucucucuuuaaagcucuuuaaucgucaggcuuucugaucuucaaagcaggcuguagccagugugaccccacucccucgccuccccaugcuggagaguaaaagccuggaguauuuuugucauuuugaagacuugcauauuuggacagccuuggacaucuggaaagugugguccucacuagcucugcagggauaagagcacgucagcacuuccaagcucucuggcgccccuacaucuggacacguugaaaaauuaacaccagacucuggaguuaagcaaacauuaaguuuauaggccuccuugcauuugaccauuuccugggacagcagcccuuauccugugacuuucuguguguagaguugagucuuugcaguugguccuccucacacucucucaacuuugugacucucugcagugcuugguccuggauaaguuugaaagcuacaaugaugaaacucagcucacccaacgugcccucucucuacuggaggaaaacauguucugggccggagugguauucccugacauguaucccuggaccagcucucuaccaccccacgugaaguauaagauccgaauggacauagacgugguggagaaaaccaauaagauuaaagacaggugauguuucaggaagggcucgcugcauuucuccaaagucagugggaaauuacauuugguagagagaaagggauugagacuggacucauaaaucaauaaaauuaaguuaaauaagaaaaaauaagauauuuuauaaagcucaacaaagaguccuugaaugaaagcaauuacagagucacauuguggcuaauauucaaaacugagauuuaaacugaggacuaggaaauagaauuggauccuuuugaagcguuuaggagaaagauuuuaagagaaugaguuccgagucacccuguggucgggaggugugagugagcuauccaagcccguucccauccuuugucccucugugucuucucagguauugggauucuggucccagagcugaucccguggaagauuuccgguacaucuggggcggguuugccuaucugcaggacaugguugaacaggggaucacaaggagccaggugcaggcggaggcuccaguuggaaucuaccuccagcagaugcccuaccccugcuucguggacgauucgugagucugaaguucgcgauccuccuccaugacacgcuaaugggggugcuggagugggcuggggugggcugggggugcccucaaggcuuccaugucuuuagagagagccccagggaccagagccaaauuggagagcauggagcucugacugaggaaccugcuucucccaagcuccaggcaggcacagaugagucagugcaguggugggaaagggaaaagaguugauguuguagcuggaaaagggaaggggaaaauuaaagcaaggaaagugaggcugggggaggggacaaauuccccacuauguaguauguuugguauguggaaggguucuggucagaauguuugcccaaugauugccacaucagcauucauuuuggacucuguauggccaguaggucugguuccugggagcccuggaauaaugcagccccuucccuaacuaacauuuccaugauguaugcucaaugacaaggcagaggaauguguuggaugagcucaggaccugccucccuggacacucccaucccaggccuguauaucuguugaccaggaauaagccaagcaagcagccuacuguuugacugaauauggauuuggggggugguagagaaagggccgggguggaggguugggaggcucauuugucauuauagauggggucagacacacuaccaaaacagcagcagagaucuacaauugaguucaccuaaaacucaguguggacacaggaaacccucuuuuaauaacuguccaauggguuuuccagccucagcucuacagaaaacuugagauaacaguggccagucugcaguuaguuuggguucggacaauaggcagagcugggaaauggagccaggggcgaaagcccagguccacuuuaggaucaggacgggaguggcugguggggaagugagguggguguggggaggcaauagggagcugggucauuugguaugggagaguccucugguggcuagucccagaagugcaugcuuuacgaacauaugcuucucucccuagggccaccuugagugaaacccucccaugcuggaauugggcccuuucagugacaacacacaacaguuuucaauagauaauaaucccaagggcuuuacuagcacaugaaacacagggaaaacguguaaaguucacaagaaagucguuccaguguaucaaaucuauccuguuugccagguggauauaccagggucuccuccaccugugcauggcuggugguggguccaguggcuguuggauaacugauguauugauggaucauucgccuucugaaagugccaaacugauuaguuauuuugugugucuuuuuguguaacuaggguuugaccuuccagggcagacugugcuggggcggcugaccccuuggggagccaaguuauugcucuuaccaccaccacuugcccuugucaguccuccacccucuuggguuucagugucagcauguagcugucuacucagaucccauccacaucaucaagucugcaguuuuuuccuugcaaggccuuacagggaagaucuuugacauagaggauauaauuuuauugacacauuuuacuugcagagcauucacccgggcuaaccagaaagccagcacucugcuauaaacaaaaaauaaugcuucagggcuaacauggaauguguuaaaagauuccagcccauuaaauguccaggggagguuuuccuguuuuccuuucccuccaucugggcuuuguucucaacacauucauucaacaaacauuuauucugccucuaccagguacagagcacucuacuauucugcuucucuccuuuugcuuuaguuucaugaucauccugaaccgcuguuucccuaucuucauggugcuggcauggaucuacucugucuccaugacugugaagagcaucgucuuggagaaggaguugcgacugaaggagaccuugaaaaaucagggugucuccaaugcagugauuugguguaccugguuccuggacagcuucuccaucaugucgaugagcaucuuccuccugacgauauucaucaugguaagccaaauggagaaggcccagaaaaucuugaauacuuugguuccuuuccccuuuccuccuguucaugugccuggauuagucauguggccaccaaggagagcgugacaucuagcuucccagcccuuccuuuuagccaacgugggagacacucaaagagacgaaaucuccugaaggagccacuguaucacagcauccucccaucucccacuuccugcccagggguccaugguccacacagacuucccagucccauuccgugaccaucuggagaagcugcuauuagcagagcccugcacagggugauaguguaauuaaaguggucuucucuuuccaaacacagaaaaaaucaguucagggaguguuuuccugggcuuacaauuuuaacuacuggcuagaguugaaauggggaaagccuuuugccuuuucaguagcaguaggggaggagaucuggauuauuuacuuaucaucaucauggucaccuccuacauggcuucaccaaaaaacauucugcugccugaaaaagcuccaacaccucucucucuuuuaaaggauggaauuuggaguccauccuuccucagugauaaggaguuuuuauagccacaggcagcaucuauuggucuguccucugcaaacuugcaacuccucugagagcuagacuuggaaaugaaacauuauuuugcaaugcgcugcuauccuucauuuuuagcuccuccaccguagaugauaguuuguacuuguuaaaugauaaggauauaaauuuaggucauuuuuuauauuuuauuggguggaauuugguauaauuuuuagacuucaggcuuuacaggcuccugagauggacugauugagcuuguucuacuucuuccccaucaugauaggaagugcuguaccacacuaggcaguguguguagugaccacagacuggcugagugucucccaucccaugcuggcccauaucugguacccaccugauccacaaauguuccaucagauccuguucaaacaacacaucuccaguuaagccaaaucuugcccuuucuccuuacgguaaaauguacuaaaucugaagguuuugucuuuuuaauguugcuccaugauccagugaucuguggccuugguuaugcucugugcuagaguccuaacaagacaaaugcuaagguagaggucauucugcucaaacaaccugaccccaccuggaugugggcuuacauuugcaaagggcaccaaaguucuaagagaugaggggaggagcugagccccuuguccuuaucuagguuucccuuguucuuucccaucccucagucugcuucuuuucccaguaccaacauguuuguguccucagaauuaaaggaguaaaaauguguaaacaucugacuagcaacagccaugagauuuugccuggcuuguugauaagcagcauugagaucugcccuccuaagaaugggccauuaggucuucaaagcuuuuacgaugugagguaaagaauguucaccaggaguuucaugcacaaaaggguuucucuuugugggaacuagaacauuguuccagugaugacggaaacagggcuuuccauaccaaaacaggguuuuccuuugaaugacucucccaccuuucccuugucucuuccuccccaccucaacaacacaggaaagaagcuggaagcagggacaaugggaaggucccuuuguuacucgagcuauuagaaacaaaaagaaaaguggccaucugaggaagccacagcuggugaaacuguagggucacagagugaauuacaccucuggcuuaagucagugaaaaguccuagaaguuugugguccuagaaguccuaaaaguuuaugggacuuuguuuugagcaaggauaagaaauugauuucaggcugggcgugguggcucacgccuguaacccuaauacuuugggagacagaggcagguggaucacuucaggucaggaguuccagagcagucuggccaacauggcgaaacccugccucuccuaaaaauacaaaaauuagccaggugcgguggcacaugccuguagucccggcuacucaggagacugagcaaggagaaucccuugaacccaggagguggaggucucagugagcugauaucauaucacugcacucuagccugggcaacagagcaagacucugucuaaaaaaauaaauaaauaaaaaagaaauugauuucauucuucugagaacugcaacaacuaccuuaaagugauuccauccaaaacccacauguucagccauggacuugcuuuuauggagcugcgugugggugacacacaaaaucaggagcucugaguccuaauuuagacuuuuauuuagauuuccucaaauuuggguuccaguuaagcgugggucucuucugugccccgcuccccuuugccauuuguuuuaucuguucuucagucuguucugucaguacccacaggcaggagagcagaaaggagaaauggcagccacagcagacaaauggcacauucguuccacucagcucucgcaugcccaucacagauacagcucauuggucucuuuucuaugagaggaagccagagcuccagggaacuacugccaacugaucagaacucauuuaggacauggaccuauuuguuccuuuauguuccugggaagagcacaggaugaauucuauguacucauuuacguguucagagaguaaagugccucauaggaugccuccagcaaaagauaaccaagaaggucuaauaccuuugacaaucucaguuuauccuauaguguaauuggauagcaguuccccuagcaaaaguugcuaguuugguccuauuuucuacauagccaaagugauugauucauugguuaaugugaaaguuacugaguacugccagcagguucuaggaaauauauuugugugauauucauggauggggaggaucaauccacuuccaagugauuuggauuaauuacugguauuuucaccuguguggguagcaaaccucagaaaaucaaguauagaugacggcauaggacaggccaggccccaggcaaaauguugaagcuccucuggaguucccucccaucucccucuuuuguuuuccauauaccugguuuauccagggcccuggagaugcuccaagacccccuacccaggucuuccucccuugucccagcuauauuucuccauauuaccacucuucucaccgaggauuugcuuacuuaacacauaauaaauacuauuaaaagagaaacuuaggcacauuaaaauguuagaguugauuccagcaaacagugauucacaggaggcuccagaucacaagugguucagggccccacugagggguagggaagcaagacaaagaaaaacaaagcaaauauuugauugguucaaguggaaagucccugauuacagguuagugggcaguuugugauuaguuaaguuucucuaaguuggguuuugguuugcugauguaggaacacagaaugcuggggccguuucaaccuaauggucucccaauuaauuuuuuuaacauuacugaugacuguuaggagucuaaugugcuacuccucccagggaaaauggcauuccuaggauuaaaggaacucagcacauggagugugcguagaaauuuagacacuaacugcaggcuggugggagagagcccuuuagggcagaaugagaaggcguccggccaagggcaggaguuacugacgcauggccucuugguuucagcauggaagaauccuacauuacagcgacccauucauccucuuccuguucuuguuggcuuucuccacugccaccaucaugcugugcuuucugcucagcaccuucuucuccaaggccagucuggcagcagccuguaguggugucaucuauuucacccucuaccugccacacauccugugcuucgccuggcaggaccgcaugaccgcugagcugaagaaggcuguggugaggcccuugggcuggccccuguccuacaacacguuuccuuggaaggguccguagcaguccuggaggcccagccugcccucugaggggguccacuuugccuuugaccuaagguuaaaaaguucacgugaggcuaaaauguacaggggcaaaagugggagcaguccucaccccgagcgaugcaacagugacuccucaccacgccugcuugauucaucugcccuggaaagucauuaaaaaaccaguucaacucaugggucccuuuauuuacucacaagagagagccagcagcccauuucacuaguuuuccuuuccuacucuuugagaagaaucagaagggagggagcuugccacuuuacuaucugucuaaagagauguuuccauuaauuaaagguuuuuguuuugcuucaaaaaaacuugaauuggaguauuuccacaaguaucuuuaacaugcucuaccaauguuugcagaaagaagugcagaaaugagacuguccacagagucaggcucgcuggccaggagaggacucccgaagcugacuucugauggccugagaaacuuccuaguucacaauucccagacccagacaaagagcacugucuuuucucuaauuguuuucaaaugggccauuuccacccucuaaucagccucuggcccuggagggugcaguuccccuuguccuccggagucucccugucucugugcuguagagucaagaagggacaaccaccugcccucacugggaaaagacagaaagucugacuuguucucacgacucacacuuauuaggcuccagaggugucagggcaucugccuuucauuucuuagguuaaauaagaaaucaauugcugccauuuguaguacccaauuuucuaaaaugaucacaauggauaaguggcaagaaauccuuaugacucaucugugggcagaguugggcuauuuugguaauccuugaguaggcagauggaauuugaggccaucuucuuggguacauagaucacuaggaagcuauaggucuagcaacuguggauuagggcugggcugagaauuguuucauguuuuuugugacuguauagcuagagacucucuuguuugcagagagacacucugaacucccccuggccgucaagggaaagacugccuucacccuccugagcugaccuuacacugagagacaauggggacccucuuuuggcccuccccucuaccucgagggcaucugggugcuguugcauuggauaaaaggcacugcucuuuuucugugcccucuccgccucacugcagagcuuacugucuccgguggcauuuggauuuggcacugaguaccugguucgcuuugaagagcaaggccuggggcugcaguggagcaacaucgggaacagucccacggaaggggacgaauucagcuuccugcuguccaugcagaugaugcuccuugaugcugcugucuauggcuuacucgcuugguaccuugaucagguguuuccagguaagcauccuccucuauaggguaaagguaauugaguucuucagauccccagcccucuccauucaucuaguuuaaauuucauuucuuccaagcucuuugucagaaccagcauuugaaguuuaaaucuagaaguuaaaaauccaccagcaaauccuacuggcucuacuugagaaacaaauccagaaucugaucucuugucaccaccuccaccacaaccuucccaaugccagucucuuccuuccacuaccaccucccaucaguccauucugcacacuguauucagggagauccuuucagaaucaaggucauguggugucagcccucucugucaaaugcuugcacuggcuuuuccucucuuucagaguaaaacccagugucucaacccuggccuccaagcugcuucauuauccggccuccaacucucuucuucaucuuacgauuuucccuacuccuccauguuccucugcuccagccacgucggccuccuuacugacuguuuaauacaccgagcgcauuuccucuucagggccuuuccaccugcuguucucaugccagaagcacauuucucuccccacaaccugcaacccgccccucauaucugcaggcuugcuuccuuacuuuguuaaggucucuguucaaaugucccauuaucacagggaucuuuccagacugaagagaucuacauaacuauggcucuguaaacaacauuccuccaggguuccuguccccuuacccuacuuuauuuuggggaacauucuucaccaucugauacaaugauguaucuuaugcauguauuuacugacucucugcccuuaguagaauaugagcccagagagcaugcauguggucuauuuuguuaacugugacagucccagugcccagaauagugccugaccuuuggugggcacugaauaaauaucuaaguaaucuguagcauggaaaaucagcuucugaaaauuggcuguuugcacggucguguauuugcuugguagaaaaucaaauuuuccuucaaauuagcauuuucugguaacuagagcugccccaucuuccucugaguggucuccaagucagccaauagccuugugcuguggcagccaugccuggcucuugaugcuguagccaaaagcaggcaggggauggugaggcugguccaguccauggggagggacaaacucacagcucucagaucaucucagggcagccuuuguuggcagaaauagguaggcagccacccugaauaggaggaaggcuucuagacugggucaggaggccuggguuugcauccuaguggcaagcgugcauucauuuacuagggcugccauaacaaaauaccacuaacugggcagcuuagacaacagccauuuauaucucacagcucugaaggcuggaaguccaaaaucaagguguuggcagggccaugcucccucugaaaccuguaggugcuugggcacuccuugacuuguagaugcuuccugcugauccuucgucugcacauggcauucugccugucuuacauggccaucuuauaaggauaccaacuggauuggauuaggugccuaccuugcucccaugugaccucaucucaacuaaucacaucugcaaugacccuguuccuaaacaaggccacauuaugagguaccugggguuagcacucugguaucuuuuuucuugacagcacuucugacaccaaauguguguuuugguuuuuuguuguuguuguuuuggcaccaaccaauucuccuauauuaauggguuguccaagaauucaauugaauucugacacuauccagaauucacacagacuccacggguucagucccacaaggcuuccccgucuucagaugccagcuggaaauguggugcccaggcuacccacacuuuugccaaaauccuguacuuacaaucacagcuuuaaaaugaaggaugcagcucaggaacugccacauggaagagaagcacaguauggggucgggggaagaguuucuaugcucucucuagacgcaccacucucccagcaccucaaaguguucagcaacccaaaagcucuccaaaucuuguuguucgagaguuuuuauaacccuaucuccagcuccauacucccccauuggagguugaggguugggacugaaaguuccauucuucacaugugugguguuucuggugaccaguccccagaaacugcagcuaucuuggggcucuacccugagucacaucauuagcauaaacucagaugugguagaggaaggggcuuauuaugaauaaaaaaagacacuccuuucugccaggaaauuccaaggguuuuaggagaucugugcccugcacaggagcuggggacaaagaccaaguauauuuuguguuaugccacagaccccaacaugucuuuuuggagggagaccaaauucaacccaugacagugacuuugaacaagacauuugaacuuagucuguuuuuucuauccuacuagauuguuggaaacagauauaauagaugaaaauuaguugauuaaaauugaaauuugugcauaauucaaaaguuuuauuuuagccaagcuaaagcuuucauuuauucaacagcuauuuacugagcagcaccugugcaugaggcucagcagggccagguucugggaacagagcgguggagauaaagauccagaccugccccgaggaauagacaguccaguggcagcaaaggccaugaaacauacggcaacucuuaaaaaaagccgagaccaugauuuuacaaaaucaacauuuuguagggagcagaacuuucaaagagaacuggacuagaaauuugggagucuuuuucuuggaacccugguagauccaguagaaugagggauggggguguaggguuaaaaacacugacauuagaacuggauuaccuguguuggaauuccuacauuucuguuucacuaucugugacggggggcagauggcugaaucucagugugccucuguuuccuuucucacaagaauaauauuacuaccuaucuccugggguuguuuugagguuuagauuauuuaacacauggaaagcacucacagcaaugccugccacagaaagaauauccaguacaucuuagugaugaucaccauuauuauuaucugacuccuggaaaaggacuugauuuaauucucucaugaaacguuuucuuggaaaacugaugucaaccaagauuauuggucuugcuguugcuuauaacaccccaaaaacaugacuguguggauaaaaauauguuggaagggguagucuuucugggagccugagaauagccauguaauaauaacugcaaauaucuauaguuacaauuugagguucagguaaauaaacucuagaucuuauagaacugcgguaagguaggauagggagacuccuucgacuuucucuguuuauuugucucuauuuuuaggagacuauggaaccccacuuccuugguacuuucuucuacaagagucguauuggcuuggcggugaaggugaguccuuuaaaacacaaaucuuaauguuugaaaucaacuccuugggcucugugcaagauguauauggaucacagagguggcccucuauguaaacggugugauuccugaugagucagcugccuccuggggcucugccccuugaugggcauugcagcgucugggggaccaccuuucacaaguugcugggcccugugugaucaugaauggcugaucauggaugaagcccuggguccuguacaccuuguccaguagacuaaauugcccuauuuaaaaaaggccaagccacuucaggguucaaagaacuuuugcagcuuuucaguauaaagcagaaauccagggaaucaugaaggaaccuuugcauucaucucccauugccuuccuugugccuuuuuauucuucucugccuuuucaaaauauaaauuaguuuauucucccaagaugaagacuccuccuggggcugaggcagagcuguuaucuucagggcaauaccucagauucuccugguguugaucuuucuuagggguggggaaaaaggcugaaagggcauuugcccacaacacaucuuagguaaaaggcaccuuuacuacugaaccaaacaggaggccuagcuagagaaaguucuagaagcagggaaaagcacagacucuuuugugaggucugagaaagcaaagaaauuccagggugaaagcgggggacuccccuagagcugaaguacucucccaucuguuuguugcucaccuaccuauucuuuacuuuguauuauugggccugggccaggacuuauccugcaagcacugagauggauguuuguuuucucugggggauuagucuuuuuuuuucuuuuuuucuuuuguuuuuugcuuuuguuuucacugggucaaacaaacaacacuuuaacagcucaggauuuuuucauuguauugacuugucuaccuguaaacuuguuaauuuuuuacuauaauaaaauuaucauauaauaaaugaaaaauuucaacacagggcuugugggcauuuuauuuuucucuacaaucccaacagauacucugccucuuaagaaaaaaagaaaucauaaggaaaauaugcuccuucaaaagugaaucacaaauauguuugccaacggaaggcaaauauuuuucaccugucucauaggcuggacugaaauggauuucuaaaacucucuaaaaccagaaaagagcugagugucuccacccaaccucccuccuuucacagauuaaaaaauaaaaaauggagcccaggagacauccaguaucuuccccuauuggucaccugggacaaaaucuggaacaugcacaugcauugccuggcaggaacucauuccagugauuaaacucuucaggaggauguuuccucuugcuauuucauuaccuauuugugcaguuugauagcuaguaaagugaucaaaggaacuguggggcauagauucaaaaguccuucaggaagcagaaauagaagaacaguacuagaggcagcaggucccugaccagcaggcccacuaccugcugcuccagcacacauccugcacauuuucagagggugggggacagaggggcccuggguggcuguugcauugagaaaucucgcccugcuccuguaugugcacuugaggccgagagcccuuggaugccuggugacagugguuuccuccugccccugccuuccucucuggcagacugacuggcccuucugcuccucuuccccuuccaggauguccugauaucuuuuuaaaccaaaugccaaguuugccaaaaagugucuguuuguguguguguguguguguguguucaaugcguguguuuauaccacacuucacaauuuguccaggcuuguauuaauaccaucaccaggcucaacccugguguuaauuccaagauacuuaaaugcccaucuaggugaauuucucagguaaaccauauauucaagcuguaguuuaagcuggcugcccgucauagcacuuugaauagacuuuguuuuuguuuuuguuuuuugagacagagucucacucugucggccaggcuggagugcaguggcacuaucucggcucacugcaaccuccgccucccggguucaagcgauucuccugccucagccuccuaaguagcugggauuacaggugagcgccaccccacccggcuaauuuuuguauuuuuaguagauacgggguuucaccauguuggucagacuggucucgaacuccugaccucaugauacgccuacauuggccucccaaagugcugggauuacaggcgugagccaccacauccggccccugaauagacuuuuacucaagguucaccaugacuuucacauguuuuguauuggaguaaaaugugccaguggugggcuaaagaaaauuaacucauuucaaauucaaaccugguuuucuuaauuuuuuuaaaaucacaguuucugaaacugugggcuccucauggcacauugagaggaggaggugaaacucuccaagucugaagcuccuguuauaaaucuuccucuggcaaagauugugugaucaggcuugaguaccucacaguccuagagcaggucaaaggcuggcuaggaaacucauuugcucccuguaccucuccccuccuuuccugccuuugcucguucucagcucccggugguagaguaacacuggcuucugauuggugcaggguguucaaccagagaagaaagagcccuggaaaagaccgagccccuaacagaggaaacggaggauccagagcacccagaaggaauacacgguaaaaccccgauaaagaauacacagcagaggcgaggaaaaggcucuaagcacugcagagggccagagcaaaacaucucauggcaaggguggaaagaagccuaggaaacugacucucucuguggacaaguguuaaaccagaucccuucucagagguccaucugcauguguguggaaugaaugguucagcccagacauuagcgcauauuuccuggagaaagcaaauaccaacuauguagugugccugugcccuuguuaggcaaaucccaagugaguugcacaaaugugcugacuuccgaggauuuagcaagaacaauaacuuuggucacugggacuuaaagcggauaugagcuauaaggaaagacaaaaauaaaugcuucuguguccagggggaaagagacuccaggggagcugacuacacuucacuuacggcuuacaaaucuagaaggccauucauugaaaccaucagaagccuuuccugacaguggaaguuaccuaauaaucccuaaacugacgacccagauuuacaaguuuuguuuuccuggcuuuugcugcccucaucuucucucuuaaacuaguucuguauuucucccaaggcuuuucauucccuaagcauacgcauuucucuguggccaaaaugcucuggguuuagacaggcagcacagccccugggcucugccugacagggcaggagagggucuggccuuuaucccuccagcccaccccaggggccauuucauaaaacuaaagccagagaccugcagccccucccagaguuagacugcaguacaccaugccucuggcaagauccuccucccacaguggaaagucuaagccaaaucaggaggcuggggacugguuccaccucaguugcaggcaaggccaggaggcacggauagaagaaacaguggacuuuuucccccuagggaaagaaaugcuuagagcuacaguauuaagaugacaaauuaagcugugccauauagggugaaaugaagcagggauagaugggaggucagggagaagugagagcacucggugagggucugcacuggagggggcaugggaggaagaaggaggggagugggguuugagggauggugaugaggaagcguggacugcccuacccaccuauuggaaaaccugggaguucugaggagcaagaagccuuagucaaagucaacucaaagauucaagccaaggugacuaagagaauggcgguccagaaaaggucaugggagaaucugaaggcagauguuguuuugggaagaugaagaaccuaagccgcuuccagaaauucaugaggaaaugccccguggacuguuggcaaugagggccuaggaccaagguugagcuuggggccaacucucccuauagacagugagugcauucugacaagcaugggcucuggguucaaaucccaacucugccacucaugccuauguguccuuaauaggacgcuugaugucucugugucuaagguuuccuggacuauggaaaugagccuaauaaaugucuaccccuuaggaccauuguaagaguacauugagguaauuuguguaaagcagucgaagcagugccuggcauauaggaggugcuguauaaacguuugaugcuaguauuacuauuauuauucuggagucuuccuugcaacggugauagccgaagccacaggggcaggugacguuauaggcagaauacaagggccuggagacagagcccuggggccauguaauuaggcauuauguuuacaucauguucauuuuuuuuccuccaagacuccuucuuugaacgugagcauccaggguggguuccugggguaugcgugaagaaucugguaaagauuuuugagcccuguggccggccagcuguggaccgucugaacaucaccuucuacgagaaccagaucaccgcauuccugggccacaauggagcugggaaaaccaccaccuugugagucuuccagcagagaagcuggcugccaugcuagccugucauuuccuggcuuagucuuucccuaucagcggcugucuacucuuucccacaaauuuuagugacaaauauuugcggccccaaaaauguguaaaagcuuucugcaguauucaaagaucacuaauauguauucucuugauggggagguagaauacguuuauugccccuuuugugugccggggaaguggacauucauucagagaguugaagugacuuuccugaagccaccaaguugucauggcucagcgggggcaaaagccaggcaccacaguugccucuuguuucucacaccuugagucuuuccccccaucucaacaguccaugguggugaucaagucauggccacugucaucaugugcauggaagcuauagaguccuccuauuuccuuucucuuuucuuuucuuuuuuuuuuuuuuuuuuuuugagauaguaaccauuacccaugcuggagggcaguggugcgaucuuggcucacugcaaccuccgccucccaggaucaagcgauucucccaccucagccucccaaguaggugggacuacaggugcauaccaccaugcccagcuaauuuuuguauuuuuuuuuuuuuuuuuuuuuuuuaguacagacaggguuucaccauguuggccaggcuggucucgaacuccugaccucaggugaucugcccgccucagcuucccaaagugcugggauuacaggcgugagcgaccgcaccaggccgaguccugcuauuuucaaggaacauuccuuuuccuaccaaucauuaggcaggcuucaacaucagcugaugaggguuaguggucguucuggagaaagugaaaaaagaaucagucucuagaggggcuuguggaguaaccgccugguaacagaaggucagggcagggaaggcaaaggggcucugcgcggaucucucagcuccgcaggcgccccacucuccuccaagggacccgagcgccaucugcugagaggagaacacggcccgccaugguuucccaaggagcagcagacacggaccucgcagggggcagcgaacccacgugacacagucuucaaguccuuuggagagccccaggaaggaacaacagcguguacacccugugauggaauguucucuagggcgguucagugugaauggaauguggggccggugccauucuaauugguucuguuucccucuagugguugaucgcggagauuucggcuucuccaucaggacaaguucagauagccugagaugguaucagaacucagggacagagcuggguguggcggcccugcauccaucugcuuucucuccaugcuaacugauauggucagagagcuggaagcaaauuccaggaccccagggcuccgcaaaggcaaacacauuacuucaucggcugcugacaugcaacuucccccagggguuaaaacaauguuuaauacuaacaguaauaauauuuuugaguuuuacuuuaugcuggcgcuguucuaauguuguaaguguauuaacucauuuaagccuuacaacaaccuaaggacaugggagucauaguucccauuuaaaaaaaaaaaaaaaaaaagcccaccauugcucugaggcuuuuuauguuuuggauccaaagcuaauauugguggugguaauucccaugccuggcuucgaucaauuaaucagcaaaugccuaggacugcuuaggguucuggccuucaucaagaccuuacccgggcuuuaugaugaugacaccuggcuuuucaauagccaugacugcucacccaggaggcaacgccucgagucaugcaccgaacaccuuuuauugauccucuccaacaccaggcuccgugauggcugagcuggggacaccugugacugcacgugaacauuuugaggcugggaaucccaaaggcccucggcguuggccugggagcaccaugaaacaaguagaagcagagaaggauggcagagguggcccucugcauuagggccuggauguauacacuggugcuaagggggccccacagcuaauagggguuugaguuugacugacagccccaggcaggaaucugugagaguucucacugaaccugguguggggguggcccuccuaaggcauguugcuaaaggccaucucuucugccacugacgccuguguucugcagguccauccugacgggucuguugccaccaaccucugggacugugcucguugggggaagggacauugaaaccagccuggaugcaguccggcagagccuuggcauguguccacagcacaacauccuguuccaccaguaagcgacacaggaacugagaccgccccauccccucuccucaccucugcccccagcacacuucucuagagcccagcucaggggugccaggccugggcacaggcagagauacagacucuuauuugguuuccccuauguuuaaaguccuuuguccuacuugcagugagaauugucccugagaauaugggacucugccucugcugcucagagcugagggcuccucccucagaagggugaggcugccuucgcucugacagagcagcugaucgauccccgagccccuugugcagcccugaaguacuuccucucugggaccaaagacaggagaaccauuguuccuuuuuccuguugaagccacggccugaaaggcaaacuuuucagggggcuuuucaguuacuuuuuuuccccaauaagauaucuuuuauuucuuaucuaagaagcuacgcauagucauugugaaagaaaaaaaaggaagggaggaaggaagggaggaaggaaggaaggaaggaaggaaggaaagaagggagggagggaggggagaaggaagcgagggagggagggaggggagaaggaagggaacaggagggaggaaaagggaaggggaaggaggaaggaaagggaaggagggaggaaguaaauauagguaaacaaaaaauugaaaauaaaagucaccuguaauuucacuacucagagauaaccgcugaguuauaacauugguauauaauuuuuuagaacuuucuccuauacauguauagauagauaaacacauauacuucaaaaugauaaagaauaguaaaacuaugcauacaauuuuauaaccugacuuuuuuuucaaaaaaaaggauugcuuuuuuaaacauaagauaucaggaacaucuuucaugucauuacauauucuucuauaaaauaauauuuaauguuuacagauuauuccauuguaugcaugaacuauguaagccauccucuuauuagauauuuaagcagggucugcuauuuuuguauuguaucauaaacaccaccacagugagcaucuugauugccaaaucaagaauacuuguccucaauuauuucuguaagaucagcugcuggaaguggaagugcuaagccacugcuuuucucguugucccauccuccuagccucacgguggcugagcacaugcuguucuaugcccagcugaaaggaaagucccaggaggaggcccagcuggagauggaagccauguuggaggacacaggccuccaccacaagcggaaugaagaggcucaggaccuaucaggugcucagagcuggauggagacagggccacagauggcaaauccauggcuccccagugcacccaggaggcaggggaggcuuggagcaggagagcuucuaagggugggaacaccucugugaaguuacaccaaaaaucuaagagcagcccccagaucauuuucccugcagagcacugucucacagcagccuggguuuuauuuguccugagauugaugugcuugaacagucuucaaagggucugauccgaggaggugaggguugcccuuucugcauuuacaaagccugaacaguauuagggcuuugaacgcuauaaacaucuaagaggcagcaccaaaccacugcuggguuaagguacccccacaaugccacuugcccugggccuuucucuuccucacccuccacagccccuuaacucucccguccuucuugugccuccagguggcaugcagagaaagcugucgguugccauugccuuugugggagaugccaagguggugauucuggacgaacccaccucugggguggacccuuacucgagacgcucaaucugggaucugcuccugaaguaucgcucagguaacagcugcugcucagucuccugggcugggcucucacugcagcccuagcugugguccccacucucucaccugccauuuuguagcugaguacaggaaccacaaugacuacacucagaaggggguuuaucagugacuuggugaaucuaaguuccagcuaaagccuccugagguuuuuacaaauauaaacagagaaucacugaugaugcaaccuacuucccaaaauauuuuagaaaauucucuugaccugcagcccuucugucuggaauaauggaugcuacucuaggugaaugucuucucugaccauggggacccaggucaccugcaaacauaccuagaagcuccauagcugucagaugaccacucaggaccagugugagggugaccugcugggcauucagugcuccagaggguggccacagauggaaguggcuccucugucauggcaccucucagacaaggggcucagaucagaagagacagcaagcagagcugagugcccauagagguaacagcacgguucaaccccguggucaagccagagcuuucccccuugcucuacucacacagcguugccccgugccuuucucugaggguuugucauccugaaauccucauugcuauuuucuuucuuucuuuucuuuuuuuuuuuuuuuuuuuuuugagacagaaucucgcucugucgcgcaggcuggagugcaguggcgcaaucuccacucacugcaagcuccgccuccuggguucgagccauucuccugccucagccuccugaguagcugggacuacaggugcccgccaccacgccuagcuaauuguuuuuguauuuuuaguagagacgggguuucaccguguuagccaggauggucucgaucucccgaccucaggugauccucccgccuuguccucccaaagugcugggauuacaggcaugagccaccgugcccggccugcuguuuucuguuaaugacaucuccaguuagugagaguaugcacguguguguucuuuaugaagaguauaaauccagagcuuaaugauccagaaaauguacauaugaaacucccuagaugcugaccauaauacaugagccccuaauauagagauuuauuugaaucagauccuaugcuggauacagagacacuguguguggcaaugcuuuacaguauguaggaagcuaugaaauguuaguuauuauuguccuaauaugcuggaauuugcugcugaauuaguucccuuggguuuuuuuuuuuaguuaacuccugauuuuugcaacuauauagccaggaaauugcuguacacccuuuaccaacaaugcccaacccagggcaggccuggugauugcccuggccccuaccuugcaggcagaaccaucaucauguccacucaccacauggacgaggccgaccuccuuggggaccgcauugccaucauugcccagggaaggcucuacugcucaggcaccccacucuuccugaagaacugcuuuggcacaggcuuguacuuaaccuuggugcgcaagaugaaaaacauccagagccaaaggaaaggcagugagguaggugucugcccagggaaggacccuggccugggugagaaggagcacacagcacggggcugccacuccagacauggcuacucacacaggcucucgccaccagaaucagugucuuuguucugggaccauuugcagaagauuucgaugaacacauucugaagccuccuccuacagagaugcuuuagccaaaaugaaacaacuagcuuuaaauggucugcaaguauuacaugccagauuacacaccaguuuggugcgguuuggugcaacauagaagugagugucuuauucuguaagguuaggcuguuuuaagagcaauugguugagcuucauuucaacauuaauauucccuaauuaaaccugaauuucagugguaagugaaaacuaagaagaggccuccuugggugcuauaacauaaaaaugaugaaggcaaaaaguaccaaccagcagagaccacuucagcacaucaggagacccaguuuuaugucugugcugcgaagugaacaaacugugucauccuaggcaaauuauuuaauuccuccuuuuuuuuaguauuuuuuucuucuucacauggaacaugaagcuaaugaccucugcuucuauuucuuagggaugugaagauaagugagauaaaguauuauaaaugugcucugggcuucuuaagaacaggcauugcucacauucaaauggucaugauuaugauauggcagcauuauuuaugccucugguuuaagugucuggcugccgcugggguuuccuauguccauccacggggagggaggcacagaaugucucccacaggcagaaccuacagcugccacauaauugaugacaagccaaagggacccuuggagguucugcuccucucugugugugacucacacacucucuaggauaaaaucaagcgacuacacccucaaaaugcucagaugaauuaacagauuaaacagugaagaaaaaaauguguugacuacacuuggcagugagaaauaaauaaagcgggcggugacagcagcuggcaucagggagaggcugucauggaagggaugugcaucuugucagucaucccauccaucuguugcaggggaccugcagcugcucgucuaaggguuucuccaccacguguccagcccacgucgaugaccuaacuccagaacaaguccuggaugguaaggacuggacgggccauacuuggguuccgucuggcagccaucucccaguauugcuggguguguccuguugugaugcauuuuaaugggagcaaagagaacacuggguacuucugcaggucacacaguuguucuuuugcuuugagcuucuuucuccucuuccuucuuccuucauucccaaagggauuuuaaaagucaugcaccuaaaggcccucucccuuuaaugaggaauacacucugugcucuuacccuuaguaagccaucauuccuggggucccccugcccuggcuccaggccacauuccuuagugucuggggagagcuucuucuacaugugugccguggcgcccucuaguggaagcauggugaugcacggcucuuccagugaauucguggagucagagauugcacauguggauggcaagucuggaaauagcauacaccccuguuauacuccugauucuccccucagcuucccaauuucccagugauucucccuuuaauuaggaugcacugaagcucucaggggugcccccaucuccaaggagcugcaguggagaggcuauccccucucuaugugagagaaugugugagaagcguauucccacacaggagcaaaacuaaacuuacguacugaugcagguuaaugaauggggaaaguaucugcuuaucaaagaaaaggcauauuuuucuauuuagcacaaacuuuuucaaauguuaagaauuuacuaacugaaaucuggugaagcaagagaaccgggcaauauuugcguugucugaucauuacaacuggagggaacaugcucagagaggcaucaucacuguucaugcaccugcccucucuuuacacugagagacccugugaugaacagaaaacaucuuuuuaggaugacaucucugggucuuucuccuagccugccuugcuguggguaccuaucucccugcucucugaaccuuggucaagaaguuuauauuuguuuuaaauugauacuaauauguuaaguuacugugauuugccaaaaucagauuggaaacagggccugcauggcugaaugauucuuuuuuuuaaauuacuuuauuucuaaauaaagguuuucuuuguauagaaucgggaugcugugaauggugggaaaugcacuaaauaguuaugccccaaauaagaaagggaaaaucauuugaauccccaguuagcuccuugaaagucuuuucacuuaaacacacccacauaccacacacacacucacagaccucccucccagaugcccaaagcccugcugaccuacagagcuacuucuggaaaggcugacacaugccuaagacacaauuccugggaauccagcagcuuuggguucaauuuccuuccuaaaagaacaaugaauaugaccccuggagagcuauuagggcagagcugcuuccuuaacguaaaggacucuccagccuccguaugaagucaucucagagcuaaagacaaucaaguccaacuugcagauuugacauaaagcaagacuuccaauccggcuaggcagaaggauuuugguugaaaaccaugaaaucccuucauauggaucauuuuuuaaacaacaaaaaaagaaaagaaccuacuggguguccacaacucugagagcugcuuucugaagagucauguuuugaguccuggaaucccucucccuuugaccugccucucaagacaaugugcgagagaacucucucuucaagugcaugcaagugagguuuucacaguuagauuuuuaauuuuaaaguaauacacauuuguacauaaaauucaauucugacuguauacaugugucagauaaacaguugauaccugacacuuguucacagucuaugauacgcaccgcauauccuacccucucccccagccucucuccauggcuucucaacccccccucugcauuuccugugaccugaggauucaguuuuguuuguggaggcaggugcaaucccaagagaaacugugcaaucuucugagaaguuagaguaggcaugugugugugauuuagggaagguacuucucacucagcuuggucaccgguuccagguuugugucuugggcaagucccccauagcuggugacagaccagaaaaaugaaaacaacuuugacuuagcccucaaguuuucagugaaugagaaugaaaaacaaccaugaguaagagauuucuuaccgagaugauguaaaggauaauaauagcagccagcacucaccuaugugccagguauuucucuaacugcuuuguguaguuugacucauccaguccucaaaaacaacaaugaaguggauaccaguauuuuccccuuuucacagaugaggaaagucuaaugugacccacccaacauaacauaguuugaggggacagagcauuucguugaacagaggaggaacuggcacaggaaaguugcaugacccccccaccaaccuccgcccccagguugcacagcuagcuagucgggaggacuuugcuuccguuucccucugccucucaaugaugaucucagggccaacuaagcuaaaagcagacuugauggagcaucaguccucugaaagagucacugccgagauacaaaauaccucuucuucaaaggggaaguggagagaaguaggaaaucuggguaaccucacagucuuccaguuucuggaaaacagagcuggcaucagucuuuuuucuuguccuaggggauguaaaugagcugauggauguaguucuccaccauguuccagaggcaaagcugguggagugcauuggucaagaacuuaucuuccuucuuccaaauaagaacuucaagcacagagcauaugccagccuuuucagagagcuggaggagacgcuggcugaccuuggucucagcaguuuuggaauuucugacacuccccuggaagagguaaaguagagauuccagcugguuucugucaagugccagaaguggcgguucuuugaaaaagucuaacauuagagcaaaguuuuguaaaagcaaaaagccaucguuccccacccaagcauagcaacuaucuuuauuuuuggcauaguucccccaucucugcaugcauacaaauuuuauguacuugugguuacugugugcuuacguuuuuguauuuauagaagaugauguucucagauagagucguaauggauuuucuucccauuaugaagcaauacccaacaaaacagagcuuggguuagauuuuucugagaauaagaaugacuaaacaaaauucucucuuuuuuucuucuugacagauuuuucugaaggucacggaggauucugauucaggaccucuguuugcggguauggugcuggagccaguggcuuguucccuuccuugccucccucccaaguuccaucucgaaagucuaaggggcugggcacaguggcucaugccuguaaucccagcaauuugggaggccaaggcagauggaccaccugaguucgagaccagccuggccaacauggugaaaccccaucuguacuaaaaauacaaaaauuagcuaggugugguggcgcgcaccuguaauuccagcuacucgggaggcugaggcaggagaaucacuugaaccugggaggcagagguugcagugagcagagauugugccacugcacugcagccugagcgacaagagcaaaauccaucucaaaaaaaaaaaaaagucuaaggaaaaagucaugaaacaacaaagcaggcaaauacuccuccauaguaucugacuccccaguaguaggcauuuugcauccuagauggcuuugagugacaaaggaauaacagacugaguuaggucuagauggggacacuuuggaugaaugaggauucuuacggaggucagguugguagcuucaucccucagcuccucaugcuguauccccagucucucggccugccaugucaucauccucaucuccuccugucaucuccaccaggccucugauccaucucugucugcaugagugacagcuggcagaguccuuaauguuuaucaaauacaacucagacgucagucuccuggccccuuugagaucaacauaaaaucauuuugaacccuuauuuaguggucuaugggcuuugaaaacauggggaccaaaauuccuguggauucuagaagucucucuucuacaugugucagccugggcaccaacuagcuccuuccaugaacuuuuaucaaacccacagccacacaaagcaugugugaguguagcagaguuuacagcagaggguggaggguggggagauagauguguggaaggguuaccugccacacaaacagaaaccacuucugauagaacacgagguguccacccacacuguaaaauccucuccugguacaggcaaagcuuugcagcgauucuccuuugcugccccugggcuccuaacaccuccuaaaccaccaguuaccuccuucuuuccaguguggcauauuucaguguuuuccuguuggaguguuuccuuucuauguggauucuggaaucagcucuuaagauaacuugguuuucaucuuucuucauaaugaucccaaacaucuaucuacuaugccuagaacuaccaauggacacauauaccagcccagauaugcuucagcccaucccaguacaucgcauggugaccaaaagauguagucguccuggcacaguggguguggggcaggaagcaguccucuccaggggacagcagcaauucaccacagaacccaaguuucuuucaagcucugcugacacagaaauugaauaaucucagcucacccaaugucaaagacucauauuaaccaagaccagaaugaaaauaugcuaauuuauaucagaagcuuugcuggauucaagaguuagggccuuuuaccugugcagaauauuccuucuugauaaauaggcccucucaggagaauaaauuacacaucagaggacuguuuagucagcauaggcauagaacaggauguuccaaagauacagucaaggggaguggguaagaguguagccucuggagugaggccgaccaaauaucaaaccugagcuucauaauuugcaaacuaacuggcuuuggguaaguacauagccucuuuguaccuguuuccccaucugcaaaauggagauaauaauagcaucuaccuguagcauuguugagagaauuaagugaguuaaugcuugccgacuuauaacacaguauacgaucacugauuaagacuuagcaacucuaaacuaaauguuuacaaaccaucucuuaccucaaagcacuuaacauccauugucuuauuugauuaucacuguaaucuuaugaagcaggcagggcaggggucugccccaucuggggggaacugagcucacagagguuggaggguuugccuaaagucacccaggccacugggucucacucucuggucuuagcucuguaaucuaggaugcucaaugccacacucucagccacuuuucagauggcuaaguacauuuguuuugaguuagcucagucucagaggaugacauuuucugaucuugucuccaguguuuaaaugaaccuguagcugugcauuggggucacacaaugcguggcauggagagggucuguggcugacugccacgguuacuacgugaaaccaucauuacagcaguuacuacuguuacugccugagaacaucauuacaagacugaacgaagggaucaacauggaaaugauaacaaaaaaaccaaaguaacuguuuuaaggaaaggcuagcaucgggaagaagaagagagaagaagagaagaagaaaagggcucccugcuucuaaugaguaaaggcagcucccuaagcuucugcagcccuucauuauuuauuggguaacaggaggaaggagcaggagguaaugauugggucagcugcuuaaaugaucacggguucauguuguuacugacagauuucaauuaugccuaaucauaagaaacauuugugcagccuccaacaagggucaaugccacuucugaaggggugacucauagucaguaacuagaaagcagcagauagcuagggacaaacuggcgauucugaauaggccuggaacccuuagcucuggccaggucagugggcuccagucaggauggagccuucagggagagaucaaagcucagagguuugagaugauaucagccagcaaagaggaggggcaguagggauccucccagagggagggccagccauagaagacaucaaaucugagcccggaucaggagaaggagccugcagaacuggggcucuggcaccgagaaccugcagaacuucgccccucugagugcaggugccagggcuggggcugccacccagccuucgcaucccaggccuggcacgucauagguaaauguaguugaaaggaugacugagcugauccaauucccuuuacaacuguccuuguccugggggacuugaggaggguuaagaaagcagcuggggaccaaccaacaguccucuaggcucuccauguccagcaauaguuguucagcaaaugagcauuaaucagugacuauaaacuguagcuucaacauaaccgacaacuugcaaugguuucuagagcaugcucccauguguuaucucauuuaaauuuccaaaccaauccugugaaauguucuuuuuuuuuuucuuuuuuuuuuuuuugagauagaguuuugcucugucacccaggcuggaauacagcggcucgaucauagcucacugcagccuugaccuccugggcccaagggguccucccaccucagccucccaaguagcugggacuacaggcacacgccaccgugccuggcuaauuucuuuucuaguuguuuguagagacagggucucccuauguuguacaggcugaucugaaacuccuggggucaaucaauccuccuggcuuggccucccaaagugcugggauuacaggcaugagccaccaugccuucauuuuacagauaagaagucugagaaaacucagauuuaggcagauugagucacuuccccaaauuuauguaucuuguaagaauccauauucaaaccucaguccccuaacucuuaguucauuacuuuuucuaccacuucucaguauccucuaagaauucagaaagaaccacaucgacucugauuuuucauuuguuuaaguacacagguaauaggugaauguauuuuguuguuuaaaaauucauauaauacacaaaaggcuaaagucucgcuucccacuuccucuccccuuucuacccaacucugccuccccagggagagcuucugcugacagucgguggacauucuuucagaguuuuacaauuauguguguguguguacauaagaugucaguuuuucuuuguguaggauacaugaacaugaauuuuaaacauaaaugugaguguauuacacauauugaccagcaccuuaguuuuuuuguuuguuuguuugguuuucuuugugcuguuugagaaggagucuugcucugucacccaggcuggagugcagucuugcaaucucggcuuacgcaaccuccaccuccuggguucaagugauucuccugccucagccucccgaguaguugggauuacaggugccugccaccaugccuggcuaauuuuuguauuuuuguagagaggggguuucacuauguaggucaagcuggucucaaacugcugaccucaaaugauccauccaccucagccucccaaagugcugagaugacaggcgugagccuccgugcccagccaguuuuguuuuuuuauuaaccaaguuacguauuuuaaacuucuccaugucaaugcuuuuagagcuauuuuguucucuuuaauguuaauagagaauuuuaaggcaauuucaggugaaucuauacaauuucucuguauaaguaauuuacacuagaaauagauuuuuauaaagaugauuaagcuaccagccugguauuucauugcugacuuaaaugaagaggaaaaucaaugcuguaagggaaaaaaaaaauggcauuagagauccagaccuuauaggcauuuuccaaauuauuaauucaaucucucaaaacagguggcgcucagcagaaaagagaaaacgucaacccccgacaccccugcuugggucccagagagaaggcuggacagacaccccaggacuccaaugucugcuccccaggggcgccggcugcucacccagagggccagccucccccagagccagagugcccaggcccgcagcucaacacggggacacagcugguccuccagcaugugcaggcgcugcuggucaagagauuccaacacaccauccgcagccacaaggacuuccuggcgcagguacuauugucggucgguguuuagcugagcucaguggcuccucucccagccuuccccuccucuccugaguguuccuucaggcauggguuauaacucagcaaggagcacccucuuuagauucugcugguuuuguuuccugcuuuccaaacccuuaucuugauucuugguaacaugaaucuucuuuguaaguuggaccuccccuagcaaagaaaauagaauaauagugaaaauguuaauauuguuuuuauuuuuacagugagggauaaagucauguuuucauucauuuuugcagugacccuacauaucaaaaucauugcccucuuuuuucuuuuaauguuguuuaauuuagaaaaagaagcucugguuuaaagaacagugagucacgugacuugcucuuugaaaugcccuuugaagucuggcugaacacugggcugcauucagauucuucaguggccaccagaacauucuguuuucuucugcacaucuuaccuuugcacacccugcuuauuauguucccccagaagcccaacccucuccaccaggggcugauuaggaggcugcaggauaaauguuuaaaagaaugaagaugugugugcacgcgcacgugugacaucuccaugccacagucauguuuauuccacgucuauucucccacagaucgugcucccggcuaccuuuguguuuuuggcucugaugcuuucuauuguuaucccuccuuuuggcgaauaccccgcuuugacccuucaccccuggauauaugggcagcaguacaccuucuucaggugcgcggacucggggucaccauucuccucuguggguuuggggcaccugggucacaugcugcuuagaagggcccugaccuucccacuucacugggaccuucaccaaugagagaggggaggggucuuugggcugccugcagaaaggaacuuaauguaucugccacugcuuggaaaggcgauccuaguggacaggcaggacugcuugggaaggccgaauggggaaaggaaugcaaagcuuaggugaauggguugaagcgccaucuuuuugaggcauaggugacaugccaucagaccacugcgaguguucaggcagccuaccgcacucccaggagagcuagcgccaucccaaggcagcauucggugccuccaauacauaccuggcacacagcagcuauccaguaaaggcucugaguugcaugauguuggcacgcgccugcucugucccagucacaugucucacucugucuagcauggaugaaccaggcagugagcaguucacgguacuugcagacguccuccugaauaagccaggcuuuggcaaccgcugccugaaggaaggguggcuuccguaagugccuacgcgccccuguccuaagaagacuagcuccccugggaggacccaacgguggguucaagauggcaggcguuggggaggccccacucaauccugcucugcuggucacuuccaugucucugaccagcacucccccaaccucuccuuccacacuugugugcagggacauucacuaccuccuaggaagcccccacaccacuggacagcucuauauuucucagcauagaaguucuauguugaguugacagaugauuccccauaacuuauuugaaaggccucugagcagggagggagggaaauaggguuaugcuauugugugauugggccuugaauggcgugagugacacaguggccaguacuuugugauaguugugagucuggagaagggaguuagcgaaggccauugacauccaccaggaauccuaaaaguucaauauaauuuuaacuuuucucccucagucuuuuucaaagcugucaauaaggaccaaaacagacuaauuucaaauuccucuucugguugcugugucucucaacagcuagagcugcuaggaauaaaaagggagacaaaacgauccacaagcuagagaugguuauuccccagccccacaccuagucagucacaaaacccuaguuuugauauugcuugagcagaaaccagccuccaagagaauaagaagaaagggccugggucuaaagaggaggaggaaaggguugggcacaauuucuuaugccuagggauuugucagcaacuuugaggcugauuauggaauauuuucuugucuuccaugagggaguaccccuguggcaacucaacacccuggaagacuccuucuguguccccaaacaucacccagcuguuccagaagcagaaauggacacaggucaacccuucaccauccugcaggugcagcaccagggagaagcucaccaugcugccagagugccccgagggugccgggggccucccgcccccccagguaccugaccuccaaacaacggggccccaggucugccugccacagagggacuaggggagucccugguaucuccugagucucucacaaacuaacauuucaaacuggcaguugaguaggggacuaaaccaaacucccugcacccucugggaggggcuccccacagggcgcuguggcugccaacuggaggaagccacucaccaaaagcuucauuuuccaccagauacuuccuauuugaucuaguagaaaaaauguguuuaagcacuaaaaaaaauuaagucauaugugcucauuauagaaaaauuagaaaacacagguaagucagaaggaaaaaaaaucaucgcuuggauauaaacacagauaauguuugguuugcagccacccaaacagauuauauuccaaauauugucuuaaaaucugauuuacugcauaauuuacuaggaacaugcauccaugucaauaaauagacaucugcaucacuuuuaauaucuguauauuaucccauuguuugaauuucuuuuuuuuuuuuuuuuuuuuuuuugagacagagucucucucugucacccagguuggagugcagcggugugaucucggcucacugcaaccucugccucccagguucaauucuugugccucagcccccccgaguaguggggauuacaggcaugcaccaucaugcccgccuaauuuuuuugguaguuuuaguacagaugggguuuuaccauguuggccaggcugguguugaacuccuggccucaagugaucuacccacuucugccuaccagagugcuaggauuacaagcgucagccacugcuccuggccuaaaguuacuuuaaauuaacugaucucccauuauucgccacuuagguuuuuuaguuuucaccauuauaagcaaugcuaugauguacauucaaauggaaauguguuuacacacuuauuaacagucuuaauuaagaagcucuccaugugcugugucucuaacaucugcagguauguacacaaauacaugcacagccagcauccaucuuuugcagggacauuaaugaucuuggcucugagcagcacccuguccugggaguucuaaaguccagaacagauuacagugagcaucuccugggggauuuagagacaucaaagaaggcuguguccgugguugauaaugggccucccagcugacuugccagggcugggccuuagacagcccuguccaaugauuugucaaugaauaaacuguucccaaacaggcuaugcaguucagugggaaagcacagguaugggacacggagagccccagguggacuacuugaccucucugagccuuaauuuuaucaccugugaauugggaauaacugcuuauuucauaauauuauuaugaggauuuaaugaaaucaugugggcaaggaauuauuuagaauuagauucaacucaagugaugacaaccccaaacuaacagcagauaaaacaagacacaacuuguuucucacucaucuaaaagucuacguggguggugcacgauguucuauucucuuucuccuccacacuaaacaggccucagccucaucagccaauaaggcaggagcugccuuccaggcagcggaauggaagaaggaugaagcaaaacagagggcagagugugcacaugugcuauguuuagggaagguuuucugaaguucccacauaguacuuccacuuacaaacccaacaaaaaaggcuauggcuaaggcagcagggaggagcaaauaaugggagcaacuagauuuugccacagcaccuaucacagucugguuuauaaaugguucuaggccaagaacacccgaucccugcucuuuuuuauauucuaaagcauguaucuuuauauuucucaagcaauauuuucucucuuugaaucacagcucaucugcugcaucauagggaucccaaaagaaggacccaaggaacuugucucaguccucugugccccaagaggaagcuuugcuuguuugcuuugcugucaaugcugagggcuccuguggcugccuccacucaaaacccuccagcaucaggacgucaaggcugugauacuguacccugagcucuuggccagggcgagggaggggaggccaagccuaccuacaugguguuucauuuccuaaacgaacccuuacuuccacgcggucuguccagcuuagaaacuuauuuucaguaguguugguccuuggucccuggacaaaauguaacagccaaaguccuagaaaaaggcaagccaguuccugccauuuucuuucacuucugcauuuccucacuauuauacgugccuuccauuggagcaaaacugaaugccacgcauaugcacaggagcugugcgcgcucugucucucucacucacucuuuuucucucucucucuuucucucucaaucucucugucucuaucuaucucuuacucuuuaucucucacucucucacucuuucucacucuuucucucaaucucuuucucauucucucucuaucuuucucucucucucucuuucucacacacacacacucacaaacccacacucuuauucacaucugcucacccuagccacucaaacacaaucccucauucagccuggaauaaguccagagggcgugggccugauucagagacaaucaguuguucucaucugggaaauggggcaauguggucaucucuagggacccucccugcucuaacauucuuugaaugugguggguccugagguggaagcacucugucccugacuucuaguauauguggagauaggguuacacaaauauuuuauugggcagaacuuuuauaaaacaauuuaucauaagcuaucgcagccagcagcaauuuuuccaaccuggauuccaccaggggagcuuggccggugucugagugccacuuucagcuugagaagcaggugacucagugaaaagagcaaggaggagacagaggcagauucaguuccuaggcccugggccacccaccugcaaguuugcagcccagucagugcaagucagcuaacuguucugaaccucaguuucucugucuguaaauuaagcuaaaaauucuucuuucaaagagugucaggaugaagugagaucguguauguagggcauuuaacauagugcccgacacacagggagcauucgguaggugccagcucuccuccuggcaggagagagagaaacaaggugaaaagagugaauuaaagaagaggaaagucaaaugggaaaacagggggaggagauagaaaguguaugaaaaggaaagaauggugcgcaauaacggcgguguaaugccaccaaaauccccucaacuacuucugggcagcacccuugacagagugaaugcuuuuaugagaauguaagcggaauguguucccagauuugcaguaauauugccaccugguggacaaacccaugcaccuuugaauuuuccaaaauauuucgaugaacuagcuuccaguccuagauguauuuugaaagugauuuguaaauuguaaggaacuauucaaauucuuucauuaaugucacaaaucaacugugucaucuguaugccacccacuauucugggugcuggggacacaacagcucacaaaucaggcaaagucccugcucucaccaaaaugauauccuacgggggauuacagauacaaauacguaaacagauccaucgggaggaaacucucagauggaaaugagagcuaugaagauaacacaacaguacaugacaauacagagugacuggaaccaggaacauuucuccgaggaauaaaauuugaagcgagccaugagagggucuacagguagaguucccaggcagagugaacagccaagcacaaagcugcaccaggagagagaggugcucgccgagagacagggaggggaguguggcaggugagcucagagaggggcagggccacacacaucggccacaugggccuugguagugagucgagauuugaucccaggguuuauuggaguggauaaguaagcaaggugacugaggugcucggguuuacauuuuuauaguucaagcuggcugcuggguggaaaacggaaguuggcagaccaaggacagaaucaggcagacccauguggaaguuucucuaguggucuaggugguggcuuggguagcguggcaguauuggagcuggagaaacgcagauggauuggagauuuguuuuggagugacgccauucugucuugucaauggauuggcgaaaaaagaggcaucaaagaugaguuacacaucauugaagugagaacuagggagaugccaguacuuuauuuaguauuuucucagcagcucaauccauaaauaauuuuuggaagacaacaagcaguuucacaaacuacuuauaaguccucaaguuccaagguaauuaacgugggugucucauugccucagagaacacagcgcagcacggaaauucuacaagaccugacggacaggaacaucuccgacuucuugguaaaaacguauccugcucuuauaagaagcagguaagaagaaauccuuuuaugcuuuuuauccuggcucccuguagaagauauuaacuagggacagaagauaauuuucucucucaauuuauguaugaucagggcaguagauuuuuuucuuuuuuaucugauuugagggccccauucaacauaaaaagcaauugaggcacauacaaguaaaauguaacuuaagauuaauucuuuuuuuguuguuuguuuguuuguuuuuacauuuagggcaagcagucuuaaauuuuaacccacguauuauuaaaaguuauaucagaagaccauagaaguuauucaaaaaugcagccacauauuuuaacuaguuaaaagagagaguaaaaauuuggagggagguggaggaguauaggggaaaagguagaagaaaaagagaaaauaaguaaguggcaaaaaagagaaaggaaaaagauagggugggaaagaggcagcgggacagugucugaguccagcacacgccagggcgagccaggucaacugcagcugucauauucuaacugugaauuaucaucuuugaucacugcccuuugagaugccaaugaacuuuucaagaaauaucuaguucucuuggcucuccagcuguucuuaucagccccauccaggauggaacagcuuuggcagcccguaucagaacaagcagcuugacaggggcaugccaugccaggagagaggauccuaaggaagcgugguccaguccgcacaggcucuggggcuuuaagauaaaaccuccugucuaacuuuaguaggacuuucuguugcuucaccugccagagcccugaacgagggauaaauugacuuaauuaacuagaacacacugcaaauggugaaagcauuuagcaaaacaaagaaugccauccaagccccaaaauaaaagcagaauaaauagaaugcaauaaacagcaaccaucccaaacugaguucucagcagcaaaucuccaguaugaaauuuuggauuuugugcgugugugcuuaaagguggaugacaaugacaguucaugggauugagcucugggguccagaguuggcaucuguucauuucccauuuugucauuuuacccuugauugacugaaugucagugccuuaacuuugggcuguggagugagucggaacucccccgaggugugcaggugguuguuagagucucauuuuugcaggguggaagacaggagggcugcagccuucauuccacacugacauggucauugccguguguucuggguccagaucaggcauauugaccugacauaugaccugacaacaggaccacucagaaaguccagcaugcgggauaugauuuggagagccagugggggaaaucauagguccuuucucugcauguguauucaggcaaugucccagggcugggcggcuuccgcauugcuuggauaucggaaaaugcaaaaaugccccugaagacugagacuucagucuucaaaaugaauguuugggaaagaaaguuaacggcacugcuguacuugugguauucauugcauuauuuuauuuuggcuuucagcuuaaagagcaaauucugggucaaugaacagagguaagaaacuauuuuuaucagaauuaaaaucucagauugauucauuguugaaauaauugcacacuuuuaaaaggcacaccucacagccaugaggaggggcuguucuguaggugcucaggaagucacaagacacguccugaagaauauguggcuagggacaucccagacucagaagacacucaguggugccucuucuuggaggacauaaguggggguggcauucccugauguggcguuucagagcauucucacccaaaaaaagcuucuaaaaccuccaaguauauaacaguuuauaauacuccaacaagagggccuuguagccuaaacccgggacacuccuuggcccauuccuuuuaagcuucagggagugugggccagccccagacucaccccauuccugaggcauccuggagguugaaauauuuccagagguuuagaaccucaccaagugggacucuaggagccugcugccucccagccucccucaggaacugcaccuccagaacaggugcggggcugacauguaugugcuuuccugggcagauucuagaccguacacaugaaaucuggcuuucaggauugcucuccagagggaccuguggggccucggcugagacagagaguaggagugaggcagugauucaaggcccugagaaagagcuccuccucugcuugguauaaccagcuaauucauucuguucuguugacuuuggcuucugcccugccuuugaaggguuugaggccagggagugaugcacucagacugguguuuccacacagucacuucagacuuccagggcaguacaggagauagaucccagggccagugaagaagcagagcacaaguccaggcaggagaggcuaagggccucccugaacaggugugaggcacagaagccccgagagguagggaugacaggaugaagauggguccugugcugcuagaaguaccugcaaagcacagagguggcacagaaaaggaguccuuggcugggaugggaggagaugacaugugacaugugaaagaggaccuggaguuggcucgaugcucccaaaagggaaaggugccgaggggagcuagcagccaugcaaaggcagagacaugcaggcagucugggccaugaggagcucuggaagugacucgauauguccagaauaggccacuccagggaagggcugaggaaggaugaaguuggagaggggcacagaccagaugcagaagggccucagaggccaggaugaggguuuggacuccuuccuggaggcagcagcagugggaaaagaguuaaaagcugguuuguaaaguggagccauguugcucgcugguccaggcaauucccccgaaaguucauguuucccuacaaaacccgagagagcuacuaguaggcgugaaguucguggcccuggucugaggauuuccuguuuccuugucagguauggaggaauuuccauuggaggaaagcucccagucguccccaucacgggggaagcacuuguuggguuuuuaagcgaccuuggccggaucaugaaugugagcgggguauguaaacagacuggagauuugaguaggauuuuugacuugcuuaacuaccaugaaugagaaacucucaugagugauaacaggaaaaaaaaauuaaaaccgucuuguuuguuuguuuacaugguuuuuagggcccuaucacuagagaggccucuaaagaaauaccugauuuccuuaaacaucuagaaacugaagacaacauuaagguacuugaccuauguauaaucugcucuggagcuaaaaauuuaccugagcugguuauuuuauuuuuacuuuccuaccuucauuaaauuccaucccuccuccugcugaaaucuagcaaggaaugucuuccagcuaccaaacccuuccugcuucucaaauuuccuuuccuucacugauuucugcuuuaacuagcuguuagugcagcgucucagauguccucuccacccucuaggugugguuuaauaacaaaggcuggcaugcccuggucagcuuucucaauguggcccacaacgccaucuuacgggccagccugccuaaggacaggagccccgaggaguauggaaucaccgucauuagccaaccccugaaccugaccaaggagcagcucucagagauuacaguguaagccaccacagccccagccucaccacuuucuugucaccuucuccacucuuugaacauccugagaggauucucaccaccgcgaagugcugauuuggaugguaaugcuguuuagucaggcacauaugaacauccgacuuucaaauaagugccucacacuucacauaccagaccucuuggucauucuuucuccccaacauuuauguggcaaguaaguuuacauuugguuccauucccuuuuggcuuuugauagcaaguugcuccuggagcuuauacaauuauuaucuuugcuaugugcaaagcagcugccaggaacuggcaaaguucaguaaaccuuucagcucccucggaguaauuaucuuagauuccaggaauuuccucagaagagcauacuuuggagaugucgacagagcuuugcuacccucaagcugaggcucuucuugcacaguuucagccaguggagacaguggccuugugcguuuuguaguauguucacucuauuugaggccuacauggaggagggguugguaggagcaccuuuguuagugcaaacuucagcaacguugugggguccugauuuuacuauccuagcacacgcugagugccagugaacaugcccagggucauccacuaaaaccugggccuuggcuccuuggugucuuccucuggacacccuagggcccuagacuguccucuguuaauucucacucagccacacuuucgugugucuccuuccagucauuuguucuaagcuuacuacguguauggaugauaugaucuguaguuuuaucaagguagugacuaccacauaggauaccuuuguggaaauuaguaaaaaugcucuuuucugcagguggacacugucccaugccagggguuauggcuuguacauaaaguucaggcuggcuuuagccccaacuuaccccucagccagaugccuucuauuuguccgaggaaagaauaaauagagccaagucccuguacaacuugccugcccucuuuucacuuaaauuuacaucaugaacauuuccuuguguuacgauguacuucuugaaaaugugauuuaacaagaugauuauuaacaaaagauaaaucucacagaccguaugucugucaacauagaaaauucaagagacucuauagacagauuauuagagcuaaugagagcauugcaguacauaagauuaauauaaacaucuauuucuauacaccauaaaaauaauuagagaauauaauaaaaagaaagguugucuagaaauauucacaugaaauagaaaggcaacccgcaaauacccauuuaaccuugguccauauggauuaagacaguuuaguggagugacagcuucaagguagagaagaggaaccuggaggccacaccugggcggguguaaggccuucccaaagccugacuuuguaucuucuccuccuucugcucuucccucuucaucgcccucucccugugucucuggcccugcugcaggcugaccacuucaguggaugcugugguugccaucugcgugauuuucuccauguccuucgucccagccagcuuuguccuuuauuugauccaggagcgggugaacaaauccaagcaccuccaguuuaucaguggagugagccccaccaccuacugggugaccaacuuccucugggacaucguaagugucaguuuacagcgccucccuccccuccgugggcccaagguggagcuugugugugcucugaaggaccagaccaagaggggagggguucucacggugccagggcugcugaaaggcacugggccaagggccuuguguaucugcugucccuugacaucuucucagaaaggcacagaacuaggagcccgaagcuaggaaaggcuguggggugcagcuuaacaacuggugaacgggggcucucuauguccugcacugaggggucuucugacccaucaaauaaucacugcaccgcaggcaugagucuggccuuccuggcaucagucuggcgcugagaagguaauaugaaggggucuuucaccccaaguccccuucucaaauccugccccaccuucaaaaggguaaagguaaaacuuucccugugguagggucaccagauaaauacaggacacccaguuaaauuuaauuucagaugaugaauaauuuuuaguauaagcauaugcuacuucaaauauugcacaggacauaucuacacuaaaaaaaaaaaaaaaaaaaaaaaaaaccugguuguuuaucugaaacucaaauuucacuaggcauccuagauuuuuauuugccaaaucuggcaaccccagccaguggccaaaauaauaagaccuucacuuauuagauuaaccaccgcuacagggaaaaaugaagaaaaaauauuuauuaaaucaauagcacacuaccaccuuccugacaaccaagguugguggggguagggaggggucaggauagcguacccuauuacaggcugcagggucaaaggaauugguaguaaaggccuaguuauaauguaacagggaucauuaugacaucaaccccaauuuauucuaggugucuugaguaguaaaaucucaacauuuuaagaccaacaugagccuccauuucaugugaugauaagauauaccaacugauggagaccaacacaaaugaccuucucauccaugguuuuuuaaaaugauggugaauauuggaauuccugaagauaugauuucuaucuuacucagcuuaguaagcagcuaucacuuaacaauacaaaaccagagauuaucaguagcaacuaaauuauuuccucucucuucugucuacacgaggaaacacucauaaaugcacggggaggaggucagaaccugaaagccuuucuuuggauaagagcaucaacugcagguaccacauuggcccugugaugcuaauauaaaaggagcuaggcccaccgguaccgaaaaguuacuuagaaaagugcggaggcuuuuaauuuuacuuuuuuuaaaagauaagaaauagaauuuacacacuuggggcuggcccacguguuucuguguguguguaugugugcacgcacgcgcgugugcgcuuacagggaucucugagccuauggagagagauguagcuaggauagaguggacaucugaggugggaggugauacuagcuggcaguccaaugaagggguagaagaugguaggcaucauguuagcaggcuuucugaugcuccagaauuuuaaagcuggccuggaaucucaccuccgcgauccaucauuuuggaacuuaggaccaccauuagccaguggcaaaaaaaaaguugaaugaaggaacaaacaauuauugcuuauguaauucacuuagcacauauaugauguuuuaaauucuuauaugugucaucuauuuuucuuuacuuuaaaauuuugcaacaguuacagacuuauggaaaagucacaaguacaguugaaaccuuuuuuucuuagucauuugaaaguaacuucucagcaagaugccccuucucauuuauuucucucuuccugucucucucucucacaccccucagcacguccgauguauacuuccuacaaacgaggauacaccccauacaaccacaacacaaacugucaacaugaggaaaccagcacugaugugucaucaccaccuaauccucacaccccacuccucuuucgcccauugccccagugaugucuuucagaaaaaaggaucuagcucagaaucaugcaugacauuugauugugcuguuucuuuagucucguucagccuggaagaguuccacagucuuuuguuaacacucauggucuugacacuuugaggacugcaggcugguuauuuugcagaaugucccuuggucugagcuugucugagguuuccucuugcccagguugagggugugcaucuuggcagcaguaucagcaaacagaugcuguguucucacugcauccuaucagguggcuucugauuucaauuugcucuguuacugaugauguucaauucggucacuuaagaaggugucugcugagcuucuucacuguaaaauuacucuuuuccccuuuauaauaaauacaaauuucagguagaggcacuucaaagauauauaaauauccuauucauuauacaauuuuccauuuauucauccauuuauuuaucucuguaugcagucaugguucauguguuaaucaauggacuaugauccaagacuaucauuauuuauuuugauauucacauuauccccacuguggucaguggggggccguugaagcuggcuucuguaucgucuugacuuggguccucaugccccuggaccuccuccaugcucaauggcacagcaagauauuccaggcucauccuuccauuauccccauuccuacccucuccccaagaagcccugguuccugccagugggaaguggcccucagaagccaaggucugagugcuagauauguucauugccucuggagcaccauuggucccaggccuucucagugauagaacuagggaagauauggauguacacacacagguaugcacacaccucuaucuauaguucucuaucuaccuauacagugaacacuaugagcucuccaaaaccaacuccacagggcucauucuaguuuuuuuucuuuccacaucuguaacucccuucuccaacagugagacgcuggcuucucucacucccaacucauuuaucuaccggaccuauacaccugaacagugcccaacucugccaccauccccuccccauguggaugccguccucucccugcuccagcugccucugcugcaugcagguccuccucguucugcucuggcucugauacccugcaccagaucagccuccuguaaggauaucuuucucaucccguugaggccuccacaccccacggcagguugcccccugaggaagcccgucucugguucuugcccugcuccugaucaccauggcuccuccccuaaccccacuguugccguccccuuucugugcccaguauaguggcuguaggacuaaauuguuuaaaaaggguaucauuauuuauuugagcuuugugaagccaagaacuaggcuuuaaguuuuucugaauucugaagacaugcuuagaaagaagaaucaacaaaacuuuaugaccaaauagaaagagugagagaccaggcagaauuuuguaauugauccuuucaaaagauacaaacuaaagguucccuuggcagggagguagggcauggggugggguaggaggacuagugacagcuuaacauauguuugccaaccaagaacuguuuaaaaagcaagucgaaucagaaucccagacccuacgagcuggaggagccuggccccaccccucauuuugcagagcuggcagcaggucugagagguuaagugacuugcucuccucuucucuuuccgagaugaauuauuccgugagugcugggcugguggugggcaucuucaucggguuucagaagaaagccuacacuucuccagaaaaccuuccugcccuuguggcacugcuccugcuguauggguaagccguuugggccauuagcuaaugccucugaagagaagccugguggugggggugggggaucaucuccugacagaaaaccugggcuguccuguggugguagcacccacaaguuuagcuuccggccccagguagggucugaagcugauaaccagggaucugucuggcuucugauucugacuccacugacagagguaucucugaggccugguccugucagugacaaugagagaagucccacaugaucugaaucuccuacucaaacugaggccuugaccaaagccugggggcagccauuccccaaccccucacccagcucugacucucacucaucuguggccaaucuguccaccucaguguccccaugugaacuggccaagaguuaccgcccacaguagaagacuccggccaaaaagcuccuccugagucagggacagaggaugacacagggguuacaucagcagaguuacagggcccagcaugcaacuuucuuucccacguguguaaauuugaaugaguaauucauccaucucggccucaguuuccucaucuguaaaagaaaauagugauccugguccuuccucugugggccaguagagccuugccaaagcauuguucuccacaucuuucucuuggaaauagagaauuugggaaccaaccugacuauaagcugugaagaugagcucacugggcucaucugagaugaccucagcugggcuuugcugacccaggcuagagugggagguguugcaggcuggagaacccuccuaugaauuguacagggcuuuguaguuuacagaguauauacacagcuagcagcccauuugcuccucacaaaaccccaugaaguggucaaggcaggcaucauuaucuccauuuaaaguugaggcacagagaccaacaaauggaguaucucucugguccccugggacucuggccaguucacacacaucaccucagguguaaggggagugcauuauauccagacguauuguagguggaauggaauguggaacuccaucacucugaguugucucauuucacacagaugggcggucauucccaugauguacccagcauccuuccuguuugauguccccagcacagccuauguggcuuuaucuugugcuaaucuguucaucggcaucaacagcagugcuauuaccuucaucuuggaauuauuugagaauaaccgggugagcauaacuuucuuggcuuuuuuguuugauuaguaggauaguagaguauguguuggucgagcagagccaggggcaagcaucguacauguagcagcuguaugcggaugagugccacuuucuuccucccuacccccgacccugccuccuuuccuuccuuccuuccucccauccuuccuuccucuuuccuucuucuccucccuccucccuccuucccccgucccuccuuccuuccuuuuucauugcuuccuuccuuccuucgucccuccuucccuuccucuuuccuucugcccucucucccuuuuuccuuucauccucccuccaucccucccuccauccuuccuucuuucuuccuucuuuccuuccuauaagcaccuuuuucauuucugugcucugaaugaaaugguuuucuguguuuauucugcaagcaaaacuugauucuugcaauaaacuuuaagcuuugcuuacucuuucagaaagguuuucucagggacuuuggguguuggguuuuacacacacacacaucaauacauuuggguaauuucaaaaucuaaaaggaacaaaaaggcauacaaugaaaaaaucuccuuccuaccccuguuucccacucaugcaguucucuucuccagaggcaaacucuuacuugaguuuccugugugcucuggagacacaucagcagaucccuauacggucuuucucccgcuuucuuauggaaauuguaacacucugacauauacuauuccuugggcaaguuaaucuugaugaagagacuggguguucuccaugcugaaugccucacuuuuaugagcugccaagcccaguugucccuuccaccugaccucccccuguccagagacagauggccaaacugaaucauaaaaagagggggaaaaaaagaaggcagucgcugcagggcugucuuuacuccacacuccacacucccaguccccaccgcugugucugaguccuggcuguggcuguccuuggaacauuugccucaccacgugccuguguccccaggcgccucaaccuuuccucuccucauuagcucuucccaguucagagggugggaccggccagcacaucugcacugcugcccugccacacccaccuccaccugccucugggccccacuggggaacacaggacaaaucugugcggaggccccaccaugaaccgcccagacccguggaccccugagacugacucuuuccagaucuuguuaggguuucguggcugcuaggcaaguaacgaagccucaucugucccaugaaugauaagaaauucagcaugucagagucagacucuggaaaggcggggggauaagaacacagccccagcagauggccagagcacccaggugacugaaagugcugcuuugcagagcuguguuugccacaggcucacagcccacuaagucuuaagacaguuuuccuucagaauaauuaaauagccagcuuaaagcaacucagaacauuuuccccucugaggcugcacccauuuagccaacauuugcuaagcacccgccuucaaaaaccugguauuuucauguaaauuauccgauacacagcugcuauggaaacccccaguaucccacaggaagcuccccagcucccagcagcugccggcccgugugagaucaggaggucuuuaccagcugaacaccacgugccgggugugugcugauauaaacaagcguggcccacucguccugcccuccagaggcucccguuccagucggaaaaggaccugcccacgaaguuugcaacgauauaagccacaguguaugauccuccauaauacagcgugugacagagcagcagaggagcgaggcagauaacaugcugcaggccagaggcagcgggaagagccaggcugcaggggcugggggagccgugguggaggaaguucaauuucagccuguagauuucuauuagcccauuuaauaaauaaugaagugccuacucugagcuaaucauugugcagguauuuaggaaggacaaaaaaauaauuaggacucagugcccacccuccaggggcccacugacuaguagagaaaguaggcagauuuuuaaaaaauuaaucaugggaaugugauaagugcugggagagaggaauggauacuuucucaugggaaucuuggaaggcuuguaagggaaggcacucucugagccagcugucuaaagaagaacaggaaucuuuaagaaagcagaagggaaaagagcauucuuuccugcuuggagcaauagguaacagccugcacaugcccaggccuagaggccaaagagcacagugauuccagaaagaguggggagaaaggguaggcagggaaggaugagguaaugugggcgcagguguggaggcuggagagggaggagguugugggacugggaggagccagauggaauggacagcaguggcccagccaggagcuaugcuggccucguacgccucgaugucccuucuauuuucucaggggaggcucugcccaacaugccaaguccgaccacuugaaaacaagucccuggcuuaacacagaccccagagagagucuccaacccuccucucccuagacaaugguaguugcccugugaggggcugaaaagcagagcuggagauggcucagggccugguguuaacaaaugccuugagggcuccuguuguuucaaagugagucugcagggagagcucccuaaguggacagcaggagggcugcagcuucucugcacauuccugcugucacccccagagucaccuaggggagggguaaggacaguaaugcagguuccucacaguuagccucggugcccacaugguacugagcauaguaaauguuuagaagaugcugccuggcuagacaaaggggaagcucccgcccacuagaaacuugcagggagccccaguccuugauuggucauuuaauugauuagcuccuuggccuggccuugaggcacugcuuguaaguacuucaugaccuccauugcaaacccaugaugcucugcuggacaaaucccuccaguggccagucuggcugcaaggacucucugucugcaggccuugcccugugcuguccugugagagcaucugggccccaccugcugaagagagggggggugggguuugccccguuuccaacaguccuacuucucuguuucagacgcugcucagguucaacgccgugcugaggaagcugcucauugucuucccccacuucugccugggccggggccucauugaccuugcacugagccaggcugugacagaugucuaugcccgguuuggugggugguagccgaggcccauggagcaugggcccuggguccaaagcugggaggguuaccgggggggcuccugcaucagacuguggcaggggcuggugcuaggaggggaccuuguugggcuggagguguccugccagcuggagaggauuagggugccucuguuuccauggcuggggagccacaggagggauggagggcagcccuuaugaggcggguguuuggcucuugcucaguucccacauaaggccuggucuagugggcccugugcuguggccaggucuguggggugagcuggggcggcugaaguggacucaauuccuguugaugcccaggugaggagcacucugcaaauccguuccacugggaccugauugggaagaaccuguuugccauggugguggaaggggugguguacuuccuccugacccugcugguccagcgccacuucuuccucucccaaugguacguccaugccacacccugggccagugggcagcucagggcauccagaacuggaccuuauacccacauggucauuucuuuccucaggagccccacuccacaauguuuuuucuacauucucaaagccuggcuuuucuccaauaauacaaguagaggaucggguuaaaauaggcacauucaaauaugugaagagcauccacuuuaaaauauuuaaaaugcagugcuauuaauuucaauugcugauauuuaauccuucucauuuaauuaccaaauguguauuuugauuagaugauaguauugcaaauaacaaugguuacaggguauccaaaguacuaggaaauagacuaauguauuuaugagagaaaggacacagcaggccccuuugcuaauuagagauuugggagcaugggaguaauaugggagccauguggaggggugcgggcagugaucacgaccccccacuccuggaggaagguggguagcugccaacccugacuuuugaccagggcuucucaaaugccagguuagcuggcaauugccauucuuccgcaggcucuuccugaagcugggugggccccugccucacuccccucugcaauccaguccuaccuuuauuguccucacccaggggccugaauugccaagcagcagcccuuccuagcaagcuuuccccaauaguguuuuguuucuuaacuuuuccuccucucaggcugaguguggucaccuguaaauagauuccaaggacuugguuuuauguuuugauccacagggaauugauuuauuggaaaugaaucugccuuucuacucacaggacugugagaggugaaugagaucacaggugucaacacacgccugaugaaacaggauacacaagcaguucuaguuaugggagacagugucaggaauuguuguccuuggcacccucagccccugcagacccuuucugcagccuuggccauaccuuuuagaggcuuuugugugggagagagcaggucaggagguugacuacccaaauugacucauuagcuucaaacucugaugucaacacauuugaaugaguccugccugcuuuagggccuaaagaggaccagagaaguacaccauagucccuggcuuccagaaggucagggaggguuucaaagaagaggcugugucuuuaagaauggggaagauuccauuugguggggcaggaggaggagaacauugagggacuggaaacacaugcggaggcugggagacgggaaugaccaauaggacugggaaccagggggagaugccaauugcugacagaggaguuagugcaagagguaagugagaaggguagguggggcuggauugcagggcuguaacuacagcugcagagggagggcuucaaccuacagcugauggggaacaacagaagguuuugaggcaugagguggccugaugacaacucuguuuuggaaagguggaguuggcagggcagacuggaggaagugggaggcucggagguuaguaacuaccccuuacugagugcuugcuguagaggaagcauuuuaguccugacggugaucccaggcccugagucuuuacucugugccaggcacugugcugaguucaucuucagcacaauccuaugagacagguauuguuacccuccuccucaucacaugguugaaguaggcaagguucagagagguccaaugcccaagaucacacaugaggaggccaggacuggaacccaaggcugacucuggacaugagcaccugaccucucuaccuaaugccuaaugccucuccugcugggagcccuuuuuagaauuuaagucuuaaaggauggaagcccagaaggaagcagaagcaaggaaguggaagagaggucccauggaaaggacagugccaaggacacuguacagccagcccaauccugaccccuuuucuucaucuaggauugccgagcccacuaaggagcccauuguugaugaagaugaugauguggcugaagaaagacaaagaauuauuacugguggaaauaaaacugacaucuuaaggcuacaugaacuaaccaagguaagggaauggguaugaguuuggaggugcugguuagauccacaguuggcaugauguugccauuuuccuucuauagaacaauugauaugcuuaugcaagcaauuugguucccaguuuuauguagggucaucaucccuguguuauaacucgucuuccaagagcaucuaauuccaauguguguucccugcuauucaucucgggcacugacacagggccucagugagaaucacuccagcugagcaucauucccuuuucuguguucuguuucugcagagcaugggucagccucgagaugucucaguacucaccacaccucugugccugcccaugucaauauguaaccuccuagugcugguaguuuucuccuaaaccauccuuugcucuuuguucccucuuccccuccuugcucucacccugucucaguucucaguccgguuucuucguaucuugcagauuuauccaggcaccuccagcccagcaguggacaggcugugugucggaguucgcccuggagagguggguacucugcagaccacgugugaaaggcuuccgaacaucagcucuugugccugccucuccuccccauaaggcagagcuauucaauaggaacauaaugccauaaugcaagucacauauguaauuuuaaaucuuccacuagccacaugagaaaaguaaaaagaaaauagguaaaauuaauuucauuaguauuuuuuauuuuacucaauauaaccaaaauauuauuucaaaauguaauuaauagaaaaccuuauuaaugaaauauuugacaauuucucguuguuuuuaagucuuugaaucuuuacacucagggcccgugucaacugggacuuagauguguuucaagugcuuaguagccacauauggcucguggccucugauggcagcccaggucuaaaauuccucccccagcucacacacacacuuacccuggggccugacauuuuagaccuucuugaucucuagggccaggcuagcucuguguuuucuccuagugcuuuggccuccugggagugaauggugccggcaaaacaaccacauucaagaugcucacuggggacaccacagugaccucaggggaugccaccguagcaggcaagaggugaguauccugcuccuccugucucagggagucucucacagguccugugagaagaauaggaagggugaucaucagacccuauaguaggguggcucugaggcccugaaagaucuguacagagaaggaggccucccagagagcauggcccaaaaagcccaacacauagacccaauggaaaagugaacugaauugugauaguuaagagauuccucuguugggauggauucuuggaaagaccugggaagcacuaagugugugguucuuaaucucuuagaggucacggaaccuuuuaagcaucugaugaauauuuguagccuauuccuauaaaaaugcaccauugcuucccauuaccucccuccacacauuuuuacaaaacguuucagggaguuuacugagccccaggucacauuuaugauccugcaggagcucuugaaucccagguuaagaaccccugugaugaaugaagaauccuuccucuggguugaguuucuagauaggggcucaugcaugggccuuugggguagccuaaccugcauuggcuauuuguaggcugauauuuggcuuugccagaccaaggagcauagagggaaaacuggcgugugcccuuggauucuggagggugacugcugcucucuguaauaaaauguguuuaaacagacugguccccuaugggcaggacagagaggaugagcucucacucaucugccucuuuccuggcugcaggaaaagcuugaacaguaaaacuucagcacacacaauagaggugcccagaggaagccucugcccugguuuauaaguggaguuaggugcugcugacaucuguccagcaucugcuugacuggggccucuuccucucuccugaaagccauccucagcauggcccaaugcccagugggcaggacgaguccugagcacgcuucacuggcucagacaggaugaauuugauucuuuggccuccauagccagcccuacuggguuuacagaaaagggacaggcaggggugaagccaggucauggcugaguccaucucaacagauccagcuucaccugcaagugaccacgcaggugacuuccucauggugacaaaaggagucauggcaggguagagauaucauaccauggcaggggaaagauaucauagaauuuuccaugagcacauuuaugagacaucaaguuacaacuguguccaagugaggcacagucugacauccagaagguaaaacugagcuggacgcuagaaagaaacuauaggcuuaagacacagaauugggauuauaugguaggguagcucccacuaauuuggaaacguacccuacuugcuucccugaguaguuuuaauuggcccagccaugccuuugguggcuuuugucauuguggggaacuguaauggucucucuguaccauccuauaucauccauccuuuauucauagacccuaagcuauaagaagaaaaggaugagauuagacuaaaugucuauguauaguuuauuuuccaucuuggcaauauauuuuuuagugggggugaauauauuagccaaagggaguugguggaacccaacucacucuaccccugcucccugcaggccucucgcuguggguaguuaucugacuggcuccucuuucauugcuaucuuugccaauaaauacagauagagaaguuuacuuccaucgggacacaugcaucuuuucuaguuacuucccaaaugucugaaaauuauugauaaaucaugaaucauuuucuuaaaccugaucuucccucuguuuuuaaacucacaugugaggugaucugauccaaaaugaaagcugacuuuuggcguaacagggauucaauuaauccuagacauggaaacauggaagaaucugacaggauucaguuucuaaccgaagggccccuguuuugauucccaaauaucccaugcauuucugaagccaaauaggagaagagaagaagcagcuuccuuuucccguuggcagaagcuucuccagcccuagcucuauggucaucccuccacuccuugaaggauacucaguaauugcuuuuuuucuugcaguauuuuaaccaauauuucugaaguccaucaaaauaugggcuacuguccucaguuugaugcaauugaugagcugcucacaggacgagaacaucuuuaccuuuaugcccggcuucgagguguaccagcagaagaaaucgaaaaggugaaaaauguuuuguuguggccacauaggagucugguuaauuacaagccuguuucaugagagugcauucucuuggagaugagaaacugaagcgugcuauucauucauucauuccaacaaauguuuacuaugugucuacugugugccaaguacuguucuagaaaccaggaguauagcagugaacaagacagacaaaaaaaaauccccacucucauaucuaacaaaauguuguaugcauuuauccucugacucagcaaucacacgucuaagaguuuauccugaagaugcaucucccacagugcaaaaugaauauguauaaggugauccauugcauuuguaauugcaaaaugcuggaaguuaccuaaauguuuagucauuguagauuggcugaauaauuuaugguacagacacacaauaaagucuuacgcaacuauaaaaaagaagaagaaaagucucaguaaacugauauggagauauuuccaguaaauacuguuaaaugauaaaaagcaaaguggaaaacagaacauagagaacgcuacuuuguauguaagaaagaaggaaaaacaagaaaguaaacguaugucugcuuaccuuugcaaauagaacguagaaaggauaaaccagaaaacaaugaauuuggugaucaacaagaagaaaaugggaagaaagaaaaaugggaggaaacaguacuucuggggauauauuuuuguauaguuuuaauuuuuggaagcauguuaauguuccacauauucaaaaaaaaucaguaagaaugggaaguaggcaaaaaugaaaacaaaaagaaaaccuaacacugacagcaaacuaaauaaaguaacccaauuuuauuucaaauaaauaucauaaucuugcaaaagggggauagagcuaacacaaacaacugcugaacacaguguuugacucuauauccucauucuugggcaggguggagcgggggagaagaacuacaaauaauuucugaguucuuuuuaguuuguuuuuuauagugguauaggcaaagugauucugaaaauuuuagauguguuacaggauuaaauaaauuaauaaauguuuugauguuauugggacccagaauucucaccguggaagaagggacuuacaaauauggaaaagggaaaagcaagaaagaacugugaggucauggauaggaaccggagguagcacugggaauucaggaauauuuauaugcuuguguuugugggugcaugcagauguguucauguuucaugcacauaggcauguauauauagacauauauuugcauguguguaucugucuuccgaaaggcucaagaagcaaaaacaccccaguagccaugagcacacuuagcacucaggcuuuugucuuaauaacauuccccacuaaaaguaacccugauuccuccaauaaaugauaaguuccagggcuggaauggcauagguauaaaaugaaccuggaauaucuuaugccagaaaguaaggaagugcuuuuaaaaaaaaaauaaggggcugggcaugguggcucacaccuguaaucgcagcacuuugggaggccaagguaggaagaucgcuugagcccaggaguuccagauuagccugugcaacauagggagacccugucucuacaaaaaauuagcaaacaaauuagcugggccugguggugcacgccuauagucccagcuacucagguggcugaggugggaggaaugcuugagcccaggagguugaggcugcagugagcugugaucaagccacugcucuccagccugggaaacagagcaagacucugucucuuaaaauaauaauaauauaauuuuaaagaaauaaaaguaacucuguacagauugcuuauugguuacaugggagaaacauaauaauuuuacaauggagaaauuagacagcaccuuaacugggugaucaaaauuaaccauaaggggcagauggacaucucaugccccgagaugugauacccugugaaggacacaauuucacuuauguagaauccagauuggagauauguaaccugaaucuuaucaugaggaaacaucugacaagcuccaaagaaggaauauuccuuaaaaaaaaaaaaaggagacuguauucuucaaaaacauaagagucauaaaagacaaagaaagagcuauggaaauaucucugaucgcaggaggcuaaacaggcauaaugacugaauagcagacaauagacuacaucuugugcagaagagaaaaaaaaugauagaaggauauuauuggaccaacugacaaaacugaacuaugaacaguagauuagguaaauguaucauaacauuaaguuuacugacauugauaauguacugugguuauguaagagaagaucucuauucuuaggaaauaugcccugaaguauuuaggagugaagggcugugaugaguaauuuacccucaaaugggucacaaaaaauugugugugagagagagaaggguuuuauuaguuaauaauucuaugaacuauuuuuauuccuauauguuugugugaguuugaaacuauuuccaaauaaaaaguuaaaaauggagauuacauucuagugggagggauagacgaucuguagauaaauagguaaaauauccaguacauuagagagugaaaaguccucagggaaaaguaacgcagggaggaacugcuggggcaggguuugcauuuugagguaggguggcccagggagagccugcagaggagagaaccugaaugaagaacuagaggugagagaaggagccacgugcacaccuagggaggaacauuccaggcacgggggacuaguauagaaggcagaagcauggugagcuugucuccaguggcuucccuagauccccuccugcgcaugugcacacacaccuggugucucugucaucguucccucacagcacugucacgaucugccaguauucuguuuauuuugacugccaccuccccgcagucugaggauagcagcaauggcuguguucacauuguucuccagugccugguucagugccuggcguauggucagugcuccauagguaugugucggaugcacaaggcuuuggguguaacccucuugacgggugggaucaacaggucugggacucaccaucuucucaaacagagccuuccuccuccacugcuagccaugguccaggacgcugggcgagacccacugucuugcucuuuguaaggcugaaguccauuucccaggcggcuacacccaacagaugcugagcaggcugggccacccugggauccaagacacagagagaaagagccccugucuggcgccugaagcacaugccagaggacaggagccagcaggagccuguuucagccuagcuggggauuucauucuggaggcgugagaucugggagcccaaggcuuugaacugggggagguuugggguguuugcuugucuucuccaaauggcauuucuuucucuucccuagguugcaaacuggaguauuaagagccugggccugacugucuacgccgacugccuggcuggcacguacagugggggcaacaagcggaaacucuccacagccaucgcacucauuggcugcccaccgcuggugcugcugguaacugcgggcuugggccgcaccaagggcuuaaaccaagugcugggucucuuggguuggggaaauagguucugggucggcagauuuagaaacugcagcaguuuggcuuuagucuggacuguuuccuguguugcucauuuugagcgaucagcccaguguuugguucacacagcuccggagaaaaacaagucacggcacagccuugacuugggacugcgcacauccugcguucccaggaugucuccuguggggccaucggcucacagccgggaaguucagcccacucugcggccugucggugucugguccccauacaggagcacugagcugggucaaaggcuccugagcugagccaggccaggccugaggccaugcccacgcagcccaaggaucaugagggcacaggacauagcgggaaccaaggaagugaccugagugaccucccugccuucugacaaauguauuugcaggauuuucuuuuuuugaggagaauucugucauugccuuaauccacuuuaauccccucgugggcugaaaugggcccaggauggacgccacgcuucuuuacucuuggauccaccuccugccuucccuacccuacaccaggguaccccugucuugcucaagugaggggagugacugugugcgccuucugucagcucauccuccacaggggagccagcccagggggaagcaguaaucagaagggccagcucccagccugugcccccaaccuucucuccaccccccaggaugagcccaccacagggauggacccccaggcacgccgcaugcuguggaacgucaucgugagcaucaucagagaagggagggcugugguccucacaucccacaggcaagagauucccagggcuggggaaggugggugggaauccucuccugcucaccuccucucuccugccccacagcauggaagaaugugaggcacuguguacccggcuggccaucaugguaaagggcgccuuucgauguaugggcaccauucagcaucucaaguccaaguaagcagaugguggggcgugccccuuguugccuucuguggauccaccuggauccuguguucuccauugacacuuggaagaguccugcugcuccgucauccccuggggcagaggcaggugguggcugggccucauucuccagcagcagauggagaaggccaucaugcugauaagaaacuccucuauauuggccuaauuuccuguggucgaagacucgcccaagucucuggauggggcaucugaucaggaugcaugcagagccuggcugggaugagggagggcugcuaccacugccucaauauuucaccacuuaucucaacagauccgggaccuguggccuauuuacuaagaguccacuccaauguaggaaugguuaggagaccaacugacuugaggacccaucuuuguuuuuagaauauuguaugcuuuugaguuugaaaaaagaccauauguuauaugacaaaccaacaauggcaguaaucuugaauaggauuauccuuauccuguacccacacauuguaaacuauuguagauaauuccuuauuauuaagaguuugcaugccaaagcuaacaguuuaagauuaucagcauauugccgugcucauucacguucugauaugcuuuauaaccuagaaaagagcagaguuacaauuacucauuuauuuaacaaacacuuauuaagagcucagaauauaagucacuaagcugguuggugggaggaacagcacauaacccaccuuaucuaugcugaggugcauaauccugaugcacccacaggaggguguuacacagaagaugucauccuuucauaugugucagagcagauaaauaauugagagaaaggucuaauagauuagcugcuuguggcaaguggacguuugacccaugauuuauugagcaacuacaacuuggacacugcauagauaucuauagaaauagcagcaugucaggucaccagaccugugucagcaacuuccuguguccaacugcuggagaaagggaagucuccuauuccuuucccuccagcuccuuaauaucuccaugauagagggggugagaggggaguguucccuguguggagggauggugaguuuucuggagcugaaagguaaacagccuuucuccucugcaucuuacugcagaggagaacagcccuagacuguggaggaagcuuuggagucaguuaugacugacacaggauaccagggcauaggguacugacacccgcuagccgugcacacacucucugguggaccaucacucauccaagagaggguaaccagccauccugcugaaggagaaagaaagcaccaauggcccaagcccuagcagcuccauuguuucaggaagcuuccucagggaagugcugccuucccgagccuuugcucccaccuggcccaucagcccuuaccaccacucaguaugcacugguccacgugucuuuaugggcagucuugggauccccacacugggcuaaaacuaccuuugacggccaggugcaguggcuuacaccuguaauccuaucacuuugggaagcugaggcagguggaucacuugaggucaggaguucgagaccagccuggccaacacggugaaacccugucucuacuaaaaauacaaaaauuagaugggcauggugguaugcaccuguaaucccaccuacucgggaaacugaggcacaagaauugcuugaacucagaaggcagagguugcagugaaucgagaucacaccacugcacuccagccugggugaaacagcaagacucugucucaaaaaauaaaauaggcugggcgugguggcucaugccuguaaucccagcacuuugggaggccaaggcgggcggaucacuugaggucaggaguuuaagaccagccuggccaacauagugaaacccugucucuacuaaaaauacaaaaaaaaaaaaaaaaauuagccgagugugguggcaggugccuguaguuccagccucucaggagacugaggcaggagaauugcuugaacccaggaggcggagguugcagugagccaagaucaugccacuguacuccagccugggcaacggugagacugucucaaauaaaauaaaauaaaauaaaauaaaauaaaauaaaauaaaauaaauaaaauaaaauaaauaaaacuaccuuugacuucagcaaguacgauuaucccacauuaccaugcagacauuugaucucuaaaaacugguaucaaaugauuucuccagggacuaccaugguuuuucucuccuaguuuucaguauguacacaggucuaugguaugggccuuuaauccccaguauuucuuuuuuuguuguucuuguuuggguuuguuucuuguuuuucgguuuuuuugagacagggucucacucugucacccaggcuggagugcaguggcaugaucauggcucacuguagccuugaccuccuaugcucaagugauccucccgccucagccucccaaguagcugggaccacaggcaugugccaccaugcccugcuaauuuucguagagacagggucuuucuuguugcccaggcuuaucuuacauuccugagcucaagugauccucccaccucuaccucccaaauugcugggauuucaggugugagccaccaagcugagcuuaauccccaaaauuucugaugagucuacuccuuauuuugggauuaccuuaggcccaaccacuaacagaggccuguccugcacugugugcauccccuagauuuggagauggcuauaucgucacaaugaagaucaaauccccgaaggacgaccugcuuccugaccugaacccuguggagcaguucuuccaggggaacuucccaggcagugugcagagggagaggcacuacaacaugcuccaguuccaggucuccuccuccucccuggcgaggaucuuccagcuccuccucucccacaaggacagccugcucaucgaggaguacucagucacacagaccacacuggaccaggcaaguuggcccuggggcaccgagagcugagcaaagacugguccagaacacccaguguggguuggaauugccauaagagggaggcauaacauucccgauuuuuaacaaacucuugcccucuguuuauugggguaaaagcugauauaucagaaauuguuuucuaacaauauuuuuuagucaucaggaaacuucauugauucuuuuuuuuacauuuuccuucccugugaugcuaugguguguuauuucauucuugcucguuugugguggugguuuuuccuucaaaucagcuuuauugauguguaauuaacauacgaugaaacacagguucuuugggaggccaaggcaggaggaucacuugagcccaggaguuuaagacaggcccauguaacaaagugagacuuugucucuacagaaaaaaaaaaaaaaaaucagaaaauuagccaggcgugguggugcaugccuguggucccaucuacaugggagguugaggaaggaagauugcuggagcccaggaggucaaggcugcaaugagcuguguucauaccacugcacucuagucugggugacagagcaagccccugucucaaaaaagcaaaacaaaacaaaaacaccuauuuuaaauguacaguuuagugaguuuugauaaacgugcauuccaugugugguuuuuaaaaauguaaucacauuuuuuauugcgguaaaauauaauaacauaaaauugaccaugccaaccauguuuaagugcacagugcaguggcacuaaguacauuuacauuguugugcaaccguuaccaccauccccgauagaacucuuucaucuugcuucagugaaaaucugugcccauuaaacacuaacucaccacuuacugccccccucgcccuuggcaacuacuguucuacuuucugucucuaaggcucugacuacuauagauaccucauauaaguggaaucauacaguguuuguccuuuugugucuggcuuauuaugcgaggacuuagcauaauguccucaagguucauccguguuguaucaugugccagaauuuccuuccuuuuucaggccgaauaauauuccuuuguacguauaugugcuacauuuuguucauccaucuauucauucauugauagacauuuggguuguuucuggguuuuguguuuuuauauauguuuuuuuaaaaauaaacaucuuuagagacaguucaguaaagcaguggaaacagggaagucuccauuuaaccccugaggaucuggcucaccugcaccuucucaucagcauuaagcagagggaggcacgagcaggagccaccugcacacucaaugaggagcugaacagggaucaauuaccuuuuuuuuuaguuauuaggaugcugcuagcugagaaucugccuugccuugauuaccccaaugucuggugcccaagucccuugaguccuccagcaggaacuccuguggcaucacucaggagucuagucuaagaagcuagcucugaccagggcagugguggccaggcuucugugagugggccagccucccccggguaggacacaagccauaccagcagggcuguaugugaacuguggaaaauagagagcaaaguggguagguggguguagggugcuguuuuccuggaaauaucuaccuaaucucgcucuucucuuaccucuagguguuuguaaauuuugcuaaacagcagacugaaagucaugaccucccucugcacccucgagcugcuggagccagucgacaagcccagguaccccugcugcuuaugcaguccacagcuugaggcaguuccuuggcucagagcccagcugguucacugggcuugaguugcuccaaggcucagauaugccuccuacagagagccccacccacaccacggucccuaccaaguccccaccacauccucaucacauccuugcuaagucccugccacuguguguucugugcugaagaacuuuucauucaguaguuguagggguuccuauuguaaucaggaaaccaucuggauagcaugggagagcauuuuugaaaagaacuuucccauguuuuugcuuacagcaaaaaagcuuggauuuggggaauaaggagcagagaagguaauagagaauauuagaauguuuugggugcuugacaucuaugucuggacauguguuugaguuucaagggaagggacuuaacuggcacaucauuucagugucagacacauuugguuagaucaaggaauagcaucuguuguaggaagagggcucuuuguucuuuauaaaaauuacaagaagauggagaaagaagcaauaggagguaugucuccuggcuugugauaacucuuggaauaggugcuuguagguuccugcccuggcacagugccccauguaaggagcacaccacccaagaaggagagagcuagagcaaguacuggaggaggcaccagcaucccaaugccuuggcuuaagccugggauuguagagggaugaauuagccacucucuucugacuuaccuggagaguaaaucaaaucaaaucaagaagcaaggauaugcaaaaaccuuauuuccccauaaaguuuuuauucugcccaguuucuggauugcaagaaaaaccaaauacagcuaaugauugaaacacugcugucuaaagcagugcuugugaugaauuuuuucccuuccucuugaccagcagagaccuaauggcuacuuggcaaaacugacuuugucuucccaccccuuaccugccagagggcccagaaaugccuaaggcuccuuuaguuacagaaaguuugcuuuuacugagaucuuccagccacugauucccauuuauagaucuggugauugcuguugacaucaguugaaaauuauuuuuaaaaaccacuugcaguugcaaauccuuuuuauaacucuguaacucagaauauagaauuggguagcaaaauuguuucccagaauuaccaauggucuccccaccccugccuggcauguucccucuuaaaggacuaaucccaccacaucaccucugggccaggcagaacaucaggggugcugauguucugugaucuacagcaguuaauuccaaacuuuucucccuuauuggaugagaucauuuuucuauuguguuuuuuacauuuuuguucacaaagauuagaaaaccugcaacacacuuauuggcauauuuuucugauaauuuucauccaaaaccuaauucugacuuuacaacauacuaucuuuacaaagguuugcaaaaauucuuucauauagcauuguauaugucugucaugaaauaauaguaaguauauuauuguuuacauuauaccacuucaaaauaauuuccuuuaaaguauucuucaaacaagaaaaaggcaauuucucucaagaaguuuuagagagaauuuacaacuugcuccuaagcaaaugugagaacuucaggagguucaucuggccauuggcuuuacaacuccaaauugugagccaggaccacacagauauuucucuagaaaucagcguuugcuuaccaagaacauuuuuacucuccaaaggacuccauccuggaaaacauguuuugggauaaggucuuaugcaaucuuauacucuguuauuaaaaccagugagggucaagguguuaauagauuaaguagugacagaugaucagacaacuuagaaacauccuaaauagguuaauaauuaugugaccaucgcaugugcauucccaaauuaggaacaacucagaucaauuucuaauccuuauucuuacacuguuccaguucccccauauaacucguaucuuuguguuaguuucagaaguuucugaaguacccucagccuugauggggauccucgcaccaccucaaauccuguucucagcccuaagaacuguguuagucauccucuuaagaggaugugugauuuuaaaucagauaaugggauaaaccacauuucgucuagacuggucaggccuuuguccaguccccuccucgcccacacuaccccagcuccacagcgggcauugguucaggaauucaacccacacuuuauaacuggagacaguaucucuccaguuaaaaaggucaccuugguguccgcuucucaaggaacauggacaucuuuauuaaucaaagcccaagcuuugaucuggagccuaauauccugcacuccagcucucaucucuccccucccccagucacacuuucaugcuucccagagccaccccuacaggaaguggucaagggaauucuauaccucagggcugaccuaaauuaggauuucuuggcuuuuaagauaaugguaacuuucuuaagcuaaaaaagccccaaaagacccuguaagagcccuuggaaacagcaccauggguguagcuuccccccaggauguaagcauguaugcacacaucucguaugugugucuuuguaacaaaugccuggaucuuaguaccagggagaccugauucauagauuucauagagaaggagagaaagauggcccauaaccugggugaucugacagaaucacagugcccucagcugagugcccuucagaaauugauugacaacuguuuagcuuuugaaaucuaaaaguaguacagcaucucagaaaaccaagaugacgcgaguccaugugaucuccuuccacaggacugaucuuucacaccgcucguuccugcagccagaaaggaacucugggcagcuggaggcgcaggagccugugcccauauggucauccaaauggacuggccagcguaaaugaccccacugcagcagaaaacaaacacacgaggagcaugcagcgaauucagaaagaggucuuucagaaggaaaccgaaacugacuugcucaccuggaacaccugauggugaaaccaaacaaauacaaaauccuucuccagaccccagaacuagaaaccccgggccaucccacuagcagcuuuggccuccauauugcucucauuucaagcagaucugcuuuucugcauguuugucugugugucugcguugugugugauuuucauggaaaaauaaaaugcaaaugcacucaucacaa

SEQ ID NO: 34814 - RNA, 21136 nt, Homo sapiens
uccuucuucauucugcaguuggugccagaacucuggauccugaacuggaagaaaaugucuauccaguaaguaucucugggagacuuuuuuaaaacaccuucauggauucaugauaaaugugcuauuucaagggcuccugaagagaaggcauugauuaaugaccuguuuaggaaagacccuugaauuuugguggggaaauuuuuuccugcuuauguauuaaagcaacuagcuagaauucagguccaaauuaugggggguuugugugacuuagcccgggguuuggaagcagucuugaguauggggauuucagacagacuugggcuccacuccuugcccagucauuuccuagugugugacuuuggacaaauuaccuaacuuuuuaagucuagcuuuuccuguauauagaaagaugucacaauagcuuuuacuccauuauguuacugugagauuuaaaagagauaauaccaugcaaaguucuuuuuaugguauguaggacauaguaauuguuuaguaaaagguaauuauuauaauugagucuggucagagauuccacucuuugaaguuacaacaugaaacugaacagaggauguagaaaguaaacaaaaauauagaaccugaaucuccuggucugacuaugaugaaaaaguacuguaggucuuggggauugguagagaaaugagaugauggggaaaaaauuaugguauaauaugagugaauaaugaaagaugagguaccugacccaaaaagcugucaucucucaaccccuaggaaggagauaaaugggucucuccuugaggcaagaaaaucaaugaugcugugagcugagcauguugauagggugggagaauacugugggaaggacccuguuuaggaacaaauuucaggaagugaacugauggcaguaggauugauugauuugucuuccgaaguaaggaaaaacugcagaggacaggauuaaguucacuguaaccauugacauuaaaagagaggucaugucucuugacaucagagcagugaucugggacccccuuccauaccugaguagucuuccccacccccagccucacgugcuccucccgcccucaccuucgcuucuccccccacccccacccccacccagcugagacuagaccggcaggagugaacaggcuuugagccagcccuagagugccuucucuccugcagcucugccucuaucucugcggacuuugagcaucaacaugggcuucuuccuuauucuuccaccauuucaggguugagcauccugcuggugguuacaagaaacuguuugaaacuguggaggaacuguccucgccgcucacagcucauguaacagguuggucucgcccaucuugaagccauccucuuuuaugucagucucucuucucuggcuuccuauuccuuggcgucucucagugcagacucccccugugggucacagggagagggaucaggugguuugggcuuuuuauagcaagaacccauuuucuuucauucgccuuuacuuuauuucucuaaugcagaaaaacgcuaccuaauuggaauucccuaaggaucaggauuacaccuuugucaucuucaaacugucagugccuagcucagugccuggcacauaguaaauguccuauaaaugucuguuccauuggugucugaauaaaugaaggcccagugacaagcaccugggaguauuaaagggugguggguuucaugcccauuuuauuagaggaauguugguucugcugggaggcagauguagaugcuaaccuagcucuaucauuucacugucugugaauccucuaaguuacuuaaacguucugagccucaauucccuuaccuacaaaaacccaaaauuuacgucaugaggauguugugaaaauuaaguggaguaauguaaauagaaugauucacccacuauccaacacaaagugaucaauagacaguaauuauuacuaucaguaucauuauuaguuauaggaaauaauccauuugcuugaaaaacuucacugguaggaaucaaggaagcacugucaaucacugcccuucucaaaggauaaaccuaccugggguuuuuuuuguuuguuuuuuuguuuguuuguuuguuuuguuuuuugagacagagucucgcucagucgcccaggcuggagugcagugggaugaucucagcucacugcaagcuccgccucauggguuuaugccauucuccugccucagccuuuccaaguagcugggacuacaggcgcccgccaucacgcccggcuaauuuuucguauuuuuaguagagacgggguuucgccguggucucgaucuccugaccucgugauccgcccgccuaggccucccaaagugcugggauuacaagcgcgagccaccgcgcccggcccuaccuggguuuuuagggacaaaccuaacugugaaagcugagaggccuuaaggacuaucuuggguaccccacauuuugcagaugagaacacugagguccagagaugacaugugagcugauccuaaaccagaagucaugucccugacauccaacccuguggacuuucugcuacagcagauugacuuucauccaagcaguagcucacacucacagagggauauagcucuagauuuuaaagagccaggauuccuguuuuuucauuuaaauagucuuuuuucuauagacacaucuuuuuaaaauacauuuauucucacucuuaauccauacuucuacuccucacuccacuaaaauauaucaagaaauuugaaaaucuucuuaaaaaugagauggcaaaaggcaaauggauugguguuuggggaaaucuauuagguggagagucccaauccucucaagaugcuucucccucacuccuuccaacccuuuauccacacucuggggcaucuccacauuucccaaggugugaucuccuagugaaggugagucaagucagcagacauuuucuaagugcuguccagcgcgagggcuggaaaugaaaaucacugccagcucuaugaggaagaagcugcccaaucaggcugcugauauacucugccuuaccaaggacaagccuagcccaaggcagggauaagaagcaauguucugucuccccuucaucacaggcaggaucccccucuggcucaccggcagucuccuucgaugugggccaggacucuuugaaguuggaucugagccauuuuaccaccuguuugaugggcaagcccuccugcacaaguuugacuuuaaagaaggacaugucacauaccacagaagguaaagcagcacuccaugccacuccuccuccucaaaguagggccuagcuuggcuccuccucccaugugaguuuucaccucugaacucaggaggcaaccuauauacccacuuucuucucacaauguaccugggccagugugucugcauggauacgagggaacauuaucauggaauaaaggagaagcuaaagccuagggcuuugggguccaacaugaguggcuuuaaacccuguauucaacagacaugacuugccuaggaggguaaccuuggcaagauguugaccuccaauucuugguuuuauaauuaguaaaaugggagaaauaauagaaucuaccuuauauauucauuacaagcauuaaaugagagcgcagugucuagcacacacaaagcacuucauaauaauagcuauugugaugcuuguuauuauuauuaaaccauuggccaucuugauuccuuuuucuuuuuauaaaauuggaaaggccacugggaaaggggucgggggcugccacaaaguagugaaggaugaaacaugucauagugcuaccagaaagagaaguuuucugaaaacaagagauuauugcuaaaaagccuugaagcccuaaaucaucauuccaggaaacccccauuaaugaaguauuaacaaauacuuugucuucugcuuucguguucaagccuauuaguggcuuuguugaucaccacagauuucaggcauuuugaaaagaccuguaaagaaaaagugaaaggggacuugaagcaggacaacuugcaugauaauagaagagaaacggaugaugucaagcagaaauguagccauaagagcuuacuguggaguucagauaaagcuuccuauaccuucgacagagcaggguacucuuucuucuucauaaaagugcgaccggguguggguggcucacaucuguaaucccagcacuuugggaggccaaggcggccagaucacuugaggucaggaguuugagaccagccuggcuagcauggugaaaccccgucucuacuaaaaauacagaaaaauuagccgggcguggugguacacgccuguagucccagcuaccugggaggcugaggcaagaguauagcuugaacccaggaggcggagguugcagugagccaagauugcgccacugcacuccagccugggcaacagagcaagacuccaucucaaauuaauuaauuaauuaauuaauuaaaaguacaaaaucagauuuuaacuggcucuccauaucagaaauccugggcaaaguaugcugucuacucuaagauaugguuuagcagaccugucuaggcaagagauggaauucaagaauacuuaauuuuuaaaacaaaauaaauguuaaaauugaagaaaaacauaaaaguaacagagggagauugagaagaauauaauucagcacaccauguccggaauuuucccaguaaguuuagguugauagguuauaggugauggggguggggguccuaugugaacuucccccagggcugcauggugugauauagaaaguucauguuguccugcucuggccaacuaggauucuaacccagcuuggccacauaugccaaucacuuaacuccucugaaccucaauuuccucaucugugagguuuaaaagauaaaaacguaaacucaagggacauugugucugcccugcuuggucaccccaagaaagugagcuaauaaaacccuuuauucuucauguugugcauuuaugauugugacuugaugaggacacauagaauggccauucuaagcuccacaugggcuguacggauugcuccugucuauacucuucccuauguuucaauguccuucagguucauccgcacugaugcuuacguacgggcaaugacugagaaaaggaucgucauaacagaauuuggcaccugugcuuucccagaucccugcaagaauauauuuuccagguuacugaacccaaacugaauguuacucaagacauuuuauauuagcccuuuuucucucauggcuugaaaauuacuggacugaaaaauucauuuguuucuacagguuuuuuucuuacuuucgaggaguagagguuacugacaaugcccuuguuaaugucuacccagugggggaagauuacuacgcuugcacagagaccaacuuuauuacaaagauuaauccagagaccuuggagacaauuaagcaggugggacacagugcuaggugauguucaggaauuuagaauuuggaacuuaaaauuaauucaacauaaauuauucaugcugcgaauguaugauucuaacuugaugaggacacacagaaugaccauuccaagcuccaaauggacugcacugauugccucugucuaugaugcuuuccugcaauugguguaauuuggugaaaagaacaugagagccacauuaaguuucaaauccuagcauugucaacaaugacuagcuauuugacauaggacaaacauuguuucuucaucucuaaaauuuuaaacacuuacauggauuggagagaacccauauaaaaugccuaacauauucauucauucauucaugacacaaauacuuaucaagugcuuuccauauucagaauuuaugcuagaugcaagggauagaucaaugaguaggguaacauggucccugccuuucauagcuuuuauaagcuagcaugaaccugguaaauacugggugcucaaaaaauuauagcuacugauacugaaaaucaugcuauuuaugguucuaggcaaguauguugcacuaauuugccccuucuuauagauacuucuuauuagaaauaaagcuauaucuugaaugaaauagcauagaacaaaauuucagcaauauuuggaagugacaaauuuuauggagaacuuagggaaucucaaugcagcaguccuuagauacacauuuugaaccaauauuuacuaagauacaccuauuuacaaggcauuguucuugucuucaggugacuuaaugucuagguggagaaaucaaauauguaacuguaauaggacaaagaauaugacgagucuuuuaagaaggaaaaucuuuuaagaaagcauaaauacgaaaggaauuacuucuggaaguaguuggcaaugcaaggugggacaggugaaagaaggcuuaaagggaaaggcuuugggcuggaaguuaaaagagagggaugauuucagugaauuuagagaaaggauaugcuagauggaggggguaaagcgaucaaaagcauggagguagaagguguucaugaaaacuggagaauaaucuccuuggacuagacuugcagcauuucucaguggagguauuaguaugacauuaggcagggggugacucaucaucauggagacgucccacacaugggagagguuuggcaucccuggccucauccacuaaacaccagucauguuuucaaucauuauacaaacccaaaacgcuccugacauuuccguaucuuccccuagggggcaauaacacucccaguugagaacuaguugccuagaguaguuaaugucaaggggaauauugagacacaggguaggaugaaauuaaaagcuugaauaauuggcuauacauuuggaauauguuguuuagcuaaugggaagcuacugaaaguuuuugcucaaagaaguaguaugaguagggcuauauuuucagauguuuauuuggggagccaugugugggcuguacgggaaggcaaaagagauacaguauagcugggagaccaagaggugaaacuaaaagccagaaccacaaaugcaguacugguaaaaauaagaagaaaaaaaauagucucaacauugagucucaauagcacaagcugaucuauaauucucaacagacuauuuacuaugucuuaacauacacuccccauagcucuuucuuguuuauguuguguguguguaaccauauacaaguguguguguagcuccuuuagagaagaacaaaagcugaguuucuaaaucauucauuugacuuugauagggaaucuguauuacaauuacaugauauuuuaauuagaaauauagaagcuaugguauggcugcagaauagacuuuauuaggagucagguuccacuguuacuagcacuguaaaauguaauuuuaaaaaugugaaauuuuugauuguuuacuguuauuaaccagugccuuugccuccagccugauucccuuaaauacaauuuauuuaaggcagcaguagcaauuuuuuaaaauauaaauaugaaaguauuacuccaccuagggaauccauaacuucccaaauaaaguccaagcgaaggucuuuguggcuggcccacucuuauuucgccuccucuacgcaugcccuucauggcagccagguuaaaugacuaguaauggccaaacagcacacauuauuucacaagucuaugcauuuacauuaggauucccacucccuggaauacacugucauccugcuccacuuggcuaacuccacgcaccuuucaaacauuaguuggagucauguuucucaggaaaacugccucaucccucagucugggcuagauggcgcuucucuacgaugccauugcacacucacagugcuuuacaccggcuuauuggucuaaugcagggcuguccaauagaacuuucugcaauaauggaaaugcucuauaacugugcuauccugguguuauuaagcacuugaaauguggcuaaugugacugaggagcugaauuugaaguucuaucuaaaaauuagugguccuguauuaauagaacagcacgggucuagaaugaaguucuugaaagcaaagaucuucucucuccugagcccugauacagugccuggcacauagugaaagcucagaguauuugauaaaugauugacugaauaaaugaauaucuugccuauuauuuaaauaagguugcuaaaauguccuaugcuuuaaaaaaaucucccuaauuaauuggaaauaauuuugguuagauaaauauauauuccaguaauuauucauucaauaacucuuuaccaaguaggucccagguggaaaucuagugcugauuuaucuagcucuuuauccuuaaacaagacacuugaucucucuggaaccccaauuuauccuucugcaaacagagauuuguguuacauuuguaguucuaaacuucuuaugagacauaaaauugaauuaaaugcuguaugcuuuugccagaaauguuuauauuuaauuaaaagagauccaugguucuccuaaagucuauuuaaauuaagacuuucuauacuagaugaagcuugaagucccuuucaguuccaaacucauacaguaccaugugcaagacauauaguugguauuuacauaguaccauacgaaauugacauuuuuggaaaucagcaauuauuaaauguuagcaaucuuauacaauuaaaucuaauacaauaauaagaguauaaagaagucugaggacucaaacuuaugguuucaggucaaucugcauaugcuaaaagaaaaguaacuaaccagagcacuguaugguauacaucaaauaaagagaugucacagguaacuccagauucagacacaugagggggcauuauguucugcaugaaggugggaacucaaggugaaagaggguagaauccagagagaugggaagaaagagaagugcacuuaggaugagaguucaagggguagugaugaccucagaccuagggacaaagguauaauguaucuuccuucucucaacuggaggacauucacuuuacuuccguagguugaucuuugcaacuaugucucugucaauggggccacugcucacccccacauugaaaaugauggaaccguuuacaauauugguaauugcuuuggaaaaaauuuuucaauugccuacaacauuguaaagaucccaccacugcaagcaggugaguuuaccaaucuguccucuucugaaaauaagugucuauauugugagaaaguuacuguauugugagaaagauaagaaugucagaauagcauuuugugcauaguuaaauuacucucagacuucagaaguacugcccucaucccuacccuauaaggggccuaaugcccaagggcaucauaucaaaggaugacgacuugaaaauauagaaagcaaguguccaaguucucuucuagaauauuaaaaauguaguacauauauauauauggauuugaucauauacaauuaggauucaaacuuagcaaacauuuauugagcacuuauucaugugcuaggcaaaauuaaauuaaauaagcauguaugugugcauaauagcauacauacauauaugagaguguacuaaauauguugcgcuuaauucccaaaacuacaaacaaaucuguuaucucauagaaguacuauagaaaaagaacuacagcaaaaagaguguacccuagaauucuccauucauucuucauuuauugccagguucauuguucaccaccuugaugauggaauuauuugaauguauacagauuuuuguuuaguauuauuuaguacaguucucaaaguguaguccuuggaccaagaccaucaccuaggaaacuguuagaaauacaaaucuugagccuuguccugggcagacugaaugagaaauuuugggaguggagccugcaaucaguauuuuaagaaacucuuuaugugauucugaugcacacuaaaguuugaggaccauucacuuacuagugaguaaauuuuaaugugcauaagaauuacuguacagggcuauugacacaaacccaucuaaacuauauccuuugggcaucuuaagauguugcaaaaggcauuuugaccauucugagguuucuucccuacuccccugacuuaaaacccaccuccagcuauugcaagaugugacuccacuacacuccacuugccacaacccuauuugagugcacguuuccaaaucugcugcuauuuggauuuuccugggugauuuugcagcuucacaugaaauuucacuaagaagugcaaaugauggagaaaaugaaaauaaccccucuaaaacaaucaaaauguguuucuuugccuguauaagcuguucuaaaugcuuuguauuaaaaaaaaaauaagaggcucuuccaaagccuuuuaaaaccacuuuauuucagacaaggaagauccaauaagcaagucagagaucguuguacaauuccccugcagugaccgauucaagccaucuuacguucauagguaacuugaaggccugcuaugaaucuucaggaaaacucaaguuuaaagauuugcuuugccuaccuuugauaccaauccugaucacaauauuuuuuugcagaaaacuaaauuuaaacauaauuaauuucauguaggcacuguugauucuuguaacugagcauaccacauauauacaaauuugucuguggcuugagaaucagcccuuucauucacaagcccauuuguguuucugaacaguuuuggucugacucccaacuauaucguuuuuguggagacaccagucaaaauuaaccuguucaaguuccuuucuucauggagucuuuggggagccaacuacauggauuguuuugaguccaaugaaaccauggggguaagucuuagauauauuugucaaguuugugauucugaagaagauguguuuaauaauguacacuuuuuuccuuuuuaaaugcaucaaaauauuuuccucauuuuucaagguuuggcuucauauugcugacaaaaaaaggaaaaaguaccucaauaauaaauacagaacuucuccuuucaaccucuuccaucacaucaacaccuaugaagacaauggguuucugauuguggaucucugcugcuggaaaggguaagaaaggacacuggacaaaugggacaccucccauuguuccuggaaauuacgggguuuuuacagagcugcugcacucaaucugaaucacaucuaaaacagcaagaguuaugugagagucaaaaauguaauuggaaaagcaguaggaaguuuagguaaucugaacaucaaaacuaugauuaaugauugaaaacuaaucggguccaugaaccccaccugaaaacaaaagauucugugaccugagaggugaacuuaaaguugacaaaaucccuggggaaacuugagccccaucuucucugcgaagggagaaaaagacaugcguuuuucagacuagccaaaucacuaagaagacaacagcaccuaaggacacaaacagaauggugacaggaagacagaacagaaaguaucucaaggcugcuguuacuuaaacaaauccauuaagcagguugcuuuauuuucauccugugugggcgggaggaaauggcucugauacaccuggcucaauagcaguuucuggguuguggaauaaagaacaggcaggcacuugugcuuaaaaaggcaagaaucaucucucuaaaauuauuugucauugccugugcucauguuugacuuuuuauuuuugcagauuugaguuuguuuauaauuacuuauauuuagccaauuuacgugagaacugggaagaggugaaaaaaaaugccagaaaggcuccccaaccugaaguuaggagauauguacuuccuuugaauauugacaagguaaccugcuucucuguagauuucagauuuaaccagaauguuucaucucucucaggaauuguccuccugccucauguuuauacauaaagucuugaaauuugagagcuagaaggagcuuuaaaaauaggcuaauuaaacuuccuucauuuuacaaaugaaacuaaagcucagaagaguacugugacuuagcaaaagcaacugcagcagagccaggauaagaaccagguuuuuaaauucuaaaucugccguucuuguauuuacaaaauugucuuuaaaauauacuuccucggugaauagugcagauccacugauuccuaugauacuuuaucaauaauauaaauaguuuaaauaauuugaaguucuggagagaugaagcaucaaaaaguacucuuguagggaaaccaguucauuauuuugguuuucuauaaaucuucugaaaaauaucacuagagguuaaaaaucauuacuaacaauagacagucaucucuuuauuucuacuuuuucuucccuguauuuagagacugucuuuuuagaauaaccagaguaacaucuagaauuuguagugugauggaaauaccagucaaaaucaauaaaauauaauucucacauauagguaugugaauauaugcuuucuuuuauaucuauuugcucccugguugcacaaaagggguuauuaaaacagcuacauggaauguaaaacuuugcaccaaaggcuuagauaugguguaguagaaaauaaacucaauuuagaaccaaacaccacugcucuuaagcaaguuuguaagcucuaugaagaaugagaaagagggagaagguugagguugaguguuacagacaggcaaaggggcgucuauaaaggcaaggaggaguuaaaaaugcaagauuucaucuauaaauaugaaguaguugcugaguuugguuuauuuagggguguaggggagauggguuuugggcagagagacuggaaagauagguuggagcaauauuguaaugggcuauauaagccuuugaguguuauauaaauauagggagccauuuaaguauuuuaaauguguauuuuaaguguauuuuaggacaugauuagaucugugauucagaaaguuacucuggcagcaucauggaagacagacuggaaaguggagagucuagagcagaggcuagaagcccuauuacaggauuaaugcaaugaggcaaauaaaagggaauaaguaguugaguuaagaaaauggugacugagagaugaagaugcaaagcugagaaauauuuaggcagcaaaaucaacagcaguugguaucuaauuacaugugagggguaagggagaggaaggaguucaggaugacuucaagauuuccauccugagcaguugagugaaugaugguauaauucacugaacugaaaacauagaaguaagaggagcugggccaggcgcaguggcucacaccuguaaucccagcaguuugggaggccgaggcgggugcaucacccgagguugggaguucaagaccagccuuaccaacauggagaaaccucaucuuuacuaaaaacacaaaauuagcugggcaugguggugcaugccuguaaucccagcuacucaggaggcugaagcaagagaaucgcuugaacccaggaggcagagguugcagugagccgagaucaugccauugcacuccagccugggcaacaagagugaaauuccaucauaaauaaauaaauaaauaaauaaauaaauaaauaaauaaauagaaguaacaggagcuagcuuguagaaaaaagaauaaauuuuacuuuauagauguaauuugaaaguacccacuagcaaucuuagcaaagcauuccauaggcagcugcuguacauggaucuggagcuccaaagaaagaucauggagagagaucaaucuggguaccuuaaggauuuuugcuuuccccuuaagaagcauaucacugacauguaguugagcauucccaaaauacucaccaaauggaugagucaguuaauuucaguaaacucuuacuucgcuaauaaugguaaaaaucacaaucaucuuuaaggaaauaaaagaggaucacuuaacuuaaauauucacauugcaaaauaaagaaaaaagaaggauuuuucuaacuguaugguuaucacggccugaagaaauauuacccaauuauagaauagggaacuguaauaaucauaaaaaaugucuaacaucaucaaauccgucuccucuuucuucuaauaguuauugaguagccacuaaaacaggcaucauacuauuuguugcaguggguacauaaaauacacuucuaguucucauggagcccguuaccuaguguaucagagagaaagaagccgaaucaggaauagccaugcaugucagcacaggaguaguacucucaggagggauaaauugauuuguuaauagcuagucagaugauaauguaggggagauuaauggaacauaguuauuugcaaugggcaguaauauggcagguggagaugggauugaggcagaacaacugaagacagaaagaacaguuugaggaaagacagauagguggagagggagauacgcagagagaauuggcuauuauaauugguugaaacauaggcaaaaguaguaaaguaaaugggauaaaaaguuauaaaaguacguuguacucuuagaaggcuuuaaggccaggcuaagaaauuugcacuuuauugaacugguaauggaaagacagugaagguuuuuacacaaaagaaaagcccauaauuaaugguauugaaaugauaaugaaauauguaagaauagagagauaagacugcaggcagggggggaaaucauauuuuagauuagguuuuccaaaagaaacauuuaaaauuugcuuauuuaaaaaauaaagaauuugagagccagagaauacagagagagaagacagccaagcacaguagcuccagaaaauaaacauguguagaaaaugguagaaacaagagaagccagaaaaagaaacaagagaagccagaaaaagaaacaagagccaccagaaagcccuaguuccuacuaagagagaguaacgucacaaagaugagugcaggugaggguuauacggugcccauugccauagacaaguugaaaagggugaagacuaagaauaaagcacuagguuuggugaucucuaagggaauagagugagagagacagaagucaggcuucagggcucuuaagguaagcaguugaguaucuggaaagcaguuacugcgugcacacucuuaaaaguuuggcaaugaagagaaaaauagaaagggcuuaggucccaguuacuuggaagacugaggcaggaggauugcuugaguccaggaguucaaaguuacagugagcuacaugccauugcaguccagccugaggaaaagaacaagaccccaucucaacaaacaaacaaacaaaacagaacaagacuccaucucaagaaacaaacaaacaaacaaacaaacaggaaaucuaauuuaacaaugaaaauaagcaaaauagaacaaaguaaaaaauucaacuugaaaccacauaaauaauauauuaaacauagacauagacauuuguacuuauuguaugcauguacauaaauaugcauacaugugcacaccccucgcuucuucccagcaucaccacuaaguaccucgagucccuuauuucacaaaaucuugcagaaucuucuccucuauuggcucccaccucccauccuuucccuauucugaaaaucuuccacuauuuacuuuuaauucuuaguccaccaccagaaaaaaucuccugucuucucuucuuagaauguugccuucaaccuccuuuuuuaaccaaaaucuggcucucuccccuaaggacacuggucuccccaacaguaauuuccaggggaaucaguuucuccucuguacaggguacagcccuuuuaccacuuggccuggaguugggguagagguccuucuucuuugcugcuuucagaucauuguucccucuauucacccuuaaaauucccuaaguuuucaucucauuuuaucuaaucauauagccaagugauguauauguguguguguguguguguguguguauauauauauauauauauauauaucccucaugcccucgacuuugccacuacuuaagacuauacuccuuccauaaucuguuucaugcaugacccacucugaccuuuuaucuuucaacaucacuugcccuacugcaauuuccaccaggaacuuccaauccauugaacacaguacuuucucacucucucucacuacguugaggauuuaccuucucuccucacucaauuuaagcuuuacagucaauaauuacaaacacuuucucauguagaccuuccuuucccuugccucuuucuuaccuuaucaaagucauuugucaaaaucacaacccuaguuaaauucagcucuccacccccuccaugcuuauaccucugaggcugaacuaagugcagacaacacacaaucauguuaauugguuccauuuuagaugcaugaccacaaaucuuucugcuacauuucccggcuucacuuacucucucacuuugcuaguuaaauauuccacacccuccucucuuuaaacuuuuaccaccucccacuucccgccuccacacucagaugcagcugauggcuauguuuucuuuuucucugaaacaaaugaaagaaaucagaaaggaaccauagacuugccagcacaucuacccacccaccagcaucuguacucauauacugaauuauccaucuuccuauccagagcugaucucuuucauccuccuucacauucucagggaaaucacucucccaauucuccccaucuuuccuagaucaccacucuccuacccuuuucgauggaucauuuuugucaggcucuuacaaaauccuucucuugacauuuuugccccaaccagcuaccuucucauuccucgucuuguuggagggccuugguuccccuaucuuccauuuauacacucacucguuguuaaauauucaugccuuauucauuuacauuuuuagcuuucucuuaaacucaagguucuuaccugcuagcgccagcuccacaucugcauuuggaugcccaauagacaucucaagucuaauaagacaagacuugaacuucucaucuucccccaccaaaaauuuacuccaccuguaguuccuaucuuuguugugacaucaacauuguacaggucaaacaccuugguguuaugcuugaugccucucuuacuuucaugccucuuccucgucccauauccuauuuaacaggaaaucuucuugacucuguccuccacuucuuccacuucucacugacugcaaugcuacuggccuagugugaaccauuguuuucuuucaacuagacuacuacaagacaaacugguuucccugauuccacucuuggauccucccuacuaacaaggcuacccuaaaaauaaaucauagcaucucacuccugugcugaaaacccuccaauggcuucccaucacucacucacagagaaagaucaaguccucauaaugaccuacgaggcuuuguacagccuggcucgugaccuccccaccuuccuuucuuauucucuccccuagcucaguugauagaauccacacuggacucuuugaugcuccucaaacacacucagcauccuccucccucaggccuuugcacaauuuguucucuuagcgugaacacucuuccccagauaucugcauugcuaauucucucaucuucuaagaguuuugucuccucugccaccuguucaaagagaccuacccgaaccaucuauucaaauuuuaaccgcuuacccuucacguuucugaucuuuuuuccucuauucuauuuuucccccacauuugugguauauuauaaaauuuauuaauuauauuuauuguauaucuccuugaacuagaauguaggcuucaugaggacagggacuucacucuccaaaacauccugaaugccaagaauagagucuagaauaaaauauguaaucaaguauuugaugaaauuauuaauaaguagauauguuagaaaaaucucaugguauuucauaaaauaaucagaaaaaucaugugugugugacaagagaucuuaggaaacauaugguccagcguuuuuuuuuuuucuuuuugucaacauaacuguaaggauuuuuuuuuucaagcaaaaucaaaacauauucuacgugugaacgaaauauacauucuuucaucccucaggcagucgaagucuuuguuguucugcagaaaaacauuaauuauuauuauuauugguuuugagauuuuuguuugguuuuuguuuuuuuguuuuucagaggccuuucuuuggagcccuaaauuuucuucaaggauggucucauuuuacugaagagaaaauugauggccuaagagguuaugugacuuucccagugauacauagccagugacugacacaggcacagauagcuugcccagucgcgucccagggucccucaucuauagcuuccugcaguuccucccugcauguugaccuaaaaaagaacuuaggagccaagacuuaagaacucugcauuucuggcuguuugaauucuuuccugcucacugagguuucuguuaucuucucuccuaggcugacacaggcaagaauuuagucacgcuccccaauacaacugccacugcaauucugugcagugacgagacuaucuggcuggagccugaaguucucuuuucagggccucgucaaggugagaugaucuagagaaaacuucacacgggagugaacaaauguuucuuucaaagagauuaagaguuuuccuaagcaugugcucuauuucguagcauuugaguuuccucaaaucaauuaccagaaguauugugggaaaccuuacacauaugcguauggacuuggcuugaaucacuuuguuccagauaggguaauuaauccuucuuacuaauauuugaacagugcuuugaguauaugcuagucaaguaaagcauauugacugauugcuugauugauuuuucuuucucacaaacagcucuguaagcugaaugucaaaacuaaagaaacuuggguuuggcaagagccugauucauacccaucagaacccaucuuuguuucucacccagaugccuuggaagaagaugaugguaaugaaagcaauuguugugucugaauacucuucuuacugcaguucuguauguuaguucguuaggaaaggaguaagguugauuauuccguaauacucaaaaacgauccuuaauacuauaaauagagcaguacugaagaauuaaaacuauuugaaaagaauuuucaucuuuugaucaggucuuguugauuaccaguagaaaaaaaugucaaagcaccauuuggugucacgauggagcaucaaugucugcucuagaugagggagagaaggaagaaaaaauggcaacaugaauuccagguuuuugccuucccugacgaagacauauuucuaaaaaaauagcaauucuaagaagggaagcuaaguauuauagcagauacaagagaaugagaaggcaggucugugaauaguuuucauuuguucuuucgguaagcuagggcuugaaaaaagacccagagccacaccagcaacucagauacagcaacucaaauuacaaaucagcaguguuaguuaacugcuucucagcugggacagggagauagauuacacucuaugggauuaaaauauggaaaacuaagagaaaugagauaaagaauuguggagccauuucacacuaaaugauuuuauauauccagucgaagcuguaaaagauuuguucucauuuuguucgaaggaagucagcuuccagaucgaucuuagaaaccauacauaugauauaucuuacugcuuucaaagucuuuuaauacacacuuuucaugugaucaucacaguuuuuacaguauguacagcaggugcuauauuuguauguuacagauaagaacagauccauuuauucagugaguauuuaaugaguaccuacuacgcuguagucauugucauagaauauugagauauagcagugagcaagacagacaagacucucccuucuuagagcuuacaguguagguaggguacauaaagaguuuaaaagaccucuuuagguggucucaugccaggugguacaagagucagaaaaagaagucaggucauaugguuuucuauauuugucaauguaauaccuccuauauuauuucaaugacauucaaucuauagcuugggcuuuuaaaaacucaauauugccuaauuuacuucugauaaacagguguaguucugagugugguggugagcccaggagcaggacaaaagccugcuuaucuccugauucugaaugccaaggacuuaagugaaguugcccgggcugaaguggagauuaacaucccugucaccuuucauggacuguucaaaaaaucuugagcauacuccagcaagauauguuuuugguagcaaaacugagaaaaucagcuucaggucugcaaucaaauucuguucaauuuuagccugcuauaugucaugguuuuaacuugcagaugcgcacaauuuugcaauguuuuacagaaagcacugaguugagcaagcaauuccuuuauuuaaaaaaaaaaguacguauuuagauaaucauacuuccucugugagacaggccauaacugaaaaacucuuaaauauuuagcaaucaaauaggaaaugaauguggacuuacuaaauggcuuuuaauuccuauuauaagagcauauuuuagguaccuaucugcuccaauuauauuuuuaacauuuaaaaaccaaaguccucuacacuugauuuauauuauauguggcuuugcugagucaaggaaguaucaugcaauaaggcuuaauuacuaaaugucaaaccaaacuuuuucucaaaccagggacuaucaucuaagauuaauuacaguaauuauuuugcguauacguaacugcucaaagauuaugaaucuuaugaauguuaaccuuuccguuuauuacaagcaaguacuauuauuucugauuuuauaauaagaaaaucuguguuuaaucaacugaggccucucaaccaaauaacaucucagagauuaaguuauauauuaaaagcuuauguaacauaaaagcaaguacauauaguagugacuauauuuaaaaaaacagcauaaaaugcuuaaaaauguaauauuuacuaaaaucagauuaugggauaauguugcaggauuauacuuuauugcaucuuuuuuguuuaauuguauuuaagcauugugcaaucacuugggaaaaauauuaaauuauuaacauugagguauuaauacauuuuaagccuuuuguuuuuaaauuucuuuucuuccagagauuguuuaaaaauaaauauugacaaaaau

SEQ ID NO: 34815 - RNA, 17217 nt, Homo sapiens
gaagccucaccaagccucugcaaugagguucuucugugcacguugcugcagcuuugggccugagaugccagcuguccagcugcugcuucuggccugccuggugugggaugugggggccaggacagcucagcucaggaaggccaaugaccagaguggccgaugccaguauaccuucaguguggccagucccaaugaauccagcugcccagagcagagccaggccaugucagucauccauaacuuacagagagacagcagcacccaacgcuuagaccuggaggccaccaaagcucgacucagcucccuggagagccuccuccaccaauugaccuuggaccaggcugccaggccccaggagacccaggaggggcugcagagggagcugggcacccugaggcgggagcgggaccagcuggaaacccaaaccagagaguuggagacugccuacagcaaccuccuccgagacaagucaguucuggaggaagagaagaagcgacuaaggcaagaaaaugagaaucuggccaggagguuggaaagcagcagccaggagguagcaaggcugagaaggggccaguguccccagacccgagacacugcucgggcugugccaccaggcuccagagaagguaagaaugcagaguggggggacucugaguucagcaggugauauggcucguagugaccugcuacaggcgcuccaggccucccugccugcccuuucuccuagagacugcacagcuagcacaagacagaugaauuaaggaaagcacagcgaucaccuucaaguauuacuaguaauuuagcuccugagagcuucauuuagauuagugguucagaguucuugugccccuccaugucaguuuucacaguccauagcaaaaggagaaauaaaaggaccgggugagaugugucugcauaugagcaguagaaaguugucaauugucccuuuugaaaaacuauccuuuuuugaaccuuugcucagauuguuauuuguaccuuuugauguuaaaaugaccuuuauuuaugaaauuacaauagauuugggaaaugauaauaagugguaaguuuuuguuuauuuuuaaauguucuucccuggcaaaauaaagagauggcaccucucugucaguuuucuuaauauguuguucugaaaguuuucuuacucaguccaaucugagaaccucugcuuuuaagucaucagacaaauucuugagauggcuuuuucugagaggcucuucuguucauccuggucccuucuugccuaaaggugagucuguguguguguggggggggugcgggggugagguguugggggaggucuucuuauuagcugggaagaugguauuugugucacuuuuugugaaagugggcucccaaauauucccuguugaggaaguguucuaaucaugaggaaauaagcaagcaaauccaguuguuggacaauuaguuuggacuggucaaagaugucagugccaaggaagaaagaaaaaagggguggggaagggcuuguucuauauuaaagagacuaaagaaauguguuaaccaaauguagugcaugagucuugauuggugucuucauccaagggggaaaaaggcuaugaggaacagguuugggauaacugaggcaauuugacugcucauuauuauguuacuguauuaauguucaguuucuuggugagauaaugauacugugguugcgaaggauaaaaucuuuguucuauggagauacaugcuuaaguacccagggugaggcgucaggaugucugcaauuugcucucaaaugguugaagaaagacugcaaauauauagauaaugagagaaagaaagguaaaacaacuguggcaaaauauuaauaacuggugaauuacaaacuggugaaucuaaguauauggggagcuuauuguacuauucuuucaguuuuucuauaggcuugaaaagcuuuaaaauuaugagaaaauauuuccuaaaaagagccuucuacgugaaaggcaagcucuucauagcuaugggguuagaaaaccuaagagccagagccuggggaugaccuugggcaaguuauugaacccucugcaucuucauuucuuguccauaacauaacaaagaaaauuccugcugugaauaauuuuugugggguucacaugaaauaccuauaagauguaaaggauuuuuaaaaaauguuuagauuguuagaauuagaagagauccaauucugaauuuuacaaccaaggaaagugaaguccuaagaugcuaaggggccaagguugcccagcuggucagugguagagcuugagacuugaaucuguggagacaauugaaagaaucaucauuaccagaagugugaugaggcauuacuuauuucagacuguugaaugaaguuacauucucaauaaaaacuccugcauguguguaugugggugugggugguguguguguguguguacaaaaauaguggcaauguuuugccuuuuuuuuucuuuuguggucauuuaacaagucuuuggggauuuauuagauguguuuccuaauuuuauauuuuuucuugaucuuuccagcuacuccacuuuugaaauaagggcaacaucccauuauauugaacaccaaacauggaaguucuuuucuaguaguagauguuuuucaugagcaggaaauuacauuaguacaagaauguggaacuggaaagggaccuaaugagcauccgguaccgcuggcugauuuuugcagauauggaaacugaggcccagagagguuauucagcuuguccauggccaucuaccaguuaguggcaaagcucgaauucuggccucuuccucugaaguucagugacuuucuuucuuuuuuuuugagacagaguuucacucuuguugcccaggcuagaguguaauggcacgaucuuggcucacugaaaccucugccucccggguucaagcaauucuccuaccucagccuccugaguagcugggauuauaggcaugugccaccaugcccggcuaauuuuguauuuuuaguagagacaggguuucaccauguuggucaggcuagucucgaacuccugaccucaggugaucugccgaccucggccuuccaaagcacugggauuacaggugugagcccucccuguacauggccaugagguucauugacuuucaagaccuucagcugaccucugguuuauagacccuaaagguaaaagacagaaagguacaggaaugcuuggaacaaaagaucuguuucaaggccagaucuagggaaaagggggcauucuggaggcuggaauauaagucuagguaugcuuuuuugcaggaguggcaagaacuaggugugaagguuuggguagagaagcuuagugaggcugaguggacaaagguaaggccugagaaggcagccuuucuguauuccaccugcaacucaaauuguuaccaccacuuucuugaucauguauuaauaguuguuauguagaaaaaaauuccuuauaaucauagaaaucacuuguuuauacauacacauaauaugacauauuuuacuacauaacuauuacuacaaaguuauauauaacuuuuucuucucugggcuuauauaaauuuucauauauauacauauauaaauuuuauguauauauaauaguuuuugaaaaguagaaaaaaaauacaauuagccaagugugguggcucacaccuguaaccuuagcacuuugggaggccgagguggacagaucacuugaggucaggaguuuaagaccagccuggccacuguggugaaaacuugucucuacuaaaaauacaaaaauuagccgggugugguggcgggcaccuguaauccaguuacuccagaggcugaggcaggagaaucgcuugaaccugggaggcagacguugcagugagccaagaucacgcuacugcacuccagccugggugacagagcgagacuccaucucaaaaaaauauauauauuacauauaauacauauaaauauauauaauuauauauauaaauuuauuauauauauaauaaaauacauauauaauuuacuagaagauaaauuagaguugguuauuacugucacaagagaaggacugcuuuguuuguuauuuagccccugcuuuggacuggucuccuguugaacagagccuggaagagggcuugugugcaguugguuuauauggaccaugauccuagagaagagaaguugagacaggggaaagugagacagggaaggcaggaaagccacaaaaugggggccuucuccagcuagucaccacagugggcaauggaggcucaaucccaucaagcccuucagaggggcuguguagacugcaacagaagaggggagguuuacgcauggaucugauacccucuuggccaagggcuaucccauggaguauauugcgcuucccugauacucagauguggggacgagguuuguucuugcagacugauuuuuuuuuuuuuuuuaagauggagucuuucucugucccccaggcuggagugcgguggcacgaucuuggcucacugcaaccuccgccuccuggguucaagcaauucuccugccucagccucccgaguagcugggauuacaggugcacacuaccacgcccagcuaacuuuuguauuuuuuuuuuuuuccaguacagacaggguuucaccauguuggccaggcuggucuugaacuccugaccucaaguauccacccaucuugaccucccaaagugcugggauuacaggcaugagccacggcgccuggccuguucuuguagacuuucuaugcagaaagucagagaagcugggccacgguggcugaggcgagguccccgcaggugauaacugcaagaggcagguugccucagcaaugacugcaaaaaagugggcaggaugugaggggagggugaggggagaaaccugagguguucaacacaagugcugcagauucccuuuccucaccuagaauaggauggggaugagaaucccucaugggagucaucaugcaaauuagcagucacacagggaagcacccagugcagcgcugagcaguggccacccagugaauaaaauauaacuagaaaggcuuauuuuacuugaguuccacuauuguuuuuguuuuuuguuuuguuuuguuuuuugaagauggagucucgcucuaucaccaggcuggagugcaguggcguggucuuggcucacugcaaccuccaccuccuggauucaagcaauucuccugccucagccucccaaguagcugggauuacaggcacacgccaccaugcccggcuaauuuuuguauuuuuaguggagaugggguuucaccauguuggccaggcuggucuugaacucccgaccucgugauccacccgccucagccucccaaagugcugggauuacaggcaugagccacugcaccuggccaggguuccacuauuguuuuaaagcaucauucaauaaucaauaugucaacaugugcauaacauuuuaauaacaugcguugauucuagagacaguacaaguuagagcaguacucaggacaauagucuauuagcuagucuucacuuuccuaagauguuucugacaaccuguagauaauuaggcauagcuuguuuuacuucauuccuuucauuuauguaauauggacugaacuuuccagugauagaaaauaucuaugaaaauuauuacaaugccuaugucuacaggcaaacgaguuaauaaauucaguuuccggguugaggucucuaaaaugccaagucuauaaagaagcgacggcagagaacacagaacauuuccagaauuuuguaauagacaugaaccuuuaaaccacagaaggacugaauuuaacauuuuaaaaaaccuagaaaaaaaacagcugggcgugguggcucacgccuguaaucccagcacuuugggaggcugaggcaggcggaucacgaggucaggaguucgugaccagccuggccaauaugguaaaacccugucucuacuaaaaauacaaaaauuagccaggcgugguggcaggcaccuguagucccagcuacucaggaggcugaggcagaagaaucacuugaacccaggaggcagagguugcaaugagcugagaucaugccacuguacuccagccugggugacagagcgagacccugucucaaaaaaaaaaaaacaaaaaaaaaaaccuuaaaaaauaaaagccccaaaaaugcuaacuaucugacacaguacagcccuuaauauuuucacagucucuuuuugguuuuccuccacauucacaaugaaauguuagugauuuuaaaacauuccagagaaauuuuaguguugacacaucuuuauugagggccauuucauuuauaguuacuuauguaaucauccaaacaauucagcucagcauacuggggcucagagagguggagucauuuacccaaagucacacagcugggacauggcagagcugaacuaggagcuaugacuuccggcuuagguccaggccccuuuacgagauuguuucccugccuuuggguuuugcauccucuauucugggcuuccacccgcaugccagauggcucuauuccuggagucugaccauugccagaugcuccuggcugacaugaccuagaagaagccagcaggcucauaacuuaaccaucgccccugccaaaugggaacuggccuugccgucauccuggaagccauucccugacauuuuguuuuauugcaguucauguuuauuccagcuaaugcacauaaggagugguuccugcaaggcacaaucugaagggcuccuugcucagagccguaagggccauggugggauucagcagggaacuuggcaccagccaggcacuuuugcugccucuucuuugccagugaggguagaagaacugauaagaggauugagugcacagcccaggagcugagaguuuacaaggcaacccacugggaccugagcucagccccaggagugggucaccccacaaagugcugagcagcaucuuugagacucuucugaagccuccaguagccaucuggguccagucgggagauagaaaucacacaguggguuaagcuggggaaguuuacuuuaaagaauuacuaaccgugaugaaagagcaacuauagauagacgugaacuccauaggcaccuagggcugagggagggugccggacaagcuuggaaggggaaggugagguucagcacaucagcuugcagagaagguggcuaaggugugcaggccucagcuggucugcagcugcaauaggccgccucccagugcaggugaggagggcaaccugcaacguguggcaagggcauggugggagucagggcaggcacaggcaggaggccuccagagcacugagguccgugugcagggacucuggguuccuuguugggagggcuguggaaagguuauggccaggcuguggcugugaggucacagaagaacuucgcucuggguccguggcugggguaggacuccaacaaauguccucacagucauaccaccuauggacgcaggacaggaaaacugcagaccuuuuuccucccacgaugucccuccagcgcccucuacugagauaguucaacaucgcgcucacuucaaagcucuuguucuucagacagcauacaugggagggugcauucagcucugagaggcaaugcguuuauaacugacacaccuccucagcacaggauggaagaguucgcagcugccauggccucggaagacauggguucaagucccagcgauaccacuuagcugugugaccuugggcauguuacuuaaccucucugaaccucgguuuccucauuugcaaaaggggauauuaauguucacuuucaggaccauuauuugaaaguagugaguagcaagcacccagcacaguacuggcucauaagagacacuuaauaaguaguagcgauaguucaacuuuaucaggcgcuaucugcaguccuaaagccuuucucuauuucucugaaacuuugaaggcaccagaucacauuuaaaaauuacauaaaaauuacuugaaaugggcaaagagcuauaaaugccgacaaaccaucuuguuucacaaaaaaaaaaaaaaaaaaagcuguuuuuuagaguugcaaagccaguacauacuuuagcuauccacaaggaagucaucugugaaaaugccugacuuuuuuggguuucacuuucuuccuucccucuauagcaaaaggggcauuucuuucuuaauuuucuccccacugacugguagguagguaccccuacuuuucuuaguauacaucuuuucucgguaaguuguuaaauuaaauaaccagcauaaaauacaucauuuuguauguguaaaggggccagaugcaggggagggauggcucgccugaauuuaauauuuuuuuaaaaaccuaaaaaaaaaagcccuaaaaauguuaacgaucugucacaauauagcccuuaauauuuucauaaucucuuuuugguuuucuuccacauucagaaugaaauguuagugauuuugaaacauuccagagaaauuuuaguauugacacauuuauuaagggacccucccauggcaacuguggauggcauagcugaaguguagggacaagguuggggcaguccuccagacuuuguguacagauggcaugcaguauuucucucuccucacauugccugaaaccaacuccuuuuuuuuuuuuuuuuuuuuuuuuugagacagagucucucugucacccaggcuggaguccaauggcacaaucucagcucacugcaaccuuugccucccagguucaaacgauucuccugacuuagccucccuaguugcugagauuacaggcaugugccacuaugcccggcuaauuuuuguauuuuuaguagagacaggguuucagcauguuggucaggcuggucucgaacuccugaccucaugauccacccaccucagccucccaaagugcuggaauuacaggcgugagccaccaugcccagcaacucuuauauucugagaguugagacaaugaaagaaaagaaauuugaguuguccugaggcagagucugcagugauccaagaagagguacagaugaaaggaaaccagcucaauucaaggaacuugcuuaaugcccugauuuugaaaaauuguccuggcaagacuuugccacaucgaaugagccucugcacauugcaggaggcuggcagggccagggagcggugggcugcuccuaacagccuggguguguguucugggccuaagagagaaggcauggcaaucggcgaggcagcaucagagaggaagguuacagaugguucugccaccuguguacaggaaggcggucacucucucuuaccucucccuggcagcacagaagaacagggaaccucgggcacccugucccucucccccauaggcagcaccaagucccugccggagguguguguugccugcacagggggagaagggaagcagcugguacuggucucaggucgaucuaaggaaacuccauuugaccuagugaaucagucccugcccuggauacccuccuaggccaaugcaaccuuuagaaugaagaacaaagggguuuccucaccccugcacaaccucagauagggagaaggagacgcagggaaugaaauaaaaguuuccaggacucuccaggagccauucagauuguccaagaaacugguuuccgcagcagccuggaauaaacccauuuuccuucucggguaugaggacuuugccagauuaugauuuccuuaagggcauggacugauugugucuuuuuuuuuuuuuuuuuaaacauagacuagccuauuagacaaacuugugucuuagacaccuuuuuuucuugagcaccuagcacagccuugcacucaauaggugcuccaaugaugugacuaaaaggauggauaaauagcucuguggauuugaggcuaggaauaaugaaggccugccaugucccgggggguacucccaauugccccuggaguuuggaaugcacauugaggauguccucaguuacauauacauuuuggcuuaugagucuuucuuuuuuuaauuuuuuuuuuuuuuaagacagggucucacucugucacccagacuggagugcaguggcaugaucauggcucacugcagccuugcccucuuggacucaagagucaucuuccugccucagccucccgaguagcugagaccacagacugcaccaccacacccagcuaacucuuuaauuuuuuguaaagauggggucucgcuauguugcccagccuggucccaaacucuuggccucaugcaauccugccaccucggccucccaaagugcuggguuuacaggcaugagccacugcgccuggccagcuuauggguuuuaacuacuuacauggugcacucuagacugagggauaucccagggauggaggacccacccaccuccagggcauuaacacuuuuagggaggcuaacaacugcagccacacagaggcagggguggagaggagagaaggguagcugggaucaggggcaggcagcugcagcagcuacugagcuggcucacugugggcagcauggcugucuggcccagccugcaccugagagcuagcugaauguuuucuucaccuccuuccagggagaaauuuuuuccaguacuauaauuuguugaagcugaaccccagcaacucaaacaagguacccugacucuggagaugugaaaauguaaaauaauguguggcuuugaugaaaugugguagaaccagaggauuaagacuucuguggugauccucucugccugaaaucuaaauuuaggagagcugagcaaacaaaugaucaaaggcagaacaugucuucccgacccucucggcuguguaggcgcuccggccucaggggaugcacugacuuuccucccacuguccugaacaccugagaauccugagcggggaacaaguugcucaaagggcagagaagugacucagagguucagcaagagaaaagcccaguguauuaagcaugucuuuuuauucugaugcuuugcugucugggccuugcaaacgugagagggacugccccucccagggguagccaguuccuacgguuagcaaaggacucaccugggaggacagcuuucauaugcaaaccaaccaauccagagcccacacccugugaccaccuccaucuggcucaaacucaaggccacugucccccugaccuaaucacccagggccugguaccagacaauuagagauaacuccugugaccccagauccugcugaaauuauucaaacuccccaauccuaaaccugcuuacccugccuccccuuucuuuccuucccauggaaagaauaaaggcgcuuucccacauuuuccccuggugcccucuucuggagcaacccuggugcuuccccagguggccuccugggcuuagugugcccccuuccucuugggcucugugaguacaacaacuuguaaagauaauuuuuuuuuagagcaguuuuauguucacagccaaauugagagaaaaguacaaacaguucccagauacuacuggcccccacacaugcacagccuccccgauuaucaucaucucccgccacagcaguuguuacaacugaugaaccugcaucagcacgcacaacacccaagguccacgguuuaaauuaggguucauuuuugguguugcgccuucuauggguuuagacaaaugcauagugacauguguccaccauuauaguaucauacacaguauucauugcccuaaaaaucgucugugccucaccuagucaucccuuccucacccaacaacugcugaucuuuuuacugucuccauaauuuugcuuuaacuugcuuuucagugacaauugccuccugggauguuggccuugccacaccugaauaaucaucaaaccugcauuuuauuuguuuuuauguguaugugauggguuuuuugggagguuggaggggaggacagggucucacucuacgccagggcuggagugcagagguacgaucacugcucaccacagccuugaccucccggucucaagugauccucccaccucagccucccaaguagcugggacugcagguacacaucaccacccaggcuaacuuuuuguaguuuuuguagagaugggauuucaccauguugcccagguuugucuugaacuccugggcuccagugaucugucuaccuuggcuucccaaagugcugggauuacagguaugagccacugggccuggccaaacugcauuuuaaaauagccaagccuguuccuugugacuauugccucauccuuguauucaagacugcuguaagaucauaauccuaagcaagaguagagacauguagcacaccaugaucacuuacugucuaaccaaugcugcccacccgcuucccuucuguauggcucaccacccccaccccaaacuccuauaggaacucugcacacacucccucuccauuaugcaaaacuggucucagaaaggaaucagacagaauauuucuacugaaaguauaaagcuuaauauguuacuucuuacaagaauauuugcauauaacaagggaaaaaaccuuaagucaugcaguaaacuuuuaucuuuuuuuuuuuuuuaacaggagucucccuauguugcccaagcuggucuugaacaccugggcucaaguacuccuccugucuuggccucccaaagugcugggauuacagacaugagccacacuucuuuuuuuuuuuuuuuuuuuuuuuuuuucuugagacagagucuugcucuguugcccagacuggaguacaguugcacaaucccggcucccugcaaccuuugccuccuggguucaagugauccucaaccuccugaguaucuggaacuacaggcaugugccaccacacccugcuaauucuuguauuucuaguaaagauggaauuucaccacgcuggccaggcuagucuugaacuccuggccuuaagugauccgccugccucggccucccaaagugcugggauuucagugugagccacugugcccggucucuuuuuuuuuuuuuuugagaccuugagaccgggccuugcucuguuacccaagcuggagugcaguggcaggaucauagcucacugcagccuugaacuucugggcucaagcaauccucccacaucagccucccaaguaccuaggacugcagaugcuuaccaccaugcccagcuaauuuuucaugaauuuuuaauuauugaaauucagacaucuaagaagaugcugaggacugucuccauauuccugaaauuacgacucaccuauucacaaaccagcccuucuaguggaauuaaaauauuauuugauuuugaauacccuacucuaagguaggcacauugcccugcaauuuauuauuuaugagguuuuuaauuauggaauuguucaaauauucacaaaaguagagagacuacaaugaacuccaauguagccaucacucaggcccaacuguuaucagcacaguccaaucauguuuuaucuucccuucucugacccccaacccauccccaguccuuaucuaaaaucaaaucucaaacaccauaucuuugggagccuauuuauuuaguuaguuaguuuucagacagaguuucuuucuuguugcccaagcuggaguacaauaguguagucucggcucacagcaaucucccccuccuugguucaagcaauucuccugccucagucucccaagaagcugggauuauaggcaccugccaccacauccagcuaauucuuuuguguuuuuagcaaagacaggguuucaccauguuggccaggcuggucucgaacuccugaccucaggugauccgccugccucggccucccaaagugcugggauuacaggcaugagccaccacgccuggccggcagccuauuuaaaugucauccucaacauagucaauccuugggccauuuuuucuuacaguaaaauuuugucucuuucuuuuaaugcaguuucuacguggaauuuggacacuuuggccuuccaggaacugaaguccgagcuaacugaaguuccugcuucccgaauuuugaaggagagcccaucuggcuaucucaggaguggagagggagacaccgguaugaaguuaaguuucuucccuuuugugcccacguggucuuuauucaugucuagugcuguguucagagaaucaguauaggguaaaugcccacccaagggggaaauuaacuucccugggagcagagggaggggaggagaagaggaacagaacucucucucucucucuguucccuugucagagcaggucugcaggagucagccuuucccuaacaaagcccucuauccuaucacccacacuugggaggcugggcugggcugcacagggcaagaugagagauguguugauuucauccacuugauugucauguagaauuagauauacuugagaaguuacauuuuucaguagcgccuucauaucuuuauuuuagggacagguauacaccaagcaccaucucagccacaaucuguuacuaacaguauguuuucugaacuuuggccacuuaggaaaaguacaguuuggcucucuccaaaguguucccugaaaguccaacuuuaugacuaauacugugauuuccagaaacuuugacuauccauguuauugacaaugauuacuagcacugaagggcaugcaugcaaguagggguuaugaaauauuuaaaacacgguucucuaagauaugagcagcaaaguguuucuaccuucuaugagggaaccgaaggugccauuaaaaguagagaaaucuggaccaggcaugguggcucaugccuguaaucccagcacuuugggaggcugaggcgggcggaucacuugaggucaggaguucaagaccagccuggccaacauggugaaacacugucucuacuaaaaauacaaaaauuagccaggcaugguggcagucaucuguaaucccagcuacuugggaggcugaggcaggaaaauugcuugaacccaggaggcagagguugcagugagccgagaucacaccacugcccuccagccugggcgacagagugagacucugucucaaaaaaaaaaaaaauacagacaucuguugugauucugguaacucuaaauuuucaaccgucucuucacuacauuuaaaaaauuauuuucuaaaccaaauuagccaggugugguagcaggcaccuguagucccagcaacucaggaggcugagaugggaggggugcuugagccuggaaggucgaggcugcagugcacugugauugcaccacugcacuccagccuagguaacagugcaagacccugucucaaaaaauaauuauuuucauguuuauuauauuaaaaugauguaugaaauaugugacucaucagggcuugaaaaacuuuguuguauggagauuauucuuaugaguugauuuuucucucuccuaccuuauaguaaugaaauaaaccaggcaugaaagucacaauaaguaauacaaugaacacccaugggucccugcccagcuuaaguagaauauuacaaaugcaguugaagcccucugugcaacuuucauccuuacaacugauacugagugaauuguacuuuaaauauuuuauagcucccacucccaugcaugccccucagugauagcaauaauugucaauaacaugaaacacagauugaucauauagcauuuaccauauauuuacucuauaccaagcacuuaacauauauaauuacauuuaaaauuuacaacagcccuacuacccaaaacacuauuaguauccccuuuuacaaaugcgauaacugaggcguagagagcuaaguaacuuacugaaagucacacagccagcgggugguagagccuagcuuuaaacccagacgauuugucuccagggcugucacaucuacuggcucugccaagcuuccgcaugaucauugucuguguuuggaaagauuauggauuaaguggugcuucguuuucuuuucugaauuuaccaggauguggagaacuaguuuggguaggagagccucucacgcugagaacagcagaaacaauuacuggcaaguaugguguguggaugcgagaccccaagcccaccuaccccuacacccaggagaccacguggagaaucgacacaguuggcacggauguccgccagguuuuugaguaugaccucaucagccaguuuaugcagggcuacccuucuaagguucacauacugccuaggccacuggaaagcacgggugcugugguguacucggggagccucuauuuccagggcgcugaguccagaacugucauaagauaugagcugaauaccgagacagugaaggcugagaaggaaaucccuggagcuggcuaccacggacaguucccguauucuugggguggcuacacggacauugacuuggcuguggaugaagcaggccucugggucauuuacagcaccgaugaggccaaaggugccauuguccucuccaaacugaacccagagaaucuggaacucgaacaaaccugggagacaaacauccguaagcagucagucgccaaugccuucaucaucuguggcaccuuguacaccgucagcagcuacaccucagcagaugcuaccgucaacuuugcuuaugacacaggcacagguaucagcaagacccugaccaucccauucaagaaccgcuauaaguacagcagcaugauugacuacaacccccuggagaagaagcucuuugccugggacaacuugaacauggucacuuaugacaucaagcucuccaagaugugaaaagccuccaagcuguacaggcaauggcagaaggagaugcucagggcuccuggggggagcaggcugaagggagagccagccagccagggcccaggcagcuuugacugcuuuccaaguuuucauuaauccagaaggaugaacauggucaccaucuaacuauucaggaauuguagucugagggcguagacaauuucauauaauaaauauccuuuaucuucugucagcauuuaugggauguuuaaugacauaguucaaguuuucuugugauuuggggcaaaagcuguaaggcauaauaguuucuuccugaaaaccauugcucuugcauguuacaugguuaccacaagccacaauaaaaagcauaacuucuaaaggaagcagaauagcuccucuggccagcaucgaauauaaguaagaugcauuuacuacaguuggcuucuaaugcuucagauagaauacaguugggucucacauaacccuuuacauugugaaauaaaauuuucuuacccaa

SEQ ID NO: 34816 - RNA, 52447 nt, Homo sapiens
gcuuacucauccaguguggauuacacuaccagcaaaacaucccaggaaggaguccaggguggccgcccacaguuaggagagaacccagaacggaacgacggacuuguuugcuuucuugccccugacucuccccguccucccugggaggguuggggaugugaacuaaugacuucugccucuuucggaccgccuuugaggcuccagagccucaccuuacuuucccacggagagggaggccacaggcuccuucagcagucgccgagcagaguccugggccgggagcgcgggggagggagcgagcggaacugcgccuaggaggccgagggaggaggcgcuccgcagacccuggcgcgccgcggagaagcucaaacuuuggcaggguaaggauuuuuaggggcucuugagcuggaauuuuuuggggggcgccgggaggugugcuggggccgcagaccccauacaggagguaaguuagagaaccacacgcaggggagggaugcugcugcuuccaggggcgggcgcggcgcuguccgcagcccccggugcugaaacgggccgcgggcuggagagaaagugaaaaaggaucggcuacggccucggcucccacuccccggcucccauaccccuccaguccaguucaaaggacaggaagcccuccccgugcuccccaagccgaucgcacccccuuuuacucacgucccacagccgcgcugggccgagcccgcugagccgucggggcgggaggcagaaggagcagggcuggcucccgcuggggacggguagggcuugcagccgcgaccccaccccauacauuuccuccugucacgcuguccccggaccgccaguccgggaaggacccacuuccccggcuccaagucgggagcgggcgccgcgucuucucgaguccgcgccgcgccgggggagguugagucaguggccuggagggagcagggccgggggaaggcagcggcgaaggacugccccccaacccaggggacuauuuucccuuggggauucaaagagaaagguaggcugaggaggaggcgagaauuaaaauucuuuuaggagugcgcgguuacuuuuuuuaaugauaaaaucacacccgggaucucggacgcccggggcuuagugcucggugauggaggagaaggggcggcgggcucucugauccucugcaauccccuaaccggauaaaggcgccgggcucccagccgucaggcuuuucucuuuagcucagcccgcggccccucccgacgccccugggggccuuggcgcgcaggcccucgcagucccgcaaccccgggccgggugauucauuuuucucccuguguaaucucccuacugagcggcgcagcugggacuuuaacuucggcccucugcagcgggggucuccgguuggcgcggcgcgugagggaggaugaauggcgcuggaaccuagaggaccuggagccggcgccccggccucuuuggccugaaccaggugccucugacacgcaguccgccggcucaggccucgccggaagcuggcgggagcagucccuugcagcgaagcccggcaccccgacggcagacgcuccccaucacaucuuccaaaggggcgaggcugggaucagcaggaauggcacccacccggguucagacuccaucccggaguggacagcucggugccccuaacauuaugcacuguccgccacccccuccccccaacacauacacacuuucauucaugaaaaccagcaagaauagugcugucugggcacggaguccaauguacagcgugcguucacgcugagaauucaugggggacgcgggugguugggccgggagaggagagauggucacuugugugugguauccaccaacugggucuucuacgccagagucccaguuguagaaaagucggccaggucagaggacccagaugggauuucacuaagcuggugggagcuucuuugcguucuuugggguagggggaaggacaggaacucccccugcuucgcaccaaugcccaaacaccgcacuuccucuucagccucgguucagccacagagaggggccuccuccuguguagaugcccggaggggaggagcggugguucuuggggugacuggcugguggaggcaggaucuuaaucacuuuagcugggacuuuggccgugacuacgugugcacuugccuuugaugcuccuguuucuaugucuuuucuguccucauucaccaucugcuagugguggcugccucugauuaauauugagguugccauggcgaccagucuccagucgccaugguacccagaagguaaacaguuggaagcuacucaggcucuuuccagcucuggccgcuaguuucccuagggaguggggcggggacggcagugaccagguuccagaacccuucuccgucccgcccuccccuuccucccucauucccacagcguccugcucaccugaaaccccugcuaaucccccaccaaccacuguggccucaagguugagaugggccaugcuuuuuucucuacugaggcuggggguaaacaguuuucucucugaccuaaugcauuuugguaacacccugaauauuucugaguacaaaggacaaggcucagucuggugggagaaacaaaauuuuaaacagacacagucccugcccucugggaccucacaguguaguguggcagacaaacccuugugcaaccuaccagguggccugcauuccggguguaaauggaggugauaacagagcccugagaguugagagaggugggagugacugacuccuggucaggguaggccuccccagcaagguuauguugcaacugaaacuugaaaucaacuggccagcaagagaggaaaaucucucuaggcagaagcaaggauguguggauuagucaggagagaguaaggcccugcuguggugacguauagacuuggaauaucuugguggcuucucccuuugcuuaugcaaugucugauuuuuuggggaguccugcaucauggggggaguccacuugccagaacccgucacucagccuucaccuggccugaaagggaggcuggaaaaugcaggaggcacaagaugggcuuuggugagcacugucucugccaguaggugggggcaaaaaaaaaaccaaauguacaauacacauaagggaagggugaguaauuuggcuuagaugagcauccaguuuaggcucacuugauccaaauuaugaaaagucuugaccaucaggcuaagaaauggagacugcgugcuggagaaaauaggcaccucuaaaagcuucugagaagagugacauaauuagaacuaccuuucauaaagauucuggggucacuauggaagguucauucauuuacacauuuauucauucuauacucauugagcaccuccuuagugccagagaauggauggauuguaggagugacagccugaagaugggagaugagcaaagauaacuauuucagccauccuggggagagagaaaggccuggaucaaggcaggaacagagcucaaagagaccagaagcaaccucuguucugauuccacacuuauacaccugucuagucuauacacuagacuagcacagggugagugcucaguacauuucugaauuaguaaauaaaagaguuggaggggauggaggagagagauagcuguugcugugacugaugcuggaucuggggcaguaagggagagggaggagugaaagcucacacagucuuagcuggguagucaguuggcucuggguguugcucauggcauuaaccaagacaguacugcagggaggaagagcaugcuugacaguagcugggggagacagugaugccauucagaauaguuuugcuccaaggaaaacucuuuccugaacucggccugcacccgagaacucaucuaauccccagagugcuucuuuuguccuccuuugcaggauucauacauuucaccuagaauuauacuaauacaguguagggguuaaaguuaaaccggcuucugcccccaggcucugccacugggugacuuugaaccaagguauuuaaucauucugagucucagcuucuugguguauaccuuggcaguaguaauaauuauaaugccuuccucaucgaguuguuguggggauuaaaugaaguaauugaaaugaaauccucagcucagugccugacauaucguaagugcucaaaguuagauauggacaucuuauuaccuccuuauaaaauaaaagcaauguguuacuuuuauaaucacaccacaaaaguuaauuaagaaaaaaaacacuuugccuuccaugcuugcaauuagguuuggagcaucuauagaguuggcuauggagagcucuguuuccccagcucugguaagguccgaaaagcauuuucauccucuugcaaucucaaccugaacagcugaaucuuuuuacaaagcagcaauuccaaaacugagcacacucagagcugaggaacucagagucccauuaauucugaaucaucucugcagagaccaggacacuuucuaggcaugagacaagccccugccucuugguuaagaaacauaauugaucaucuugauccaauuucagugcauuuucuuuuacuccaaauuucuuccuguucuuaagaacaaucuuaacuuucuucucagacaggaauugaaacuuugcagcugacauuuggaagcuuccauuugcucuuguuauaaaaaugcuggaguucagagagagauaacucuaccuuccugucaugagaaaguuucuuugggaaacaagacucaacucucccaacucagacucguuaucuccaucaugguggagggaccuugauggguuugggacagccaccauagagaggaggaauuggauucugaccuucaucucccuucaucaccucacagcucaacccugagcacaacaggauacacccuuguugucuaagacuugaacugucuuuuugggaccuuucuugggcagauggaggaagcuuuaauacuuauuggucccagaaguuacuuuguuucuugagaggcaagagcuuaaaagcuugcaggcucuacaauuagauugccuguugaaguccuggcugugugaacuguguaccucgguuugcuccucuguaaaauggggaugauaugguuucgcucugucaccacccaaaucucaucuugaauucccacguguugugggagggacccagugggagguaauugaaucaucggggcaggccuuucccaugcuguucucaugauagugaauaagucucaugagaucugauggcuuuauaagggggagcgucccugcacaagcucucucucugccugcugccauccauguaagaugugacuggcuccuccuuccaccaugauugugaggccuccccagccauguggaacuguaaauccauuaaaccucuuucuuuuguaaauuacccauucucggguaugucuuuaucagcagcaugaaaauggacuaauacaggggauaagaauaauauuuaccucauaagguuauugaaaagauaaaaugaguugauacacguaaaaaguuauagagcagugacugguauaauguaagcccucaaaaaugugauggucauuauuauuaaugucauauuuuggcauuucuccccuuuauuauguuucaugaguuucuuguagcugauauugugaguuuugcauuuuaaaaaguguuuugauuuuagauuuaaaauuauuucuuuuuagauauaauuuucaugccacaaaugucacccauuuaaaaugcacauuucacugguuuuuaguauauuuauaguugugcaaccaucaccacauuauaaucuuagaacuuuucaacacugucaaaagggaccccguauccauuagcagucauuccucuuucuccuucucuccacuccugcuccaggcaaccucuacucuacuuucugccuuaauggauuugccuauucuggacauuucauguacaugaaauuauauauuaugugacucuuuuugucuggcuucuuccacuuagcauaauauuuucaggguucacccauguuguagcauguaucacuguuuuauucuuuccuaucgccaaauaagauuccaucugaauaacauuccauuauguggacauacuacauuuuguuuauccauuuaucgguggauaggcccuaauaaaugauugucguuuccacuuagggcuacuguaaauaaugcugcuaugaacauucauguacaaguuguuguguggacauguuuuuauuucucuuagguauaagcuuagcaguggaauuccuggaucacaugguaacucauguuuaacauuuugaggaacugcccagcuguucuccaaaguggcuacaucauuuacauucccaccagcaaugaaugaggcuuccaguuuuuccacaucacauuguggaaaaugguuaauuguauguaucaucuugccugggauacagggugcccagauaaaacauuauuucugggggugucugugagcgaguuuccagaugagauuaguauuugaauccauggacuggguaaagcagauugcccuccccaguguugguggccacuauucaauccauugcgagcccggguaggauaaaauguagaagaaaggggaauucauucuuugagcugggacaucaucaguuuccugcccucuauuggcccucugguucucagaacugcaccacuggcuuuucuggucuccaacuuacagacagcagcucaugggcuucucagccucuaauucuuuauaauaaaucauauguauauacaguugacccuugagcaaugcagggauuggggugcugauccccuaugcagucaaaaauccacauauaacucuuuuggcuucuucaaaacugauuuacuaauaggcuucuguugaccacaagccucaccuauaacauaaauggccaauuaacacauauuuuguaaguucuauguauuacaggcuguauucuuacaauagauuaagcaagaaaaaaugggguuuuuccauuugucacauaucuccaaaauuuuuuccaauauauuuauugaaagaaaaacauauagaaguggacguguacaguucaaacccaugcuguuuaaggaucaaugguauauauauccuauugguucuguuuccauggagaacccuaacacacucacuaacacuuguuaugguaauauuaacauuuuauaguucuuuuucuuucuguuuuugaagcucuguaauaauuuuuauuuccuccaccuagguucauauucacacacaaaauaugagaggacacucaaguauaauauuugcauuguaggguuuuauuauaucauggaacuucuggaauggaaggaccuuuuauagccauccuagucaguguugaguacagucaucucucaguaucugaggagcauuuguuccaggaccuacccacaaauaccaaaauuuaacagaagcugaagucacuuaugcaaaauggcauaguauuugcauuagguuaguacaaaaguaauugugguuuuugccauuaccaaucuaauaaauaaccuacuguauuaguccagucuuauauugcuauaaagaaauaccugagaacuugguaauuuauaaagaaaagagguuuacucagcucauaguucugcagaugguacaggaagcauuaugcuggcaucugcucagcuucuugggaagccucaggaaacuuacaaucaugguggaagccugagggggagcaugcacaucauggcaggaguaggggcaagugggggaggugucacacacuuguaaaugaccagaacucaugagaacucacucacugucaucagaacagcaccaaggcaguggugcuaaauaauucaugagaaauccaccacuaugagccaauuacucccacaaggcuccaccuccaacauuggggauuacaacagaacaugagauuugggaggggacauagauccaaaccauaucaccuacguacaaccuccuguguacuguacuuuaagucaucucuagauuacuuauaguaguaccuaauacaguguaaaugcuauguaaauaguuugcacuguauuguuuuuauuuguuuuauuuuuauuguuguauuguuauucuuuauuguuuugguuuuuuucaaauauuuucaaucugugauugguugaaucugcagaugcagaaccugcagaugagagggccaacuguaguaagucauugugcuuuugauuuguauuuccucaugacuaaauacguggagaauguuagcaugugcuucuuagccauucuguaucuucuucagauaaaugucuauucaaauccuuugccugcuuuuuaauugaguuauuugacuuuuguuauugaguuauaagaguucuuuauaucuuguggauauaugccaauauaugucuuaaaaauauauucugcaaucccagcacuuugggaggcugaagcagaaggaucgcuugagccuaggaguuugagaccagccugggaaacauagagagacaccaucucuacaaaaaauuuaaaauauagcuaggcaugguggugugcaccuguggucccagcuacuuaggaggcuaaaguuggaggcuggcuugagcccaggaggucaaggcugcagugagcgguaaucaaaccacugugcuguagccugggugacacagugagacucugucucuaaagaaauaaaaaaugaaaauaguuucucccauucuuuagauugcuuuuuuacuuuguugauggcauacuuugauacacaaaggcauuuuuauuuugaugcaguccaaucuauuuuuucuuuuaucacuuucaccauucaccgugcuguuaacugugguugugucauggauacccuuuguuagguugaggaaguuuccuuauacuccuaguuuuuaaauuauuuucaccaugaaagcauguuggauuuuugccaaaugcauuuucuguguucaugagaugauuaugaggucuuugcccuuuauucuauuaggagggaguauuacauugauugaguuuggguaagucuauuuugcauuucugggauaaacaucacuugguuucccugugaaauccuuuuguauguugcuggauauaguuuacuaguauuuuguugagaacuuuugcauauuaaucugaguuucgaaguguccuuucauguaaauucugauauucaaauuguuuucacuuuucuuauacaguuuccaaaaauauuaacauuauauaguuuuccuuucuguuuuugaagcucuggaauguuuuuauuuuuuccacauagguucacauucacacauaaaauauaagaggacccucagguguaauauuugcauauaguguuuugcuccaucauggaacuucuagaauugaaggacuuuuaauaaucaacugggccuaugauuuucaacucuguuccacaguuucuuaagauguucugcacauauuuuaaguuuuuuaaaagguauauuuaaauauuuuuaaaacucuuauauaaagauagcacugacaugucuucuguaccaaacuuuaauauauugacuaucauggccaaaauuaacuugugucccacuaauugucuuuaucaaaguuaucaaauacuuuuaaauaaaauacaauaaguaaaugcuuuaugcaucaggguuuuguggauuauuucauuuuaaauaaggccauuucuauuauuagaugaaaaaauuaaagugcuggucacuuacccacauuggaggcuaagcugggaagagaagccaucucuccuuccucucaggccagugcccuuaaccacuuauacugccuuucaaaugugauuugagucaaacaaaagauauuucacucaggguuuucucucuccauaagccuaggacucugcuucaaaucaccaggccucuuugccggcuguaggaaugucaguguggugcccacgucagcucuguggggugguucacaggucucaggguaauuaagugcuucagcacuggagaauuucccuucuacccugcaguucucaagcaggaugggggcauaagggaaaggcaauuggaagaguauuuuggaaaaguguuuuagaaaaguuucaaaguauguagacccugggggaguucuugacuuaucuuuggaguuuaauuugaugaagcgagccugcccagccucacauuuacugauaacuugcugagugcauuuguccagggugaugcugagaagguugaguuuuggaggacugaaaugaaucagacucagacagagucugagaagauuacuucugagaaguaagauagaagaccccagugaucagucucugcuggagaaaacaguggccugggcuaaguaugccuguccaucaagacucuguacucuguccugauugagauuucggcuuguuugccauggcuuguguccagacucggcaccucacuaauuggacccgccaaacccuggcugaauagagucuccuccccaaggaugaugaucauucagaacgacuuccaguggacuuacagugcauccauacagggcuauggacaccucuguguugucucuccauugucagcugcauucagacuuggaaaaugguaauguuucaaaccacacaaauugcaccaggauuaguuuugauguucaggucacaauaaaaaagaagacagagaacaaacaaacugaguguaaauggucaguuagucaucaugaauggggagcaagguuuucuuucggaagcacguucagucuagagcaaggggcucgaaauguuuggcccuccuuuguaguauguuugcucucucauaaauucccacuuauaaauuccaaguggaauggaaauuuucagugugacucauucacacaaucauugugaggaucaaaugaguaaauaugcacuuaaaguuauuagaacaguaacaggcaaagauuaaacaauaaauacguggcuguuauuaucagugucgucaugaugauuccucaccaguuccuccauuuaucacacgcucuacuaccuacuaaauguaugugccggguguuugaagaauaaaauguuuuuuagguaaaaggaggcaguucuugccuuuaaggcuuuuggagucaguaaaggaacaagaaaaguacaagaauaacuggaauacagugagcugcguuaaaugccugacuacucaggcguccgggccaaugacaguggagagagcccaggaugagcacuggagugcaaaagucacagcugaauccuugaagguacacagcaaaaugugauuguaagugguacauguaacacuguaaugguaaauguugaauagugcuaaguaaaugugauggcuucucaccugggaagccuccuuaauggucccuaaggcagaauuaaggauuuccuccccauccugcauugcacccaucgugccucuaccuguauuucaacaccauuugcacuaccuuacccucacuguuuaacacgccuguuuuccccaugcaaauguugugcucucaauggcagagaucugucuuccucaucuucacaauucucaggaccagguauagugccugggacaucauuggcaaggagucaguaagggggcugguggcagggggacaugcuagauuuagucauguuguaaagaaaauggaaauugccugaaauggcauguucuuagcucuccaguuaaguccuagaaaauacacauucauuugggagaugcucaaaaaccacuccuagacucacgccugggauccacuucaaggucaccuucacaguugcagaaugcaucuucuugcuaguuuugaaaauuaaaauuccauuuguacauuuccaaucuccugcagugccugugauaaacagaacaagccauaauguggauuucagagugagacaggcccagggguccauuuccuuaucugcaagaugagcaucacuauucccucuugggguuacugaggauucacgcgugauggauauggaagugccucgcacccagggggcccuggcuagauggcagcuuucauuguccacagagccucaggaucacugauugugguuucauuaucucauuggugaguucuacucacaaagaguuuaucaaggcagggccagaugugaaaacacaugcagugguuggguaaucucuuaagaugucaugacucaaaaacugauaaauacagggaaauaauuguuuauucggccuuuccuauaggaauugaccaaucaaauaauuaagaguaaaauuuuuucuuuuaaaaauauuucagcuaauugaggaaggaaugguagaauaccaccaacuugcaaccucuaaugaauugauggaucuagcaaaugaacaucaacagcugcuaaugucccccagagaaauauaagaucuuauguaccuucugauggaagaacaaagaauccccuaugaaauugucaugcaaaaaaaaauuaauaaauugaccaagcuucuggguacagcuaccaguaguagauaacauuuuaaaguuggaauuagcaaaaauucauacuguaguaaacuccauuggacaaauaaugaaauuucuacacaaagagaaaaacuuuagagguaaaaauaccaagaagauauaacaaccaaucaacaagauugguuccuuauuugguuccuccugauuuuuuaauguauuuuuucaaagacaaccauuuaugacacuuaugagacaauagggaaaaaagaucuucugaguuaucuuaaacuuacauuucccuuuagugauguacauuuugcccuguccuacuccaaccauuguuuuccuggauaaagaacauagaauuaaaagggaaacuuggcucacuccuaaaccuugagggacuugggucaagaguacaaaugacccacuuacuguagcccaaauaucuaaaaguuaaagauucucuuagcagugauacccacuccccuccaaaacagagccuugaacagggaaugcaggcaggcaguuuauuuggggagugauuccaaggaacaggaguaggggucuuggagagggcaaaagggaaagaggacaagccaacccagauguccauuaucaaacugaucgccacucugggcaaccagggguucuccaaggagccagguagaaagugucucagagccaccuuccugagggauggaagaguauauucccucaggcuccugcuucuauugguccaggguugccccaaggauguuaccccuucagcuuuugcacauguaucagaacggugauguggucucagcaaguguuuccugggggaaguaaggaagcccccaaggcagaaggcccuagaaucugcagugucacugaggcaaaguacauggguuacccagcaugcagcugguugccauagcaauggcuggacugaaaggugggcaggaaggaugcgagguagaggaccagaaaugaccauuacauggaccaagauagcacacuguuaaaucaaaugugcccacccuccuaaacuggcaaauacacugcauuaccaccuggaggccagguucaaaccgagaguacucaggccccuuggaguugagccugagagcaggaagucaugaggagagcugaucucugguucccugcccacaaccugcccccuucuguccccagcccuagguccacaccacgucaaaggggccuugcacaggaggcccugcacaccugucuguggacgcccuggccacaucuccaggcucugucucccccaccccccacaaacagcugcuccuuggccauccuugggccuaggggagugcaagcuggugcacucagggagauggaccagggaagagucccaggcaggcucuagaaccaguugaaagccucuuggacagagaaucuggggguuuggggcauucagaccauagcuggagcaggggcaggguucccggugggcauggccccuugauucuaugggcuucucgacccuuugggagggauguggcuggaggagggccagcaugggguccuuuaaagcagagaccccuccugcccaggccuaaaggcaauaccaguucccucaaugacuuugcacucucagguuuuggagucagacagauuuuuagucaauccuggcuccggccuucagcagcaaccuuaaggaaaugacucaccuguccaguuucuucauuuguaagagagggaggggggcugcugugaggauuaaguaaggaaguguugcacagcacucaccuguggcuggcaccuaguggcccucaacaggaggcaggucuaugggaggacagagguacugccuccaugcaauggcagugggaccagaguuugugcccaggauagagaaagcagcugagggggcugaaggaaggggcacaggcuggagacaaugcacuuuauuugguguaauuugccuggaaauguacaaagaagaguaauucgauaguuuuuccacagagucccaaacuucuuugagacuugcucugcaccccacuugacugucagcuccuggaggacagagcugcauauagcucucuaauaaagccccagcuucuagcauauugccuggcacauaguaagugcucaauuaaaaaguguugaauggacaauuuugaauuggauuuauugcuuuuuuaucuaaaaacauauaaacauuccauuuuaaaguauugaaaauaaugaggccggggggaggugggagacaaggauuuggccaaagucugcauauacuaagucaaauaggguugaguccuaauguggcuucuggaccucacacguucuuuggaaaguuacauaaccuguuauaagccuccauuuccucaucuaugcaaugaagacacuaauagcauccaccucagagacucucauguuagaauaaacaaugauguaaaaagcuuagcacauugacuggaauaaaaucagauuucaauauauuauaacuacuacuauuuggauaacacacaugaauauguguguuauuuuuauuuuuauuuuauuuuauuuuauuuuauuuauuuuauuuuauuuuuaguucugggguacaugcgcaggacgugcagguuuguuacauagguaaaugugugccauggugguuugcugcaucuaucaacccaucucuagguauuaaggccagcaugcauuagcuauuuauccaguuacucucccucccugccaccccuggagaggccccaguguguguuguuauuccccucacuguguccaccuguucucauuguucaacucccacuuauaagugagaacaugcaguguuugguuuucugcuuccgaguuaguuugcugaggauaauggcuuccagcuccauccaugucccugcaaaggacaugaucucauuccuuuuuauggcugcauaguauuccaugguguauauguaccacauuuucuuuaucuagucuaucauugaugggcauuuggguugauuccaugucuuugcuauugugaauagugccacaaugaacauaugcaugccuguaucuuuauaauagaauaauuuauauucuuuuggguauauaaccaguaaugggauuacugggucaaaugguauuucugguucugggucuuugaggaauugccacacugucuuccacaugguugaacuaacuuacacucccaccaacaguguaaaagcguuccuguuucuccacagccccacaagcaacuguccuuuucuugacuuuuuuuuuuuuuuuuuuuuugagacagagucuugcucugucgcccaggcuggagugcaguggcgcgaucucggcucucugcaagcuccaccucccgagcucacaccauucuccugccucagccuccagaguagcugggacuacaggcgcccgccaccacccccagagaauuuuuuguauuuuuaguagagacaggguuucaccguguuagccaggauggucucgauuuccuggccucgugauccaccugccucggccucccaaagugcugggauuacaggcgugagccaccgcgcccggccuucuuggcuuuuuaauaaucaccauuaugacuggcaugagaugguaugucaucgugguuuugauuugcauuucccuaaugaucagugacguuaagcuuuuuuucauauguuuauuagccacauaaaugucuucuuuugagaagugucuuuucauguccuuugcccacuuuuuuuuuuuuuuuuuuuuuuugaggcagaguuuugcucuuguugcccaggcuggagugcaauggcacuaucucggcucacugcaaccucugccucccggguucaagugauucuccuaccucagccucccgaguagcuaggauuacaggcgccugccaccacgcccagcuaauuauuuguauuuuuaguagagaugggguuucaccauauuggccaggcugguaucgaacuccugaccucaggugauccaccugccucggccucccaaagugcugggauuacagaugugaaccacuacacccggccugcccacuuuuuaauguuguuuuuuuuuucuugcaaauucauuuaaguuccuuauagaugcuggauguuagaccuuugccagauggguagauugcaaaaauuuucucccauucuguagguugucuguucacucugaugauaguuucuuuugcugugcagaagcacaccugaaauuaauuagauccuguuugucaauuuuugcuuuuguugcaauugcuuuugauguuuuugucaugaagccuuugcccgugccugucuugaaugguauugcguauauuuucuucuaggguuuuuacaguuugggguuuuacauuuaagucucuaauccaucuugaguuaauuuuuguaaaagguguaaggaagggguccaguuucaauuuucugcauauggcuagccaguucucccagcaccauuuauuaaauagggaauccuuuccccauuacuugcuuuggucagauuuguuaaagaucagaugguuguagauguguggucuuauuucugaguuuucuagucuguuccauuggucuauaucccuauuuuuguaucaguaccaugcuguuuugguuacuauagucuuauagcauaguuugaaguuggguaccaugaugccuccagcuuuguucuuuuuguuuaggauugucuuggcuauacaagcucuuuuugguuuccauaugaauuuuaaaguaguuuuuucuaauucugugaagaaugucaaugguaguuuaaugggaauagcauugaaucuauaaauuacuucgggaaguauggccauuuucaugauaaugauuuuuuuccauccaugagcauggaaugcuuuuccauuuguguccucucugauuucuuugagcagugguuuguaguucuccuugauaagguccuucacuugccuuacuagcuauauuccuaaguaucugacucucuuuguagaaauuuugaguggaaauucauucaugauuuagcucuuugcuugucuguugauguauaggaaugcuugugacuuuuguauccugacacuuugcugagguugcuuaucagcuuaagaagcuuuugggccaagaugaugggguuuucuagauauaggaucuagaagacauccuuaucuugugucaguuuucaaggggaaugcuuccagauuuugcccauucaguaugauauuggauauggguuugucauaaauggcuuuuauuauuuuguuauuucuuauuauuuuauuauuuugagguauguuccaucaauaccuaguacauuccuauguacauuccuaguacaauaccuauguacauucuguuguuuucggguagagaguucuguagauaucuaucagauccacuugauccagagcugacuucaaguccugaauauccuuguuaauuuucugucucgaugaucugucuaauauugacagugggguguuaaagucucccgcuguuauugugugggagucugcaucucuuuguaggucuccaagaacuuguuuuaugaaucuaggugcuccuuuauugggugcauauauauuuaaaauaguuagcucuuuauguugaauugauacuuuuaccauuauguaaugcccuucuguguuuuuugaucuuuguugcuuuaaagucuguuuugucaggcugggugugguggcucaugccuguaaucccagcacuuuggaaggccaaggugggcagaucacuugagaucagaaguucaagacuagccuggccaacauggugaaaccucaucucuacuaaaaauacaaaaauuagccaggcaugguggcaugggcguguuaucccagcuacuagggagacugagcuaggagaaucacuugaacccaggagguagagguugcagugacccgagauugcaccacugcacuccagccugggcaacagagcaagacuccaucucaaaaauaaauaaauaaauaaauaaauaaagucuguuuugucagauacuaggauugcaaccccugcuuuuuucuccuuuccauuugcuuuguaaauuuuccuccaucgcuuuauguugagcccauuugugucuuugcaccugagauggguuucuugaauacagcacacugaugggucuugacuccuuaucgagcuugccauucugugucuuuuaaucaggacauuuagcccauuuacauuuaagguuaauauaguuguguaugaauuugacccugucaucaugaugucaggugguuauuuugcaggcuuguugagguugcugcuucauaauaucguuggucuuuguauuucagucuguuuuuguaguggcugauaacaguuuuuccuuuccauaguuaguguuuccuucaggagcuccugcaaguccuggugcugaugaauccccucagcauuuacuugucugaaaaggauuuuauuucuccuuugcuuaugaaguuuaguuuggccagauaggaaauucuggguugcaaauucuuuucuuuaagaguauugaauauuggccuccaaucucuucuggcuuguaggguuucuggggagagguccacuguuagucugaugggcuuuccuuuguaggugaccuggccuuucucucuggcugcccuuaacauuuuuuuuuuuucaguugggguccugcucugucacccaggcugaagugcaguggugcaaucucagcucacugcaaccuccgccuccccgguucaagcgauucuccugccucagccuacugagguccaguggcucgcuccuauaaucccaacacuuugggaagccgaggcaggcaaaucacuugaaguuaggaguuugagaccagccuggccaacauggugaaacccugucucuacuaaaaauacaaaaauuagcugggcaugguggcauaagccuguaaucccugcccuuaacauuuuuuccuucauuucaaccuuggagaaucugaugauuaugugucuugagguugaucuucucauggaguaccuuauuggaguucucuggauuuccugaauuugaauguuggcuugucuugcuagguuggggagguucuccuggaugauacccugaaguguguuuuccaacuugguuccauucuacccaucucuuucagguaccccaaucagucauagguucagucuuuuuacauaauccuguaguucucagagguuuuguucauucuuuuucauuuuuuuuuccucuaaucuugucugccugucuuauuucagcaagauagucuucaagcucugaaauucuuuccucugcuuggucuauuuggccauugauacuugugaaguucucguguuguguuuuucagaaccaucaggucauuuauguggcucucuaaacugguuacucugguuaacagcuccuguaauguuuuaucaugguucuuagcuucuuugcauuggguuagaacgugcuccuuuagcucagcaaaguuuguuauuacccacuuucugaagccuacuucugucaguuaauccaucucggccucagcccaguucugugcccuugguggagauguguugugaucauuuggaggagaagaggcacucugguuuuuugaguuuucagcauuuuuggcagauucuuucucaucuucauggguuuaucuuguuuuggucuuugaggcugcugacauuuggaugggauuuuuguggaaacuuuuuaguugaugcuguugcuguuguugcuuuguuuauuucucaauagucagacccuucuuuuguagggcugcugcaguuugcuggggauccucuccagaccccauucaccuggaucccuccugccccuggagguguuaccaguggaggcugcagaacagcaaagauggcugccugcuccuucauccgggagauccgucucaaaggggcgcugaccugaugccggcaagaacgugccuguuuaagauuucugcugaccccuguugaggggucucacccagucaggaagcacaggaucagggacccacuuaacaaagcacucuggcugacucuuagcagagggcaugcgcugcacuugcgggggaucccacucauccagacugcccgauuccuuaaagccagccaggggagagaccaaguccacuauucaguggauaccacagcagccccuccccgcaaggggcuccaucccagggacauccagccccuggcugggguugcugaaauuccagcggggaggcccugccuggugaggagggaugggucuggguuuagccuaaagaggcagucuggccacgaucugccacagccgcuauggugcacuguggggaauuccuccugggcccaaacugcccagucuccacgacuccagcaggggaaaauggcagacuggaacuccagugauggcggccaccccuuuccccaggagcucgguagucuuaggcagucuccaguguagaggccgccaagaaucugcacagcucugugcuugagacccaaggcccugguggugugggcucacgagggaaucgccugaucuguggauagcacagauccauggaaaaagcgugguuuccuggguaggguagcacaaucacucaccgccucuuuuggcugagaaugagagguccccuugcccugugccgcucccaggugggcaggcgcuccacccugcuuguccucacucuccuugggacugccuagucagucccacugagagaaccuggacaccucaguugcuggugcaggauucacucaccauuuucauucuccuuggugagaaccucugacaucagcuguuuuuuuucuuuuuuuucuuuuuuuuuuuuuuuuauugagacagagucucacugugucccccaggcuggagggcaggagugcaguggcgcgaucucggcucaccgcaagcuccgccucccggguucacaccauucuccugccucagccucccgaguagcugggacuacaggcacccaccaccacgcccggcuaauuuuuuguguuuuuaguagagacagaguuucaccauguuagccaggauggucucaaucuccuaaccuugugauccagccgcuucggccucccaaagugcggggauuacgggcgugagcuaccccgcccggcugaccucagcuguuucuagucagccaucuuggucccuccccggauuuauuacuuuuaaugaguacaauuucuuauguugguccuaaaguuuugcaggcaucucaaacuggaaucauucucuuucucuaacgugcuuccccccuaguucccugucucaaugggcaggcaacaccccccaucaccccagcuguuggggcacuguguucagcaccucuuccuccccaccccuuauaccuaaauugccauguccuggcaacucuacccacuugcuaucacuaccacaaagcuaguucaggcaguuguucucucuccccuaagaaacuguggcaauuuuuuagcugcucaccucacagggaacucauguucccugaauacauccucccuggucuagccagaguggccuguacacaccugaccacauuccuacugggcuuuaggguaaggcccaagcuccugggcacaaccugcaaagccuguuguagcaccugccccacugcacugucagauccuugagaacaggcuucguuuuauuucucuuuauagcuccuaugaucagccagaaacucacucauuguuacauaagugaauaaaguguuuaaaaaucaaaacaauguuugaucuauugagaaaaccagaauauuuaaacucauagacuuaaacuaucaaacaucagagacaagucaggacccugcugagccgauggcugcccuuuuguaacuggcagaggguuggccaaaugugcauggccacaccaauggcuccugucucugaccuuccuuuggauuuggaauuaacugaguccuggagugagucccugggcuauuucuagaaauugccaucuuucuccggaguggucuccacugacaucugacacacuuaaacgauguggcugcucaagagagccugugcuaaucuauuuuagagaaaccauccucagaaaugcaucuuccagugaaagacuuauccaaaaaucauggaacuggccaaucacaccagcccugcucucacauaggcuuucuuuucaaucacaggggcaccuuccaauguuugccaaagagaaaauguucaugaccugauuucuggcacaaguguaacugcccaagggguucaccuuccccacugccuagacagagccaacuuaucaagacaggggaauugcaacagagaaaaaguaauucacacagagcuggcugugcaggagaccagaguuuuauuauuacucaaaucacucuucccaaaacucagggaucaggguuuuuaaggauaauuuguuggguagggggccagugaaucggaagugcugauuggcuggcuuagggaugaaaucacagggaguugacucuguucucuuaugcugagucaguuacuggguggaggccacagaacugguugguaggucaagguguggccauccgguuguuagaaaugugaaaaccugaaaagacaucucaaaaggccgaucuuaggcucacaauagugacguugccuuuaacaguaacuggggaaguugcgaaucuuacgaccucuggaauaauggcugauaauauuuagaauuccagccccucucauucuaacuugguggcuguugggcuuuuaguuguuuuacaaaaacaguuuagcuuugggaaagggcuuuaauuuaaauuauaaauuaaauuccuucccaaggcuaguucggccuacgcccaggaaugaauaaggacaauuuagagguuagaagcaagauggaauugguuaggucuuaugucguucacugacauaauuuucuuaguuacaauuuuucaagacgauuucacaaggauugugccacauugacagguggaucuaucuuucauuggacaagcuacuuaacaucucugacgcucaguuuauucaucuuuaaaugggaauaaaaauaauaaguaccucacaaaguuacuguaaggauuaaugagaugaaucguguauuggguuuagcauuauauuguaaagguuuucugaaugucacauaugguccuuuuuuuacauguugucuuaaagcaagauuugagggagcaguggaaauaggugccaaauuauaagauaaaaauaaggaaacaagaaaaccagggucaagagggacacugcaucaucucaaagaaucaugagggcuucaccuuccuuauaucacauaccaacuuggcccuucauuuauuuauucauucacucauucaguacuuaacucugagcaucucuucagcaugguagcauaaacaaaugaguaaaagacuuugugccuuaugcuagaaagaagagccuggagauguccaacuaaaacucacugcagcaggaacuacaagagacagcagagggugugccugccagggcuugcaggggggccgcgugcgguagcccuugcccuugaugagcuggguuugcaguuacuuuccuguccugaugacgugucugcuuuguguucacauuuuagcaaucaucuggggggcuaaaugugacaaaccgagaagauggccaagaucaacacccaauacucccaccccuccaggacccaccucaagguaaagaccucagaccgagaucucaaucgcgcugaaaauggccucagcagguaagaugggcuaagaugggcuuuucauuuuaugccuggcucuggucauuuccacagcugaucuagacugugggggaagaaugccuucacguuggccagccacaggucagagggcaggggagguauucacagcacugccaacuucauuuuucaucucacuuaauccucacaacccccagaaaguagucuguauucuuguuuuagagauguggaaaagcaggcuuaaauagucacuuaauugcuauaagguaagaaaaugaagacucaaaugcagcagacuaaauuuuacuguaagaacuuccucaaacugacacacucucccauguauucaucaaaaauguguuggacucuugcugugcaccagccacugaacuggguuugcagucugagcugggcaccaaagauguagcaugaaucagaugcccugcccucgcuuccaggggaagaucuggaggcaggccaugcccagggccuguauagggagugggcagugccccuugucagccaagccaucaaccccaucaaugacauccugacacagguaggaaauggaaaucuggagccuuaagcucuacuucuaacccucuuccuaacuuacuaguagaccugggaaaacgcauuuaaccacuccaugccucaauuucuucacaaugaaacagcauuuuuuccaagcuccugguauaauagugaggacacccgaagggaccuauuuacuguacauagagcuaaacccuuauguuucuuuguuuuuaguuuuuuccuuuuuguuuuucgugacagagucccacccugucacccagacuggagugcaguagugcaauuagugcaaucucggcucacuggguucaagugauucuccugccucagccucucuaguagcuggaauuacaggcacccaccaucacacccugcuaauuuuuguauuuuuaguagagacaggguuuugccauguuggccauguuggucucgaacuccugaccucaggugauccaccugccucagccucccaaagugcugggauuacaggugugagccacugcacccagccauguuuguuaaaugauuaaugagaugauugaguugaagcaugagcaacuuucuuuccaauguuucuguuauuuuugcccuauauauauagaauugaaaacuucuccccacuaugcagcuuaaaugcacacugucugauggccccaaaaugcaguaacaucccucaguccccaccucccugcacugggcccucgugccucauuucuucucauucauuuguguucaucacuuccucucccaaaggcacauuugguuguuucucugucuacacucuuggucccagcuccucagcaaacucugcuaauaagugauggucaauaauuuucaaagagauugaguccccauuauggcaaacccacacagcccuugaaccccaccuucugagauuucggcaauggaaggaagaucccagagcaucccaacagauauuuauuuccuccaaccauuuuaacucggugcuggggccccaggaagugugauauggcuucagaggcaucagaaaguuccauccuacucaaauaccuuucuccuaacuagcccuuugucaaugccugcgucgcaccacuggagacuuaguccucuaaguuaaggcauugcuccuuauuuaaaagaacaaagaacacuauuaggaccuugaaacgucuguauguuuuaauaguuuauuucccaugugugagcuaauaaagccccuugaaggggguuucaaagagagggucgggcaucagggagaaggagcccaagaaugaggcacagcauaacaucacgauccugggauccugggcccaagaccuugggagaaggaccagaggcugucaggaucaggaagauuuugaagcagaauggaacuuuuccucuuugcacccaacuugccuggaguggggcaugacccaagcaugucauggagcuuccagauucccuaaaggcagagaaggcaguagugggaucucaguccggcuccuuccggugagauacccacuggaguaggcacccagaagaaggcaguccuggucugcaggcugcugcggcuccugcccacaaugucugccugacuugacagcaccgugguccugcugacucacccugguucugcuuuggccagugaccuccaagcccagcuugaccuguauccuguugaagcuugcaaggccucuuagaagaugaccauuugcaaaaugaauugcuagcuuguuaagccaugcuaauagcagccacuggccucuggcuucuggcagacucucugcaggcucacucuggaaugcacacugacaagggucacagcaccucuagggaucagccacauggucaggggcucugaacugacgucuugagauaaugcuauuugucgucugcaugggugagaaaagguccucccuucuccuuccuuugcacuuucugugaccagaaugaugguuuaacagcacaagcuuggggucagacugccugggauuggacacuggcucugcaacugaccugcuaugaaaaguugcucaguggcuccaagccucaguuuucucaucugcaaaaugaaucaguacuaauauugcccuccuaggguuguggugagguuacugcagaugugaaugcagagguccuggcacagucccugcuaugugguuaagugcucaauugacucccacucccggucuuggaaaugauuacuucuuccuguggcccuucucuggucucuucuccuugaccucagauagccgcauuuccugccuguguccaagcccugcuguuucagccugaccaccagccgaggcuuacugaacuccacucaggucucggccccacccuucacaugguaaauugacagauuaauacaguaucccguggaaacaccacugagauuucaaaaugagagacagaaagagugcuuccuuuaugaaagagcuaugcuuuaucuuacagaggcgagacuggcuuuaacagccagaaauuuucagaauguuccuuggagucaccaaggaaugacaguguguacucaggaugggguacagcagccucagggauggaggcugggcccagccccuccccugcuucccagcccagcccagcaucugucuauccaccgaugaggucucuaugugagacugauuugaacaaaggacucaggcacauaccacgcaaaaauuuuuaaguuucaaaucacuauuuuggagccaggagaaauaguguuuggacaagucacaccucuuugucuugaaauuccaguccuuuuagaaagcuuuaugagacaaaugauugagaauugggguacacgaacguuaaucgcucuuuaucuucagugauaucaagaagccugcacuggaaaccugcguguggguauggccccucgcugagugcccccaagaggaaggcauagccaagucucuguccccugagacuucccugccccaaggucuuuucaccaaauuggagggccaguuuuuaaguuauuggaauuauuuuuauaguggaaagucauagggaagaaugaaaacauuucauuugaaugaaaacauuuuacacccugaaaauaccaaaaauaagucugaguuuucauuucuacuuagaucuuuuuaguuggcucaauuauuuaagaacugucuggcauaucugugaggauaaggcaauagaaacaggcuauucucugcugcagagaauugcagcuaggacugagggcaacuuaaaucccagauccaucuccuggcguagcaauuuugaaugagcuuuggggcacggggguuugugucugacagaagaguggucuucuuguguuacucccugagcagagcccaaagcaauuaccaccaaagaaaaccauuuucaucccacuucuccaggaccaaaggcuuaaaaaugcauuggcuucagucccccaccacauguggccaauagcaguggguuccaaucauucaaguuccucagggcuuaagaagaggaaauuaaagugucguauuccccagccuugugcugaaaggucaccucuguuuacucucauguccccaaaacuaucuugcuggaaaacaucagaugcuucaccaagugcaaaguuaauuuccaguuccaguucucaugggagccccuguccucgcccagucacaagaaaccuucaccuuaccaacguuaauuccucugugcaaauaaacguagaacuugagcauuacaaggugaaaauuauguugucuuucaaagcagucucuccauucuacuaguuguucuuguucuugccaacuaccaacaucaggggggccucuuccuuggaaggcaucgaccccacaugggaucuuagaauagcagcccacacgugggagggaagcuccaggguuguccuggccuggucuguucauuuuacagagacugagguccuguaaagccauugccccaggcccuuccaccagccacaggcagaacagagccuggccccacgacucucauuuuccauuccugcauuagucgccaaaagcaucuccuuuuuuucgguaccuguguguccuuggggacuccaaaugucaccucagacaucaguuccucuccucucuucccaccuccccuccaucugccugguaaaaucaguuucugggagaaguaauuaaugaaguuuacuauguaaacacccccaggcauuuaauauggguaaagcucuggagcuaaaagaaagacauugaucuaauggaauuucaggcauugagaaggaaguggggcaacgcauagggaaaaaaugggcccccccaucaggccccuggaacuugcaucauguaaggaucucccuguucuucacggccaguugugccuuucugguaacugaaauccacaugaaauugccaacuuuugcuuuauuugcuuugugaagaucaggaaacuuaagcccagagaggguaagugaccagcccacagaauacucagccugcaggugcuggagcagggacucaaaccaggaccugccaccuuuccacucugccuccucccccugagugggcaucauagaucccgcccauaugcaacagcucucgcugcugcugguugcaggccugcuuugcaauccuggguggguuuugccuuccucacccacucaccagcucugauguuaucuaauucauuugccgcgaaugcaaauaaaucuggucucaggaugugcccucaugcaauuagcaggaaccagacuacgcuaaaacgcugggccgacugcuuggugccuagagcucccugaggagcugcugguggcggcagaacaccuccauccuugggauugccuccagaucuuccaggcacacaggcugugacagggcccccgcccagcugucagcugccaucaccaccacccccaugccagcuucucgaauccaaggaccucugccaccuccuccugcaaccaaccuaggugcauuggaacaugcauccugccuuuauaguauacagaauaugaagcgggcaagggaauuguagcuucuggacugcagcagggucucugacagggucuuuuauguguacacaaaugagaugagaguggguuucuuaugaguauaaggggagaauucaaucaggugguuugaaaauaaagagccaugccuaugguacagccauauggauuacagcaaugucucuaguggcaugccacagggcucaguccucagccauccuauuaauuuccuuuucaucugugccauauaugaaaauacagggcagcuucauggaguggaugacagcaaguuuugaaaugggauggaauaacauuggaaucucggcuguaccaccuggcuaugggaucucggugaaguugcuuaaccuuucugaacucccauuuccucucuuacaggguuguuguguggaugaaaugauaaaauguauguggcuggcauacagaaaagagccacugaauggcaugugguuuguguauuuuguuugugaguaggaugguguugggaggaaaggugaguguguucucugcauaccaaugcuuccaaaacaucgaguuacucagaucagugggaagguccaauacuuaauuccaaaaaaaaucaauugcgcauacacaagccgggguccucuggcuggcagcagccuguguuacaggacugcuuuggguuuucgcugacuguagcuggugaccaucaaaaaccaccagaaacacacaaagcaauaaagucuucccagagucugcccagucaagcaagaccccaggaacuugcucacaggagaaggaccaugacaaggaagagacuugaccccaaggaggaauugcugggugagcuggggguucuggccuggaaacccagaagucacacagguccuggucauggaagguagaagacgaagcuaccugacucccggugguuccagcagaaaacagccucaauguggggaggcugagagagggaagaaucugugggcagguggcgcagucaagagacagcccaggcagaccggggcaugggagugagcucccuguugcuggaaaaggcagggaggaaucuguagaagaggagaagcaagcagcagccuggccaccgugaugcaaggacucugacuucuaaucaaucaccagggagagacugaagcuuuucccugguauuaauucuugccuccuuguuaagaaggcuaauuggguuggaacaggucaugugauagaauuaauuugucuugccugggcuccucaagacucauagacugaagugcaaaucccuagaggcuaaugccuggcuggcuuuuaaucaggcugaucaaacuucagccccaggagguuuaaaagaaaggaaaauauucccagacgcauuccuagucuuauuccaggcaauucaaccagacucugcuggugugacuggugguuguauggaguuacgggcaccuguccuuucuggggucacacuuuccacaauggguugcacaaggggagucaccacaccuuaccucugccuugcaggagagagagccuagaguuuggcaaaagggacgaggggaaguggagucucauuugaaagcacuguacaaauuauuugaacugcauguggagagcuaggccaguucugugcaauauuccagggccuccguguuaaccagcggguucccaggaagccugccagacaagcccacaaacagcugcccaggcaguguggcugcagcacacgcagugggaagggaggcucagaaagaccccuaaggagcggguauucaaucuagccucagaagaugaaauucaguaggcgagaaguguuggaaccaaaauccucguucuggagucauuuuauggaagcagcugcuuuggcuugaaauggcaagccccgggaccucuccccacccagugcuuugaugagggccaggccagcauguacugccaccuucccguccuuucaccuagcccuggacaguagcuaccuuccuugcuguaaaggaaaggccacguuuauaccaaaauccagaaucuaucugcaggaggcaaagggaaguggggagccccugggaugaggaucugugaggguggcuuucccugcuaagcagaacaucugacugucucacuccuggcuguguccaggagguagaugggcuugaaaucaauucugcuugcugcauaucugauuuccuagagcccacucgucaagugaggagacaucgucagugcugcagccggggaucgccauggagaccagaggacuggcugacuccgggcagggcuccuucaccggccaggggaucgccagguaacugaccagccucagucccuaccuuggccugggggacacuguugcagaaagaagguagugaccucucaggaaaaagugcuagauggggguggaguugaagauuuggaaaagaaagggucaggagcagagcagccugaaaacuaucagugaguaauuuccucuugggucagauguucugagcucagaaaagucuaaggaaaacugccuuuaucugaaauugcuuaauaaaagcugacauugagguacuugcucagguuuggaagaauucagaaaaaaagccaaccggagaaggugguaagagcagccagccgugggagaccuuugauuggguggacacaguggugugcugaggaugguggugaugagucugaaauggcucuggcagggucucccgggugcucgucuggaccccagggcagguagguguccuugcaaaagcauuuguuugcaagauuagugagacuccaagcucugcuucccccugaugacauccguacuccagcuucaacagcugcuccauccugaggaagucauuucaccuuuucaaaucucaucuagaaaugcaucuaacagugccuaccccacagguggcuugaaagcugcuucagagccaagcaccgacucacggcaggugcucaacaaacaccaggcucauuauuuccuuccaccacgugguuuuuuccaaugccagagucuuacauagucacauguucuaaacuuuuuacuuaagauuaucacaaaagaaauucacauaucuauuuauucuucaugcuuuucauuaugaaggaugcuacuccaccauuguuuauuuaacuaguccauuguagcugggcauguaagugauguucaguguuugcauuuuacuaauaaagagcugucuuaagguucuuugaugauaaaggaagaaagagaacaccuuuaaaucagcucuguagggcugauacaggguguguuguaagcuugcaacacaagcuaucucagggaaacagagccaguggggcucgcaggaggggaccuggggagguagucaccuucccccucccauuuucucauggaguuucauggucuuugugcuucuuucugcauguccccuccauucuggcucucucuguuccaauaucagcuggcacaaggcugaaaacagccuuugccaugugaccaugaguugaaacacccaacccugucuucgaguggcucucaguucagaggccugaguggcucucugugcgucaguugucuguccuagucccauugucugaggcuggaggagggaguaugaccuugguuccacccucuuggcagaggaagugugugguuacaggaauugucugcggcagagagacugggcuuggcagauaccuccaaauaugucugcggcagcagcuguaagcaucugccuacagagauauuuucuuagucaauguauugccuuaggcuaaggucauaagugugugauuagggucaagguaugugacaauucauagcuuaguuccagguuguucaguacugacucuggcucgggacaccccguccaggggagggcacugcagaugccaaaucagggaaaccagaagccaagaaacagaauggagucucugggccuguuccccacuguuccccucuggcagagacaccagcaacagcaggcaggguggagggaaggccccucucaggcccgugugucucagaugagcucuagggacuggcacuguggucgcagguguuggagcucacggcaagcuccaggcagggccgggcuccgggagagggcccagggcaaguugcaaaggaaccucccaggccuggggagaaaacucuaguuuguacaagaacacaccaauaagauaaaagcugggaaaagacuccagguugugccuggacgccuguuccuuuaagccuugcuguaucagaucucaagaacuucuaaauaaauaaauaaauaaccuugcucucaauguugucauccuuugaaacccacauugcuuuacucuuccugcacuuggcagucauaacaaagagcucuccauugggcaaaaggagugagcuaaucccccauuugaaggaucaugccuuaggcagaguccaagugcugcaaggacaaaugguaauaaagagagugucccuuuccggggaagccugccccugacugcaggguggagggagaaggggauaaacgguccccauggggcagagaugcaaacuuagaccacagggcccccagcacccguacccugcuggucaucauugcuucugccccaucccuugagacagacagagagggagggagaaagagagagagggaaagacugggguuuggggguguggggggcuuuuccucucccucuggcucagugcuugugucaccuuccaggcugucgcgccucaucuucuugcugcgcaggugggcugccaggcaugugcaccaccaggaccagggaccggacucuuuuccugaucguuuccguggagccgagcuuaaggagguguccagccaagaaagcaaugcccaggcaaaugugggcagccaggagccagcagacagagggagaagguaaggaacggaaaagaagaaggggccucuggugccugcuggggccaggcaggaagccugugcuuugcuccauccuguuuggaugcagcacagguggccuggaacgucauccccaugagcuguuccuugaagaaaguguuugcccuugggggagcacuacaugcucuaacagccucugcggaguccaagaggccuugcaggagggagaaaacccuugaaccagagcccccagccucauuugaccacucaccuuauccuacacagggguccuguuaggguccccuggaaaucauguucucagaaacucaucgggggaugcuggccuuaccuaucucucuucaccaaggacccccguccuagacuccacuaugacccaucuugcucaaaagcagggucuuuuauagcaggagccuugggggggugucuaaaugguauccacaaguuuauguguaggcacgcgugcauuuuucugggaagagagucuacagguuggucagaauuuucaaggggagccauccaugucccagaucagguugagaaauaccagguggggaaggggacaauggugagaguagagcgagguggggagagugcuugcuuucuggagggaaaaucugcagaacuggggccucucugcaucuugcuucgcccccacccuaacugggagauaaaccugcaaucagacugguagccccuuacacacagacacagggcugcugccuccccuccugacuuguucaugagaagucuccccagcagguggucugcagagagaccccugggccagcacagguugaaucaauugucacugagcaguagagggucucuuuaggacacuuaggucugucuggaagggaggagaggcaagacguugaggggaagcugaccuccccucggccucccaaacagguggcuucucacccagaaccuauuuucuggggggugggaaaaggggaucaaauaagcaugauggcugcagaacagacagucccuauauaauuugcuagagaaaaagcuaucuguaugucaaugaggagaagauggguucagguuuggagcuucucaaauggucauaugaggguuucuggugugugaaggugaugaagucucaggggaaacccaguggcucuuucgggaacguccauuuucauuccauauuuguauggggaguggcaguggguauuuguaugucauagaugaugcaggggauggcgaacggcacgggcauuuuuaagauggaauaugagaguucaaggccaugucuugccagugacugcuuuaggagacccggggaaaggugugagaaucccugacugagaugggaaggccagaguuuucacacgagcuuggacugcaaacgcuuggguuuccugggcugggggaaggaggcuggggaaggccugggcgcuggcccagacaagugcagggaggucccagguucccaggacugggcauccaguauccucgagggacaccaugagacagaaagauaaggaggcaggcagauaagaaagaggacaaaguggggaaagaggaagagggaggggggaaaaagaaguuucucagcaagccagccagacuggucuaauuccuuuugggcaagcaaagacuuccuuauuuaaauugaucaaauuaccuuccuacauccuuagagaugaauguuagacucucuguccauuucccgaugggaccagacaaauggaggguugagcuaggaccauauccagggcaggccccgaccaccucacagacaucugauggaucacucgcgggcagggucagcaugggaagauggaugcgauggugcggauaguguuggucaaucagcaagucuuccugggggugaggauuuugaauuuuucuggaggcaaagucuccacugcaaagccaaguauauacacagacagguccuaguucuccugugugggcuuggcuuugugggguuacgggcacagaggcauggugaacacagccacugcaucccccacggagcugaaccuucccuccuucacaaucccacggcgguuccaguuccugggagauuuucagaugagcagaaccaaucuagaaacaagcgguuauggccauaucuuagacggagagagggagauuugggcaggaugagcugaagucaucauaauggcauuuauuuggcuggacaucaagcaucguggaagaggugccccgggagucaggugggggugucgccugccucaggcuccaguucccguggucuccuaugaggggucugcagugcccugcgaggccgcauggcuuuuuuaacccagccauguugaaaauguguucuggcggucagagauaauaccuuuuccuauagaacaucaugaaguacugcaaaauucaacuuuaaauaaauauccaguuugugcaaaaccagccccuaccuucaaccagauucucacauagaucaggggugucaggcccuggagucguaaaauuuggggagauaggagaggacaagaggaggagaaacugaaaacagcaacaaucccaccuaugcucaauuacuugcccugcuaauuggaagaggccuucgcagcugagggagcaagucgcuguugcugcugcaggcugcguccauccuggggcagaaggugcaagaccuccuccaccacagaggcauggaagcacugagggcagaggccacgcaggguccauuucugugccccucuuagugccuggcacguggccccauccaggguggaauggaaggaaauugaguggaauuugaggcagggaagcuggaaggagucaaacggcugaaucuuuucuucagaagccucaguuuagccauguucacucucucuucccccaaggcuuuuacccgagguaacuaaucacaaagcauuuuggccuugacaauaccaccccguauucuucaagcugugagugcaaaggcuggaagcagugggauagggauugggggguggggcaugguaauccccuggugaaauggccccaaggaauggaaacagaguucagacccuugauguucucucuaccuucccgcagcgccuggccccuggccaaaugcaacacuaacaccagcaacaacacggaggaggaguaaguacccacacacccagcagagcccuccccaagcccggugcccuccaccccauagaagccccagcuuggccucucuccuuagugcuccugcuccccacucccagagcaccaguagaauauuuuagaauccuguucccuucguuggaauuccaucccuguggacagaagucggggagggaugagaucugugugacuucuuggggaagucgucugaucucuucgccucucauuuuucucauccauaaagcaaaggaauuggaucagauaaaugcuuuaagcuuuagcacucuauaccacgauauaucugagggugcagaaccggaguuccuugacagagcacuggagauucuccuuaaugaugaaaaggcauuuucuuauucuacaaccucaggcucuugagugccagugaaaugcccuuguuuuugcugcuguuguuauuguuguuuguuuguuuguuuuugagauggagucuugcucugucacccaggcuggagugcaguggcgccaucuugacucguugcaagcuccgccucccggguucacgccauucuccugcuucagcuucccgaguagcugggacuacaggcgcccgccaccacacccggcuaguuuuuuuguauuuuuaguagagaggggggguuucaccguguuagccaggauggucucgaccuccugaccucgugauccacccgccucggccuccaaagugcuaggauuacaggcaugagccacugcgccucgccugaaguucccguguuuuaaggccaauuugggccaauuuugggggcguaaucagagcaguggaaaaaggcaauuuaaauauguccagagaauagccucuucaaagggugaccugcuauaauuccuuuuuccaucaccagauacuaagguggcagauuagggacagcguggcacuauucaggaggggaagucuuaguuggagauuagggaaaaaauaccuauaucagugagaaaugccgauuucuugacuuccaacagacagagaaaugugccaaggguuuuucuuguuauuucucucuuuguuccucagcuagaacuuuuuucuauuuucuccaugaaggaagcaugucuuuuguuugcauaaauuuggacaucaaauccagagacccaaaugccagccauaacgaaaaaugagaugauuuuaucuacaaagcaauagcuauagugauauguguuugacuuaaagccaaaccugacacuaaacacccuugcagcugcaguaucaagucuuucaggcagggaacggcuccagauacugaaaccauggacagagguccuggggguuucuaggcaucuuuguccuggggcuggggugugggcaaggauguggguggauagcgugggcugcacccggcucuucaaucuuucaauaaaugggcucacuucacugguccacuuugaagccaaggaccaagggacaaaacugggaacuaucccaaaaugaggacacacacaaaauaauuauuuaugaacaccuuccccgacucuucacuccauuucugucauuuucauauggucucauuuguccugaauaauuuuucccucccccaucaaacuguucccagccaaaaccagcagcauuuugcaguucuguguaggguucuuuuggggcagugcuggguggauuuggggaugcagccgauggugcugggucuuuccuaggcucucagcaguuugguacccagacaggccaaggcccguaauccagggccacaaaucuugcacaaggcaagcugaguccggcguaaacugcagggcaaagcucacccaaaaagcuugagggcagcgccgucugcuggugacuugacguuaagacuccagugccugaaaagagaccaggguucacaucacccuggaggacagaggagggguaacuuuccuugcucuuuucauuuaaugauuuuaauaaccuuuuauucuaauucacuuuauugaaauacucuugcugaaaacuuggaaaacaagaaaagcacacaggggcauacacacacaaaaacugcacuucaugcuaaccauggaauuccacuaucagagauagccccacuuaacauguugacaaauauacuuccaacuucuuccuaggcauauauauugaauacuuagauugauacaauauauuuuauauauacauauacuuguuaagagcaucuguuucccaacucaguugccucagagcuuugugaccuuggacaaguguauuaguccauucucacauugcuagaaagaaaugccugagacucgguaauuuaucagaaaagugguuuaauuggcuugagguacugcaagcuauacaggaagcauagcagcuucugcuucuggggaggccucaggaagcuuucaaucaugguggaaggcaaagggggagcaaggagucucaaacggcaggagcaggaggaaggugggguaggugccguaaacaaccagaucucaagaaaacucacucacugucucaagcaaagcaccaaggaauuggugccaaaccaugagaaauccaccaccaugacagggacacagauucaaaccacauaagcugguuaccuaacuucucuguguaucuguuuccuggcuuauaaaauaaggauuguaauagggucuuauuacauggugggagugaagacugaauguguuacucugugaaaagugcucagaacagugccugguacauaguaagugcucaauaaauauugacuugugugguaggcagaacaaucucccccaaaagaugucuaccauccuaauccuuagaaccuguaaacagguuaccucauauggcaaagggaacuucguaaaugugauuacauucaagguccuugagauagguaaugauuugacuuggcuguguccccacccaaaucucaucuugaauuguagcuccucuaauucccaugugucgggacagaucuggugggagguaauugaaucaugggggugggucuuucccaugcugugaauaagucucacgagaucugaugguuuuguaaaggggaguuccccugcacagacucuuugcgugccgccacguaagaugugacuuugcuccucaucugccuuccaccaugauugcgaggccucccaagccauguggaacugaguccauuaaaccucuuuccuuuauaaauuacccacccucggguaugccuuuauuagcagcaugagaacagacuaauacagguagguuauccuggauuaucagggugggcccacuguaaucacaugaguccuuaaaagcagaagagugggucagagaaaguaaauggaagaagaagagagucacagugugagggggacucgacccaucacugcuggcuuugaagauguaggaaggggaccugagcuaaggaagccacagccucgaaaggugcagccagcagggaaacagggaucucagccccacaaucgcaagaagcuggauucugcguaagauccaaacgagcaggaaucagagccccgccuagagacucugggggauggcagcccugucaacaccuugauuuuagucuggugagauccacaguagacuucugaccuacagaucugcaagauaauacauuuauguuguauaaguuugcaguaauuuguuccggcagaaauagaaaacugauccagcuauuacgguaaacucuuuuguagucugcuucuuaacuuagcaaaauauuaggaaccguuuucccacgucacuagcucuucugaaacagcguuuuaaguggccauguagaauucaccguugaggaugagccugcauggucgugugauucgguggcucucccuuuuugauugucaugaauaauggcagugauuauuuuuccacacguaucgcacacagccuugauuauuuccauaggaaguguuagguaauugugaauggaucuuuuucaaugaguguuuaauuagcagaauuuaucucucaaccaugccuuccuucagcguguggaagagagaaaucagaggggccugaaggggacucgagggguugucccuuccgcaaccuuuguuucuucaacuauucaauggggcauuacugccugccuugaagaaauuuacauguauucauuagauaacuuuauaagaguuccuagcucuuaaaagacacccaauaaagaagaggcagcagugugaagucuuauguugaagaaaaaccugcagucacaggaccauccugcggacgcugccugaaccgucucgcagcccagcaaaguccgaaggcgugucugaacucggccacauuugcgaaccugcgaccacacguauuugccacuacaugcgucacagacccgccucuucgaauguugcuucccuucugcucacuggcuuucucauuaaggcccagguuuucacuugauccagagagagguuucaagaacagcggacaggccacacccuuccauucagaacggagagccuggcgugggauuuccaaaacuccgaguaacuuucccaacuucaauguguggauuugggucuaugucguacuaccucaaaacgucuccagucucuggcuguuugugacuucccaggagcucaugaaaauagaucagaaauuguagaacauuagacugagccacuaauuucucaauguauacucaauggggugguuuaccucacgcuucaggaauaauaauaacaaaucaauaaccccauuucaucccaaugcgcuggaagcaccccuugccacgcccucucuucaggacgucuccacgacgccacacgccacgcccucucuccgggacgcagcagccugccccuuccauuugguaauguccuugauauaugaagucugcuaaaugugccccggcaucauccagcagcaaggcagaaaagaacgaagagaaaaaagaagagagaaaagcuaccuaaaacacgaggaggaaguacugaaggaagcugccucuaaagacggggugccauggucccagcaggccugaccccucccugcagggcuccagggcuggguaucuuggagcaacgcuaucagggggccuuagcuucggcccuggaggggagagggugcuuggagcugaggaaaagucggucccagcaggcugcagaccaugccuccugagaccaugugaagcccccaucuugcagaaagaauccucuccaagcuccgggaacucaaggggggcuuauaaguaaagagaguugcuugucugcagccuccggugggcagccgggggcugccccugugagccugcucaugugccccccacccgaagcauuucguuugcccucacaagugggccggccacacguaggcugagggcuucucuggggcacuggaagauacaauguucacaaacuuucacccaaauucaguggugaugagagcuguagggaacgucccaaagcccggucagugagugaccuugcacuugcagcauccaggugaaggcaggaagucacuggggucuccgauggagcacaggagcacucugcaggccugggccagcgugggucgcaugggauggcagaggggacacauggacccaacaaaaaggcagucuccaguacagccuguaaacuugaaucugcgggaaauucuaagaauaaaaguuaagcacucuaagcuauguauuucauuccgugcgggcccacgugacagguuauucccaggcuuuugauggagaggugugaugcaagcccuuggaaaugagccuuuacaucguccgcacaaacacagugagggagguggagaggguucuggagggaauacuguggggcuccccaacucuguccagagaggggcugccucagaacuauccaggcaaugcuuaaaugcauauuuccaggcccagcccuggaagaggugagugggcccugggaaucagaauuuucuggaaguuccccagacuuuagcagaccucugugacauugccaugcugcguuuucauucucagcauccugaaggguguggauguugucgugggcacaugggaaugucaucaccauuaccuuauagucgaccgugaccuccugggacugagcugggagagaaggaccucuggagucuacccuaccuccuggccugccuuccccuacagggacuccccaugugacucccuugagacuaagaggacccuguuguggacagccacaucuugggcuucagccugaaauugcccuaggcucucuaaaacccuccaaagcuacagucuuggagcacagugcgcuguuuguguauguguggguuuccaggaagaagacgaaaaagaaggaugcgaucgugguggacccguccagcaaccuguacuaccgcuggcugaccgccaucgcccugccugucuucuauaacugguaucugcuuauuugcagguaagcgacagggguggaaggugcagcggaaagggggaaaccagggcaccaggcccaggagccagagcuccaccucucccucgggaggccugaggccuggaccccucacggccaccacuuaguuauugugccucgguuucuccuuuuaaaaauagaagguuccccaagaggaccaucagagugcucugaagcauggguggggaauugagcuucagguggacagccaggguuucggcacuguggggcccccucaagugaguuguacgaggaggaugcaggggcgguugcuucucuuuggagggauaagugggugguucugaacaugcagcaggguagggaggcaggggcaagcugcuacuauuuuuuucuuuuuuuuuuugagacagagucucacucugucacccaggcuggaguucaguggcgcgaucucagcuaacugcaaccuccaccucccggguuaaagcgauucuccugccucagccacccgaguagcugugacuacauauaugagccaccacgccuggcuuuuauauauauauauguauuuuuuuuuuaguagagacaguguuucaccauauuggcuaggcuggucuugaacuccucaccucaaaugaucugcccaccuuggccucccaaagugcugggauuccaggugugagccacugcucccggccucuacuacucuucuaauaagcagaagagggauugagggccucuccuaggaaaccuguuugugaaugcagggacgagauacugcuccucuuaggggaagccaggggccugggcuuuucugagcaggccuccaggguggggccaccagagggaacguuccugagcacgcuguccaccaaggaugcaggacaagcugcugcuugugggggcuggcggggacuuuggggcauuucugaggaagccugcaggcugcaagcugcaggacaaggaggagggaugaccugcugcucucucuagguaagcaugggguuugggggcccuucccagcaggccugcuccaggacaccaaugcaggguacacuguuggucuucugaggguacacgggagggcuuaggggacuucccaagcaagugugcaggacaggugugcaaaggcaggucucuucugagaugugugggacugggaugcaugcgagaggagacgaugccucuggggcucuccggagccaguaugcaaaaugaggaugcagaggcaaguccugccuguccuucugagaguaggcaguaggcuuuggggcacuccugagcaagccugcaagacagagagccacugcucugagaggcuaguugaugaguuuuggggcauuccagauuaugccgcacgucagggaugccauccacauggaagcagaggcuuucgauuauucgagcauaggcugaucuccugcucuucggagggauugcggggcaggugaaaacuggaagaacuuggagccugucccagcgagcagacaggauggggugcuugggcaagcugcugcucucuggugcacgcgggcucuggggaggcagggcugggcacuguucuccuucaggugggcaggaggcuuuggggcgcugagcaagcagcaggugggcggcaggggcaggcugcugugcccgugaggauaggaggagagcugggggugcugccugugugggaaacagcagaaagauggagaagguagaaaauauuuacugucuguuccauuguuaaucucucggaaauucuccuauuuuuguugaacuuugaccccagaaagggcaggucuuuagccccuuuaccugacucugccaguguggccuggaaaacgguaccuccugggaucuuguagcucucugcugagaggcaauggggccgcucuuuggggucaaucccagcucuucucaggaguucugugacugugggacagaaaagcuucucagagacaucucaucagaagcgggggugauuacacugagguagugacaccgcaggcagggccauucccauauuacaugauccagcgucuuccacacagagcccgugcccacaggugggugguccacgcuccagaaacacacgcacagccauccaucucccacauggcuucuuuagggccuguuucgaugagcugcaguccgaguaccugaugcuguggcugguccuggacuacucggcagauguccuguaugucuuggaugugcuuguacgagcucggacaggugagugugccccaggccuggggaggggaccauggcccccacgggaguguuccgggagacccagcaugguggaugggacauuaccuacccuugaccaugagaggccaggcaggucuggggaccuccgacagugaggguagguggugcggccucaagcccuucuacacggaacccuuggacaggacgcugagcaggggccaggacaccuaagcucugggcucugcucuuccaacaagcuguaugaccuugagcaagucaggcugucucucugggccuuguucuugucaccucugagauaagcaggccaggccaggugcaguggcucacaucuguaauccuaggacuuugggaggccaagguggacagauuacuggaggucaggaguucgagaccagccuggccaacauggugaaaccccaucucuacuaaaaauacaaaaauuagcugggcccacuggcaugugccuguaaucccagcuacuugagaggcugaggcaggagaaucgcuugaaccccgggagguggagguugcagugaguggagaucaugccacuucacuccaaccugggugacauagcaacauucugucucaaaaaaagaaaaaaaaaagaaaagaaaagaaaagaaaaaaaaagaaaagaaguaagcaggccggacugcaaucucgaaggaccccuccagcucucacuacucgacacugggguaagcaggaaggagagcucagucaaucuuggaguuucucuucuuggacagucagcagauacaggacauguuacuccguggcuuucagaggacuuuuaacauguggagaaugaaaaucugaaauagggcccaggugaaugaggacuuccuucgaaucaucugugguuggggaugggaaaggauacucaccccuucacauuucuuaggugcugaacugugugcccuugggacaucuuuuucuaaucugcacaaagacauugccuaagcugguagaggcccuguuuccaagauuuuugaacugaaaacugugccaggccaggcaugggugcaggcaccuguaaucccagcacuuugggaggccaagacagaagggucauuugaggcaggaguuccagacuagccagggcaacauagcaagaccuugucucuacaaaaagaaaaaauuagcuggacguguuggugugugccucaggaggcugaggugagaggauugcuugagcccaggaggucaagacuguagggagucauggccucgguuuacagagcaagaccuugucucaaaaaaaaaaaaugauaaaauaaugcuaugccauagcuguugauguaaacaccagcagaucacaguagccgaccuccguguggcuccacguacaauacauuucaagugcgucuugcuucuucauuagaaccacugcaugagacaagaagcucaggugugauuaccuccaucuugcugauuuagaaaccaacaucagagacaccaagugacuuguccaaaguccacagucacugcccagccacaccagacugguccucuguuugcuuccacacuggugccuagcgucauaacuuagaagaccucagauacacaggcugaggcuugcguggguggccuagccagcccuggucaccugccccgcugcugcagucauguuaaacuccacagacacacgagcucuguaaguggcccauugggcugauggucccuggucucagcccagcuucagugggaugagacaccccgacucagucauuaacccugcaccuucuugugcuuggguaguacccuaagcaaccaagauucagcaggaagcugggagagagggaggcacaggaaucacacuccaaggaaaacaucauuagaauugagagaagacaucuuaaagaaguggggaggaggcuggaggcacaggaggcuacauaaugaucaaggcccucaguaacgcauguauaacaaauaaugcuaagaagaacugggggcugugaagugggguguucuuuguugugacagcacacuagauuuucaguuugagcagagugagacguccuaccccagucuagccucgguggccuggacccgcagcccuagcaucaccuggaacuugcuagacuugcccccaacuuccgggagccaacucuggguugcaggcuggcacucuguguuucgcacagcccucagggaaauucugaugcucaccgcaauuuuaaaaggacuaauuauauuauucucucuacuuucgugcauguuugaaaauguaaaaaacaaaaaagaaugcaggucauggccuccuuaauugauuucacccaucauaaugccccuggcucuagguguccagcccaucuccagaccagucagauucuuugggggugggucccgaacuucauauauuuuaaaagcccuuuggguaacagucacgugcaaccaaggaaagcuguguuccuggaagguguuuucaaaaggcagguugugccccauugcugacuggugaaaucaauuugggaggccauggccuguguuuuuuacauuuuuauuauuaauauuuucaaauguaugcaaaagcagagagaauaguguuaugaauccccauguacccucacccagcuccagcuguuaucagcauucugcccaucuuguuucaucuguuccuuuucuuguuucauccgcccuuuucuuguuugauuuuccuguuuuuguuuuugcucuuuuguuucauccacccuuuucuuggcuggcauaagcaaaccccaggcaguaagcacuuuagcauuuugaauagaaaauagaaugucucaggaagucaaacucacucugccaaagggaagaguuaggcuugggaacugagucaugcaaaagcugccuuccuuuucugcccagauagcuguaauuucacaugcuuacuuuaucuuacguaaaauguaguuugcauaauuuacuuuuccuccacucccuucuuuucacauguagauucacugagcgcuaaucaaagccuagcaagaauauaaccacuggccucauugccuacccacccuuucuuuucuuucuucucuccucuccugccugcugccugcucuguccccuuuaaguauugacauccucaaaacccucuuuggaaaaagcacaggccacagaucuuacugugacuuguguuucuuucuccuagguguaccuucaaccuugauaaaaauaaaccucuaaaucaauugagaucugccuccgucacuuuuuuuuuuucaaagacucagagucucacucuguugcccaggcuggaguguaguggugcgaucuuggcucauugcacccuccaccuccuggguucaagugguucucgugccucagcuuccugaguagcugggauuacaggggugcaccaccacaucuggcuaauuuuuguauuuuuaguagagacaggguuucaccauguugcccaggcuggucucaaacccuugaccucaggugauccacccgccucggccucucaaaguacugggauuauaggcaugagccacggcacccggcccucugucacuuuuugauuuacaacauguaucucuaauuuuaaaggauccuuuuuuaaaauauguauauaauuuccauuuaucuuuuaaaauuuaauaaucauucuuuguuaucauguaauacccaauuuauauuuaaauuuacucaaucaaccuauguuuuaaaaaaauucaauagaauagauuagaaccucauagaauagaaaauaucagagugcauuuccuguaguaaugguaaguguuguuuuugaaaucauuucuauuauauauguaucacugcauacuguguagccgugagguaaaauauguuucuuuguacuauggucaaaaaaagucagccucugugaugcccaaugaccuccaucuucuucuuuagguuuucucgagcaaggcuuaauggucagugauaccaacaggcuguggcagcauuacaagacgaccacgcaguucaagcuggauguguugucccugguccccaccgaccuggcuuacuuaaaggugggcacaaacuacccagaagugagguucaaccgccuacugaaguuuucccggcucuuugaauucuuugaccgcacagagacaaggaccaacuaccccaauauguucaggauugggaacuuggucuuguacauucucaucaucauccacuggaaugccugcaucuacuuugccauuuccaaguucauugguuuugggacagacuccugggucuacccaaacaucucaaucccagagcaugggcgccucuccaggaaguacauuuacagucucuacugguccaccuugacccuuaccaccauuggugagaccccaccccccgugaaagaugaggaguaucucuuuguggucguagacuucuugguggguguucugauuuuugccaccauugugggcaaugugggcuccaugaucucgaauaugaaugccucacgggcagaguuccaggccaagauugauuccaucaagcaguacaugcaguuccgcaaggucaccaaggacuuggagacgcggguuauccggugguuugacuaccugugggccaacaagaagacgguggaugagaaggaggugcucaagagccucccagacaagcugaaggcugagaucgccaucaacgugcaccuggacacgcugaagaagguucgcaucuuccaggacugugaggcagggcugcugguggagcuggugcugaagcugcgacccacuguguucagcccuggggauuauaucugcaagaagggagauauugggaaggagauguacaucaucaacgagggcaagcuggccgugguggcugaugauggggucacccaguucgugguccucagcgauggcagcuacuucggggagaucagcauucugaacaucaaggggagcaagucggggaaccgcaggacggccaacauccgcagcauuggcuacucagaccuguucugccucucaaaggacgaucucauggaggcccucaccgaguaccccgaagccaagaaggcccuggaggagaaaggacggcagauccugaugaaagacaaccugaucgaugaggagcuggccagggcgggcgcggaccccaaggaccuugaggagaaaguggagcagcugggguccucccuggacacccugcagaccagguuugcacgccuccuggcugaguacaacgccacccagaugaagaugaagcagcgucucagccaacuggaaagccaggugaagggugguggggacaagccccuggcugauggggaaguucccggggaugcuacaaaaacagaggacaaacaacagugaaaaugcagcaucugucuccugcuucacagggucgacugucagggugaccguauguggccgcagcuguguggcauggaacuuggucaggguugaauuccagcucuacucacccuuugaaagcugugugacugccugagagaaccuguuucuucaccuaaaaaaugggacuuuuugucucagucccagugaagugccagguuugauugugaaguccgcaugaaacacugcaccaggcagggcuuugcaaagugcaagguauccccaguccaaguauaugaaaacgugcacacaggacucucauuacuuuuuuauggaaucugcaagguguuuuuaggcuuuuuaaucugauuuucuuauaaaugaaagauuauuuagucaccuuucuccuguccaacuucaccaccaccugauaauggguauauaacaggaagcugaagguacaacauagugacuaaaauucagacuuacacaagacaguuugaggcauauuucuuaaucugguaucaccucguguguucuuuggggcccuagaaacccuggcuuuugggagugcuauggcaaguagaaguucugccggauggaaagaggcugccccauuugaggucauuuaaaaucugugaagcaaauccagacuccuugccguucagccacugugaaaccagaaucugcuucacagaaaaaagcaucucaguuaggagaagagacauccccuccuucucacuugccaaagagauucaaagacagccccuauccuccauucuugagucagggcccuaggugaccuauucuaacucaaggaggagagcuauguacagggagagcauuuuagauugaagguuggaaugguguacuaaaccaaaaaagcugacaacugagaguuuuagaagauuagaccauuaggaacguaucuuugcaaacugcccauucacccaugaagaggaagccucaagaucccuuggaauugcaucccaaggcaaagcuuuuggcucaccgaaagcucacagauugcagaaauuagcuuuuuuaaaaaacaaaccccaguaaauauaauuucauuaacauuuuauaacagauuuauauuuuugaguuccgugauugcaaauuaugaccucaaauuccauccuucacuuauguaacauguugcaaauuacccaaagaugagucuuucuucuuucuuuccuuuuuccuuucuucuuccuuuccuuuuuucuuucuucuuccuucuuucuuccuuuuucucucuccucuuuuccuccucaaaauguauauauuuuaaaagccuuaacuguuaguuaugccugcauucauauuugcacaggaaaaauaaagaccuggauuuaaaaaua

SEQ ID NO: 34817 - RNA, 52447 nt, Homo sapiens; identical to SEQ ID NO: 34816

SEQ ID NO: 34818 - RNA, 48180 nt, Homo sapiens
gcaggcgccguuggggugcgcauccggggaccugcagguuacaagcagcagaucccaccuucaguccuggcucugacaagcccuccagguaaggcgccuuugcauuuagccgagcuagagaagagagcuggaagccaccucuaccuuucacggggggaagggacugcccgcgcgcucgcccccauuaucucagcccuccgaagcgcgccacggacuccagccuugucucucacccccagccucaccccgcgucccugacccgcgagucucccgcccagcuccgcguccccggucccugccuccaggcgcguacacggcgcgcuaagaggcgcggggagcucuuagcgcaccuacuacuuaaccggaccggcuacuuacuggccgccagguggaagccugcgaucgagcuggccgggccucccagcaccgccgcucuccaggcucccuuuccaggacucaacuuuggucccagccccaaucgcagcuccgguaaccuuuccaggaaccgaaaugcuagauacagcggaaggagaaacggagggaggaagacaaacccggagcagggcggcgcggcaguuuggacacgccccgagcucuccugggcucucaguccccgucaggaugggaggcgcgugccgagggaggaggcugaggacacagccuccuuucgcccugcgcugcccggccuuccgcgugaccccgccuaugaccucggggcguuccgccuacgucugaccgucaggugcgcacgcgcacuuacaggcuuguuuugccagcuucacgccacccgggaugggagaaagcaggugucgcgagaguugggcgcaagacgccuuguagggaguguaacuauggccggccugcggaacgaaagugaacaggagccgcucuuaggcgacacaccuggaagcaggugagcggauccugguggagggaccccucagucuccugcgcuguugggacugguuccuuuccgggcgucacccgcacugggacaaacccucgcugccagagggguuccagcgcggugggagccgguggcuggguugugugagccgaggagauucgcucccaacguaggagaaagggcgucuggccgcaccgugcggugaugagcccguggguucgagugacggggcuggagaaacccaggcugcugcuuugccuguugcagcacccaagcugagaggugacagcgugcuggcaguccucacagcccuugcucgcucuccaggccuccucugccugggcucccacuuuggcggcacuugaggagcccuucagcccaccgcugcacugugggagccccuuucugggcuggccaaggugggagccggcucccucagcuugcagggagguguggugggagaggcgugagcgggaaccggggcugcgcgccgcgcuugcgggccagcuggaguuccgagugggcgugggcuuggcgggccccgcacugggagcagcaggccggcccugccggccccgggcaaugaggggcuuagcacccgggccagcggcugcggagggugugcugggucccccagcagugccagcccacuggcgcugcgcucgauuucucgccgggccuuagcugccuucccgcggggcagggcucgggaccugcagcccgccaugccugagccucccacccacuccgugggcuccugugcggcccgagccuccccgaugagcgccgcucccuacuccacggugccuagucccaucgaccacccaagggcugaggagugcgggugcacggcgcgggacuggcaggcagcuccaccugcagccccggugcgggauccacugggcgaagccagcugggcuccugagucugguggagacguggagaacguuuaugucuagcucagggauuguaacuacaccaaucggcacucuguaucuagcucaagguuuguaaacacaccaaucagcacccugugucuagcucaggguuugugaaugcaccagucgacacucuguaucuagcuacucugguggggccuuggagaaccuuucugucaacacucuguaucuaguuaaucuaguggggacguggagaaccuuugugucuagcucagggauuguaaacgcaccaaucagcgcccugucaaaacagacuacucggcucuaccaaucagcaggauguggguggggccagauaagagaauaaaagcaggcugcccaccaguaguggcaacccgcugaggucccuuuccacaguguggaagcuuuguuuuuucgcucuuugcgauaaaucuugcuacugcucacucuuugggaccauacggcuuuuaugagccguaacacucaccgcgaaggucugcaguuucacuccugaagccagcgagaccacggggaggaacgaacaacuccagacgcgccgccuuaagaguuguaacacucaccacgaaggucugcagcuucgcucuugagccagcgagaccacgaacccaccagaaggaagaaacucugaacacaucugagcaucagaaggaacaaacuccagacgugccaccuuaagagcuguuaacacucaccgcgaggguccgcagcuucauucuugaagucagugagaccaagaacccaccaaucccggacacaaagccaccacauucuguaucuucugcauuccauauuuggcccuuuguagcugaucacuuuccagauuucacaguuucaaaaugaugguuuuaauagauacuugaagguaucggucuuaguaaugaccugcugccuaauugccugacaaccucuugauaguuuaacaaaucuguccaaaaugagcucgccuuuguccuaugccaaauguacaaagaaagacuaauuuuaaggcauuaaaggaauaacgucaguauuuugauccuuauaauucugguuguucugauccuaguuuaugggcagugacucgggaauguauaccuaauguauuuuuaccuuuaggaaaacggaauuacuauuuuauuugaaauauacauaauaauuaccucagguaaauuaauaaauucaguuaaacuucagcugucuaugaccauaauaauuuuuacucauuuguuccccuuaagcaccaaccuuuugugagcacucuaacucaaaacccuuuggcaaauguauuucucugguccucgauuuacuaaacagaguuuaugcaaugcaguuuuaucuuuacuugauuuuaucuugagaucauuaaaaugaguuuagaugcugauaugaauuuuaguagagugauguccugagagccuauugagacauuugggacuguuugcuucuauaccaauuuauuuuacacugcuauacuuuuuuuuugagacggggucuugcucuguggccuagucuggagugcaguggugagccuggagugcaguuuuaucuuuacuugauuuuaucuugagaucauuaaaaugaauaucgaugcugauaugaauuuuaauagagugauguccucagagccuauugagacauuugggacuguugcuucuauaccaauuuauucuacacugcuauacuuuuuuuugagacggggucuugcucugugggcuagucuggagugcaguggugcgauuuuggcucacugccaccucugccucccagguucaagcgauucuccugccucagcuucuggaguagcugggauuaacagacgugggccaccagacacggcuaauuuuuguauuuuugguaaagacaggguuucaccagguggccaggcugaucuggaacuccugaccucaagugauccacccaccucagccucccaaagugcugguguagaagcaaacagucccaaaugucucaauaggcucugaggcccguugcuauacuuuuuaaguacuuacgucugcuuuuuaguuuuucugacagacuguuuuccucgcagacuguucugcaucauguuuuugaaaucuggcagcaacaguuguuuuauuguuguugcugucaccauacucuuuccaccagcuuuaauuuggggcuucuuguuuguuauagcuuugauaacccuggaucuaugcuuaauguaacugugugucauuacaaccugguaguucugacugagagcuaaaugucuuuccuacuaguuaagugcauaagcuugagugcguggacuucaugacauuugguuuucucagaacucagaaauucuuuuuuuuuuuuuuuuuuuuugagacggagucucgcucugucacccaggcuggagugcaguggcgcaaucucggcucacugcaagcuccgccucccggguucacgccauucuucugccucagccucccgaguagaguagcugggacuacaggcgcccgucaccacgccgggcuaauuuuuuuuguauuuuuaguagagacgggguuucaccguguuagccaggauggucucgaucuccugaccucgugauccgcccgccucggccucccaaagugcugggauuacaggugugagccaccgugcccggccucagaauucuuuuugcuucguccugguuuuuagcuauuuuccagauaauugcaggaucccugaguuauguuuaaauguggucuucugguacauucugucaccuuguacaaaagagaauuuuuuuucauacucuuagcuuugauuucaucaaagugauugaugcucauuaggaucuguccagauuuagguguuccugccaauaaucaauaccucugauugagguucuagauuuagcauuuuaaaaacaaaaagggaguauuuugaaaauaauaaguauaugucuuuaaaaacaaguauauucccuaguaaagugaaccuauguacaacuaguuggcaggaccuguucacuuugaauauauugcacaaacaugucuaggucaccaccaacuuuuccucacuaacaagguugauuauuauuugcuggucugguggagcuggccucuugaauccucagugcuccccacugacccccucuauggagcuuuauuuaagacaacagggguuggaaaacauuuccuguaaagucccagauuguaaauauuuuaggcuuguuuagggcaaggggaaaaaucaaggauauuauauagguguuuagauaaccagaaaacaaauuccacaaaauuuuuuaguaaugacauuuaaaauauaauaauaaguauaauauagguuuguuaaugaaagggauagaauuuggugggggaggggaugacauuuuccuuaauugcacuucagaguugguguuuucugucaucaaacugauaaauauucaucuguaaaaaccguuuguagcucacguuacugauccaaguuacaaaugauuucaaaauuuuuuugcaaccuuagccuagucucuguaaaauuuguauuauuagggcaucuguccuuauagggcauaucuuuauagaauauuuucaguuuauuucuguaacuguuauaccacuacacuguucugucacugagcacacacuucuuucuuuucucucucuuauuuauuuauuuauuuuuuugagacagacugucuguugcccaggcuggagugcaguggcacaaucucugcucacugcaaccucugccucccagguucaagugauucuccugccucagccuccuaaguagcuggggcuacaggcauccaccaccacgccuggcuaauuuuuguauuuuuaguagagacaggguuucaccauguuggccaggcugaucuugaacuccugaccucaagcagucugcccggcuuuggccucccaaagugcugggauuacaggcaugagccacugcgccuggccguuguuaaauuuuaucuaacucauuuugcugaucaguucacuccacuauauuguguauuccuuuuaguuuuuaagucacaaguuugacaagcaugcuaucauuuggaguauuucaguuuguaauagaaauguugaacaggauaaaacuguaguacuacaguuuuacuggaaggaaaaucucaaauggggaacuaaugccagaaugcagcagugauuauagaaaggaauuuuaaaaguuaagcaaaucaucuuagaaaugcagcauuccuuuuuguacccggucauacaagaaagaagccucuggaaauucaaucagauaugugacauauuugucugaaucaucaaagcuaagaaaauguaauaaauauggucacuugauugaaggacaguugcauucuccuauauuucuacugucuccaacaagguagaaagauaauuuuuuucauugaaguuauacuuuuuuaauuaaaaaaggaaaaaguaaaucuuuuuauuuugaaaaauguuaaaucuauagaaaagaugaaaaaaucacgaacaccuguauauccugucacuaacuguuagccuuuuccacacugccgaaaucuuucggcagguacauacacacccacacgcaccucuuuugccaaacuacccaaaaguagguugcagacauugugauacuuugucccaaguacuuaauugcagcuugcaccucccaagaacaaagaaauucuuuuacgcaacuccaucacuguuacaacuagaaauacaauauuaauucaagaauaucaugcaauacauaguuaauacucaaguuuuuccaauuguuccaaaaauauaccuuauauucuuuaaaaaaacaaaaauaaaaaaaaccaggagccauaugcaggagauaaucaauguuuaugcauuuguuguuaggucuuuuuagacuccccuaaccuaaaacuauccuuugaccuaucucuuucuugucaccauuaaaaucuuugaagagucuaggucagguuuucugcagaacaucuaauauucuggauuuauggacuguuuauuucaaaauagauccuggucaaacauuucuggcaagaauaucacauggguuauguugagaacaccccacuacauuacaucaaaagguacaggaugccaggacaucccacuacugggaaugccaaacaugaccacuuguuaagagggugacugcuauaucuuucaauuauaaagguucauguuccauuuuguaauuaguaagcagacacuggggugacauuugagggccuuugacuauccucuccuuaacaaucuuccagucaguuguuuuagcauccauugaugauccuuccauuauagcauagaaaguggccauuaaauuauuauuuucuaauuuuauccuuucaauauuuaauaauugucauuugucauuaaaagaagaaagauuuugucugagcucuaaaucagucacucaaacaauuuuauuauuuuuuuagaaucaaauaauuuacuucuugauucccuaacuuagauauaucugguuuuuuauucaaauucuaguauauugauuucaaaguaugggcaucuaggguucugguauuuuucucagguaagcuacauuauuuuuauuuuuuucuuaucuccuuugacucagaagagguuuguuuauauggaaugacauauauaguguuaaacacuuuaaauauauuaggaacuaauauguuuggcauauaauacaucuaaaaacauuguuucucuucuuccuuuccucuuuaccacucccaaccauaucacguuugaaaaaaaaaaguuucuuuuuugaagacuaauuugacaguucuaaggcuuauuuuuaagaaauuaaucuuggaacauaagaaggcauuuugucuguucugcaugucuugauuauuugaaaagauaaugcucacguuaaggugaacuuguuaacucuuucuauugugugugugaaaauguaaugaguauauagacucaugugucaccuaauggagguaagauaucuacuuaguauacaugccuuugguccagaucagacgcuuauccaaaagaucacuuaagucuggggagucauggucucucuuuggucugcugauaaaauuuaucugguaacccauuuaggaggucccagggcugaaaaugucuuagguuacguuaaaccuuccugguaucauuccuguuuucugaaguaggaagccaaaagagcuuccugcagcaauuuaauuugcugucaucaaguagagcauguuauaaugaugacaguuauuauuuuuuaguacuuaguagcuacgggggaucuaguuguagcuaguuuauuugauuuaucuugacguaauuuauucauuuuuacaaauugcaacacucuugauuaauaaaucugugcaugucaaugguagcaaaauaauugccuugcaaaaaguuuccucuuuuaaaacuauacuguuucccaaauuucuguauacaauaaugcauauauacaauccauggaaauucaaaaaaauaaugcuuauucauagauaaauuaguguagcagaaucaauauugguaaauucuaccucuaucacaucauuuucauaacuagagaauaaaacuguugacacuuaagauccacauguaaugagauaaauuuauacuacuuuuuucuucuuuacaccuagagaaugggacauuuuagagacugaagagcauuauaagagccgauggagaucuauuaggauuuuauaucuuacuauguuucucagcaguguagguaaguauuagaaauacauaauuuuaacaauucagaucagaugucauauuuuaacuucauuuacuucauuuacuuucauugccucugaaauuaucuuuauugugcuaaaaaauacgugacauaaauuuaccguguuaccauaucuaaguucaauagccuuaaguauauccacauuguugugcaaccaaucccuagaacauuuucaucuugcaaaagagaaacucuauacccauuaaacaacucccuauuuucccaucccccaagcccuagcaaacuuuguuucuuggaauuugacuauucuagauagcucauauaaauggaauuauauaguauuuuuuuucuugugaugagauuauuucacucaauguccucaaguugguucauguugcacuugugauaauuuccuuuuauuuaaaggcuguauaguucauuauauguauucuaggguaggagaaauuuuuccucuauucuccuaugugcuuaaggcuugugaauuaagcugacaaaagaaagacuaacaguuaaaaaaguauacaaauuuauuugauguuaauauuuuuuaaugaaaagaaacaaauaacauuaaggaauguacauacaaacgaaacuagacaacuacuaagagucccuaacacuuucauguacucacaaaaguauuucaucuuuuuuuuuuuuuuuuuuugagacggaguuucacucuuguugcccaggcuggagugcaauggcacgaucucagcucacugcaaccuccaccucccagauucaagcgauucgccugccccagccugccaaguaucugggauuacaggcaugugccaccaccccuggcuaauuuuguauuuuuaguagagacgggaugucuccauguuggucaggcuggucucgaacucccaaccucaggugaucugcccaccucggccucccaaagugcugcgauuacaggcgugagucaccgcccccaguuaaaaauauuucaucuuuuuucuuuuuuuuuuuuuuucaagacggaguuucgcacugucgcccaggcuggagugcaguggcgcgaucucggcucacugcaagcuccgccucccagguucgcgugauucuccugccucagccucccgaguagcugggacuacagacacccgccaccacgcuaauuguuuuauauuuuuaguagagacgggguuucacuguguuagccgggaugucuugaucuccugaccucgugaucugccagacucagccucccaaagugcuggaauuacaggccugagccaccgcaccuggccaaaaguauuucaucuuuacagccaucagucaauuauuuguucugcuacuucuugaagaugugcaaaauuucuuuuuaaaaaaauuuuauuauuuauuauuauuuauucauuuuuugagguggagucgcccaggcuggagugcaguggugugaucucggcuuacugcaaccucugccuccuggguucgagcaauucuugugccuuagccucccgaguagcugggacuacaggcgcacgcuaucacgcccagcuaauuuuuuuguaucuuuaguagagaugggguuucacggcguuagccaggauggucucgaucucgugaccucaugaucugcccgccucagccucccaaagugcugggauuacaggcgugagccaccccgccuggccagugcaaaauuucuuaaguuuaaauauacagucuuaauuauaccugugucuuaaugucccaagacagauuguagguaacagaaucucaauugugccucaaagaauuaacaacaaaacaaaauucaaucuauucucugcauucaggcagaaagggggagagcagagaacccuuccugcaucugcuauuucucgguugccuucaguuugagauaauuaauauggcaaaacagcagauuuuuggaguagcauacucugauugccuucaguauauaccacauuuuuuuuuuuuuuuuuuuugagacaaagucucgcucugucguccaagcuggagugcaguggugugaucuuggcucacugaaaccuccgccugcgggguucaagcaauucucugccucagccucccagguagcugggauuacagucacccaccaccaugcccggcuaauuuuuguauuuuuaguagagaugggguuucaccaucuuggccaggcuggucuugaacuccugaccucgugauccaccggccucagccucccaaagugcuaggauuacagccuagccuggccuaccacauuuuguuuagccauuuaucugucgauggacauuuggguugcuuccaccucuuggcuguugugaauagugcugcugucaauaugggugugcaaauaucucuucaagauccugcuuuuaguccuuuuggguauauauccagaagugaaauugcuggaucauauuaugauuuucuuuuuaauuuuuuaauuuuuuggaaaauugccauacuguuuuccauagcagccguaccauuuuauuuacauucucaacaacagucaggguuccaauuuuuucacauccuugccaacguuaacuuucuuuuggauaguagucauccuaguggaugagaugguaucuuguuuugauuugcaucuucuuaaugauuagugauguugaacauguuucuugugcuuucuguccauuuguauaucuucuuuggagaaguguuuguucaagaccauugcccauuuauuaguuggauuuuuuguuguugaguuguaggaauucuuuauauacucugaauguuagccccuuauccaauauaugauuuguaaauauuuucucccauuccaggacucuucuauucagugugcuaaauguauccugugauucacauucacagaaguguuaaauacugauguaguccaccuucucuguuuuuuucuuuuugagacagagucuugcuuuguugcccaaguuggagugcaauggcacuaucucggcucgcugcaaccucccgcuuucggguucaagcuaugcuugugccucagccucccugguagcugggacugcaggugugugccaccacaccuggcuaauuuuuguauuuuuaguagagacgggguuuugccauuuuugccaggcugaucucaaacuccugaccucagguaguccaccugccuuggccucccaaagugcugggauuacaggcaugagccccacaccuggcuguuuuuaucuuuuguugccucuaaccucaacuuauuuuuauauugauaaaacauacaaaaaguaaaauacaagaaucucaauuuguauugcuugauguauuuuaaccuauucacauuauuucugaauauguaguuacuaaaaaguaaaacuucaugaggaaaacuuuucaaaauauuaaacaucuauaaccauguuaaaaggaugggaugagaauauauaggaaugaucaauauugugauaguuuuuaaaggacuguuuuaggaaaugaauuuuuuuccaaguagaaacccucuaaaucuauaggcacuaauauuacaaguggucucuuuccccugagaggaauuaaggaaggucauuuuacuaaauugcuuuccauauauuuuccauauauuuucuauuuaccccaaucauccuguuuucucucacuugccaaaguugugcaugauucaguacuggguaaaaagaaaagugaaugauaaaggauauuuucaacaauucuuuauaauacauuuucaccuugcauuguguaucaguuagaaugacuugugcagggccaggcaagguggcucacgccuguaaucccagcacuuugcaaggcugaggcgggcggaucacgaggucaggaguuugcgaccagucuggccaauauggugaaaccccaucucuacuaaaaauacacuugaacccaggaggcagagguugcacugagccaagaucacaccacugcacuccagccugggccacagagcaagauuccgucucaaaaaaaaaaaaaaaaaaaaaaaaaaaacagaaugccuugugcaaauaucagaaaaagugcugaaucaguuggcuuauacuguaacguaauuuauucuuuuuuuuuuuuugagcugagugcaguggcacgaucuuggcucacugcaaccucagccucccguguugaaacgauucuccugccucagccuuccaaguaguugggauuacaggcaugcggcaccaugcccagcuaauguuguauuuuuaguagagacgggguuucuccauguuggucaggcuggucuugaacucccgaccucaggugauccgcccgccucagccucccaaagugcuaggauuacaggugugaccuguaaauuucuaaaccaacaucaacuaagaugaugggauuacuccaguugaauuuuuuagacuaaucagaauguacccucugggaucgaacauggagagaguuucucuuagaccaugaggcuuuguugaggaaguauggauaccugaauagaacugggguuccaucaagaagguggaaggggccaauggauacuguuuugguagcaaugccugcaauugauuuauuuuuccauuuuaaacacuucugguuuuuaguacucaauuaucuaaaauuauaagaaacaauuucaaauucaacagcaaaaaaagaaaauuauuuuaacuuuagauuuuuuuuuuuuuuuuuuuuuugagguggagucucacucugucuuccaggcugaagugcaguagcacgaucucagcucaccucaaccucugccucccggguucaagcgauucuccugccucagccuccugaauagaugagacuacaggugccugccaccacgcccagcuaauuuuuguauuuuuaguagagacgggguuucaccauguugccauugcuggucuugaacuccugacuucaaaugaucugccugccgcagucucccaaagugcuuggauuacaggcaucauccacugugccuggccaacuuuagauuuuaauuggcauguuaaacauuuuguuuacaaauuucuguacuccaaaauuguagccuugauuuaaaagauuaauuggugcuuucaguccuuuacugaucaaaguaacuaugucaauucaaaauacuuuaaaaugaagcuaauauuuauuuauuuuuauuuauuuauuuuuuuugagacagagucuugcucugucacccaggcuggagugcaguagcgcaaucucugcucacugcaagcuucgccucccggguucucgccauucuccugccucaaccucccgaguagcugggacuacgaugcaugccgcuacacccggauaauuuuuuguauuuuuaguagagacaggguuucacuguguuagccaggaugggcucgauagccugaccucaugauccgcccacccaggccucccaaagugcugggauuacaggcaugagccaccgugccuggccugaaaugaagcuaauaauuaaauuauguuuuaaaauaggguuuauauaaggaauguacauguacaccauggaugaaucuugaaaauauaaugcuaaggccaggcgcgguugcucacaccuguaaucccagcauuuuaggaggccgaggcaggcggauugcaaggucaggagauugagaccauccuggccaacauggugaaaccccaucucuacgaaaaauacaaaaaauuagcugggugugguggcacgugcuuguaaucccagcuacucuggagacugaggugugagaauugcuugaacccgggaggcggagauugcaaugagccgagauugcgccacugcacuccagccuggugacauagcgagacucugucucaaaaaaaaaaaaaaaaauacuaagugaaagaagacaagacaaaagaccauguauuauauuauucuauuuguaugaaaauacagauaaaacucuauagaguacaaacaaaguacauuagugguuguuuacagcuggcaggagaggggaugaaacagggugauagcugaaggguauagaguuuuuuuugaggugacaaauguguucuaaaauugacaguaauggcugggcgcaguggcuaaugccuguaaucccaacacuuugggaggcaaggcaggcagaucaccugaggucaggaguucgagaccagccuggucaacauggugaaaccucaucucuacuaaaguacaaaaauuagccuguugugguggcaggagccuguaaucccagcugcucgggaggcugaggcaggagaaucgcuugaauccaggagucggagguugcagugagccgagaucgggucacuacacuccagccugggcgacaagaaacucugucucaaaaaauaaauaaaucaaauaaaauugacuguaaugaugguugcacauaucugugauuauauuaaaacccauugugauuauauuaaaacccauugaauuguauacuuuaaaugcauaauuguaugauaugggaauuauauaucucaacagcuauuuuuaaauuuauuuuuucuuuuuuuuccuuuuuuuuuuugagacagagucucacucucaccuagacuggagugcaguggugcaaucuuggcucacuacaaccuccgccuccguguucaagcaauucuccugccucagccuccugaauggcugggauuacaggcaugcgcuaccaugcccagcuaauuuuuguauuuuuuuuuugcagagagggguuucuccaugcuggccaggcuggucucaaacuccuggccucaagugauucacccaccucggccuuccagaguucugggauuacaggcgugagacacugugcccagccucaguaaagccauuuugaagaacaggcuuuauagaauuucuugauuugcccaacauuuauuuauucauuuuuaauuuuuuuuugagauggagucaagcucugucacccaugcuggagugcaguggugcgauguuggcucacuacaaccuacuccgccuccuggguucaagcaauucuucuaccucagcuuccuaaguagcugggauuacaggcaugugccaccaugcccggcuaauuuuuauauuuuuaguagagacaggguuucaccauguuggccaggccggucucaaacuccugaccuuagguaaucugccugccucagccucccaaagugcugggauuacaggcauaagucacugcuggcugcauuugccuaacauuuaaaauugacagauaguguuggaguuaaucauuauaguuuucauguaguaaaggcuagcagaaauagugaauuuucuuuuaagguauggccaucuugaaguauucugguuuucuauagccccccuguagaugaucauuuuccuuauuccugcucuucccuucagucaauuaucuccuccaaacaacacaggauagaagccuagcacuuccugucuaacaaaauagccuuuccuccauucauuucugcuauaaaaacuuaacaaagcuuuugguuauuuccauuuacaguaaaagcacaugaguauggagaaguagauccucugcuuuuuuguauuuguuauuaugaugagggacuguaauuguauguucuuuuagucuuuauuuuucuucugauaauuaaaaucucauugccucauaaauuaggcauuuguaugcauagauuuuagguucagaauauuuuaaaauccaugccacgguucagaaaauuguaucuguaauaaugauuaaauuauuauaaguauaaauaaccuaguuugcuucuucacaggguuuucuguagugaugauguccauauggccauaucuccaaaagguuuguacauuucaaucuauuuuucccuuauagcuacaguaguaguaacucuuacguaguuaagcauuuucuaaagagucucuuugguauucuaugguuuaaucuuuacaagaauaaugagauaauaguuccuuaaaagaggcuuauaaguaaugugaccauaugcuuuauugugcaagccagaacacuuuuguagugaagagacugcuacguaaggaaaaauaggaucauacccagauagucccaggcaaagguagauguauggucaccuacucagaagccacauucauauuccaucauuaccucuucccuaauaaaaaggaaacuaguaauagucugaauuccuaaaguguguaaaugauauuuuuguggaauaauuuaacgcuuuucccauaaaauuaauuugggcuaucagguaacauuguaaagacuagaacauauguauuuuuugaugcuguuauuacuagaaggggaagagggggugacaugaauauguaaguuuguuagguagcuuaacaucaguugaucaucagguccugucaguucuaucuuaaaucuccaggaagaaacuuaacuaaaaaucaguauauaaguugguuacauaauucaucuauaacaauguuuuaguaaagguucuuaaagaguuccucuguauuuccuaaccuacuccuuaaccuacugcuaucugauuaacuuuucugcuguccugaaacugcucuuguaagguuuccaauuacuuaauuguugaucacgaaauacuuuucaguccuuauuuuaggugacaccuggauaggauuugacauuguuguccucuccuuacuuccugaaaccaccuguauuagucuguuuucuguugcuuauaacagaauacccuaaaccagauaauuuauuuuaaaaaaggaauuuauuucuuaccguuacagaggcugagaaguccuaguuugagagaccacaucuggugagggccuucuugcugguggggacucuccgaagagucccaagacaguguagggcaucacaugaugaaggggcugagcaugcuagcucaggucucucuuccuucucuuauaaagccaccaguuccacuccaugauaacccauuaauacauaaauggauucauucaugagggcacagccuucaugauccaauuguuaguuggcagaucugugucuguacaggucugcagcaaccucaauucuugccuccugaaagaaauaauucaaguaaaggacauaaugcagaaggagaaacugaggcaaguuguagagcaggaguuaaaauuuauuaaaaagcuuuagagcaagaaugaaaggaaggaaaagaaggaaaguacacuuggaagagggccaagugggcaacuugaaagacaagccugcgguuugaccuuuugacuugggauuucauacacuggcauaauuuuggggucuugcauuacuucuccccacucaccccaccccugagaucguaucaggaagcugcuaauuaccagguguuuucuauuuauuaggaggcugccuuuuccuagcacuagcugugaccaauaauuacuuuagagagcguuaacaaccgccugaccaucaccuaacagucucuccacacuccccaugugaggggcaggggagaccucuccugcccuguucauacccaacuagcuaccuaauguaacacagucacuucuuaaagguccuaccuuucaauauuuuaauaauauuaauuuaaauauuaauuuccaaaaaaugaaauuugggggacacauucaaaccauggcaccaccucuuagcuucugugacauuucucuauccuggcuuuccucuuaacucuaaugacuuauucuuaaauucuuuuguguauucuuccuuaucaguuuaucccuuguugguuuuucuaugagguuggagagagaguguguguguguguguguguguguguguguguguguucacacgugcauauguguguuuuauccuagauucugaacuuugucccauauuagauguauagccaacaauuuauuagauaaauccaugguacuuggaugaacccaggcuccucaggucuuuacacauuugucucccuuuuuacuggaaugcuuuuccucucuccaucuuucuuuugcucuccccuuucuccuuccucacugucuuuuauucacucuucaagguuuugcuccagugucaccuccucuggaaagccuucucucucucucuguuuuuuuuuuuuuuuuugcaauggagucuugcucuguugcccuggcuggcaugcaguggcgugaucuuggugcgcugcaaucucugccuuaaggguucaagcgauucuccugccucagucucccaaguagcugggacuacagacgccagcuaccacacccggcuaauuuuuguauuuuuaguagagacgggguuucaccauaccggccaggcugaucucuaccugaccucaggugguccacccaccucggccucccaaagugcugggauuuccaccuccuggguucaagcgauucacaugccucagccuuccaaguagcugggauuacaggcacccgccaccauuccuggcuaauuuuuauaauuuuaguagaaguggguuuucggcauguuggcuaggcugaucucgaacgccugaccucaggugauccugccucagccuccccaguugcugggguuacagaugugagccacugcaccuggccuggaaaggcuucucucacugucccucacaacaauuugggucagaagcuuuuccuguauacucccguuucccuuuaucauuagcccuuaauauggaguguccuaacacuguauuuacagagaguuuacuuaacuccccuacuagauugucuagauuguuaggauuguuuuuuuuuuuaauuuuugugguuuuuuuuguaaauggagucucgcucugucacccaggcucgaggucagugaugcaaucuuggcucacugcagccuccaccuccaagguucaagugauucuccugccucagccucccaaguagcugggauuacagucgugcaccaccacgcccagcuaauuuuuguauuuuuaguagagacaggguuucacuguguugaccaggcuggucucaaacuccugaccuugggugacccaccaccucagccucucaaagugcuggcauuacaagugugagccaccaugcccagcccaguuuuuacgaauuucuacuuuuugaaaaugcucuccuaaaauauauuuuuaaaggaauauaagaagaaaagaaauacaaauuuuacuuuuuacugguuuagugccauauuuucauugcuauuuugaaaauaauauuacaugaaauuauuacccauuacacuaaaaauucuuuccaugcugguagucauuggaauuggcacaauucuggagcaacgucuucucuacuaaaaagauauuuucauguaucaaaauucuuaauuucuuggcauuuagucuuuuuagucaaaauucucaaaagaaggauauuaguagugauuaggucuacucagcauacuauguugaguuuugaaaaguacucucuuuucuccagauauuuugaaaacucuuuaaagagucuugcuaucaggcccagugcugugacucacgugccuguaaucccagcgcuuugggaggccaaguugggaggauugcuugagcccaagaguucaagaccagccuggguaacgauauaagaccucgucucuacaaaaaaauuuaaaaaguuaucuggguaugguggugcuacucccuguagucccagcugcuugggagccugaguugggaggauuucuugagcaaaggaguuugagguuacagugagccaagauuaugccacuguauucuggccugggugacagagccagacccugucucagaaaaaaaaaaaaaaaaaaguuuugcuuucaaaccacuacacauuuaacauuaaaauugaguuuucauugcuuuuuugaaaauuaaaauuuuauguaacaugaaauuauuauuuucuauuuuaguagagaugacaaaugaagcuaaagguaauacaggaagaaaaugaaaaccagaguaccuaaaaugaaagauauuuuaacggcuagaacuuuaaauauuauguaucauuauacuuuugcauauuauuucuuauuuuuuucauaaagaaaaacgcaccuaaauauuuucacuuuaaauaucuuuagggaauuaccaggcacgguggcucacaccaacaaucccagcacuuugggaggccaaggcaggcagcucaccugaggucaggaguuaagagaucagccuggccaacauggugaaaccgcgucgcuacuaaaaaaaauauaaaaauuagcugugcccacgugguggcacaugccuguaaucucagcuacuugggaggcugaggcaggagaaucgcuugaaccugggagguagagguuguagugaccugagaucgcaccauugcaccccagccugggcaacaagaucaaaacuccgucucaaaaguaaauaaauaaauaaaauaaaauaaauaaauaaauaucuuuagggaacaaaaggucauaguuuuccuuauuaaauuguucuaccacuuaucuauauuuguuuaaauuuauuuccuaaaauuuaauaaaagccauuaaauaggaagauuagagauagaaucuuccuauguugcccagacuggagugcaguggcuuuucacagguacagucauaguguguuacagccuccaacuccugggcucaagggauccuucuacucuagacugcugaguagcugagauuacaggcaugggccacuucgccuggcuuagccuaccacauaugaaaaaaaguaaucuggcugagugcgguggcucaugccacuaaucccaauauuuugggaggccaaggugggagaauuccucccucccgcggcaggaggauugcuuugagaguuggaggcgggaaguucaagaccagccugggcaacauagggagacccugucucuacaaaaauaaaaaaauuaggugggcaugguggugcauaccuguaguccuggcuacucaagaggcugaggcaggaggaucacuugggccucaaaggucgaggcugcacugagccgugaucggaccacugcgcuccagccuggaugucagagugagacccugucucaaaaaaaaaauaaaaauaaaaauaaacaauagugccuuuucuaagcuaacauuuucuauuuuucugaaaguauuuuauuuucugaguuguagucauuugguucuccccuuaaguucaucaugauauguaaacccuuuuaaagugguagaauacugaguggucuauauagaacggaagaauuuauaacagguuuauugagauaauugucuaucaucuuuuguguuuuuauuaucuucuuuaugcauuugacucuugugccuaguuuuuuuaaaaaaaaugauuuacagcgcuaauggcuguuuaacguauaggguagcauaagucuaaagaauucuauuuacaagaauuaaagaauagcuuauauuauuuuucaugauguuauugcuauaugcguauauagugugugugauuaucuucuuaccaagguuuauaugaaccaaaaauuuccagucauucuuaaaaaugagccucccaagcauuuuucccuuguguacagucuauuguuagcacauuuaauuguauugucagaaguuugaaucccuuacuauaaguaauaguguuauaaaacuuauacguuagaauuguuuuuauuuuuugauaggaaaucuuacaugguaugacaaauguauuuaguuuuaaacuuuucuuggauaacaauucuuaaagcacuguaccuuuuucugcagauugauccgacagcugauacaaguuuuuugggcuggguuauugcuucauauagucuuggccaaaugguagcuucaccuauauuugguuuauggucuaauuauagaccaagaaaagagccucuuauugucuccaucuugauuuccguggcagccaacugccucuaugcauaucuccacaucccagcuucucauaauaaauacuacaugcugguugcucguggauuguugggaauuggagcagguaagguuguauguauauguuugguugugucauauucacauucauucugacauuuauggcucacuuuuaacuggucucauccccuuuuaaacucauauuucacaguucaacauacauguuucucauuguaaacaaauauuuuucuuaucauuuugccuuugcucaugauguucucauuaccuauaguuucucuucuguucucaucauucuucauccuucaagauucaguuuaaaccaggugugguggcacgugccuauaauaccagcuacucaggagacugagguagcagaaucucuugagcccaggaguucgaggccagccuggguaacauagggagaccuccaucuaaaaaaaaaaaaacccaaaacaaaaauagauccaauucaagcuccacauuuuccacaaagccaucuugggcuacccugccccuugagagauuuuuuucuucucugacaugucucuggcacuugcuuauaguauuguacuguuucuauccuuucucacuaaccagauaauaauuuuuuuuuuuuuuugaaacggagucuuacucugucacccagacuggaaugcaguggcgcaaucuuggcucacugcauccucuaccugccuggguucaagcaauucuccugccucagccucccgaguagcugggauuacaggcgucugccacugcaccuggcuaauuuuuguauuuuuaguagagacgcaguuucaccaucuuggccaggcuggucuugaacuccugaccucgugauccacucgccucggccucccaaagugcugggauuacaggcaugagccaccauucccaaccuaaacuuuuugcaauuagaaagaauuaaugauacuuuaaaaauauccuaugcccccuaacagagucucuugaauguaauguacucaaugaaaauuuucaguaaaauuguuagugcauuuuuuucuguuucuuauauuacaugucuaugcauacagaguuuguaauauuguaauacuuuucuuuuaaaaacaguuguaguaaucaaugguaugccauucacucagugcuuuuuuaguacuaaguaaguuugauauucuuuuuuuuuuuuuuucacuguugcccaggcuagagugcaguggcgugaucuuggcucauugcaaccucagcauccuggguucaagcaguucuucugccucagccuccugaguaguugggacuacagguggauaauuuuugaauuuuuaauagagacgggguuucaccguguuggccaggcuggucuugaacuccugaccucaaaaugauccaccuaccucaaccucugaaagugcugggguuacagaugugagccacugugcccggcuugguuuucuuaugauaccauuuuuucacucauugauaucuuuaacuguuuucauauuaccaaaacuaguaugguccauuaauugaugcauuugcuuaauaaaaauaccuuacaugcuuugugugaucauaaagaggaagcagugacuguacuguugaccaagauuucuucuucuguauaaagucaaauuggauugaauuuuauaagcugaaugauacuuucuuuuacuuuggauuauugugucuuguuuuuaaggaaauguagcaguuguuagaucauauacugcuggugcuacuucccuucaggaaagaacaaguuccauggcaaacauaagcaugugucaagcauuagguuuuauucuagguccagguagguguucuucacaugucauuacuugaauuugaauugggaaaacuuuugaggcuuaaauauucaguguaacccaaguauaaaaacucauagcugaagggaaagggaggaaagcuaauuuuuuuuuuaauccaggaaugaggcuacacucauuuuaucuugaugccaauccacuaaauuaagugcuauuaguccccuuuuauaguugagagugccagugcauagagaaucuaaguaaauuguccaaggucacccuuuugcugaguguuaaaaaaauuagugaggccaugcguggugguccacaccuguaaucucagcacuuugggggucuguggaaggcagaucaccugaggucaggaguuugagaccagccuggccaacauggugaaaccccaucucuacuaaaaauacaaaaauuagccaggugugguggcgggcaccuguaaucccagcuacuugggaggcugaggcaggggaaucgcuugaacucggaggcagagguugcagugagcugagaucacaucauugcacuccagcuugggcaacaagcgcgagacucugucucaaaaaaaauuaaugagauuuaguauuuccucaaggcaaauuaauuuucugcugaguaaagaaucagucauuuucaugccuagaauaauauugaaaaaccauauaauugguccauauuuugaauauugaaguuaugaauauuaucaguuugaauccaacucagcuuacuucaucauuaacaccccaucucccacccccaguuuccauuacguuccucuauuuagccaaaaagaaaaggcucaacagaagggaaucuaauucacuguucaccaaaaucuacuauuucaguuuuguacccugaaacaaauacaagcacaaauguagaauaauugaacuugaauacuauauuguaaaguacaugaggacaugguuugagucuuuauuuaccagucuacccucaguaucuagcauaauaccugguauagacuuauguucuuaguaaauauuuuuuaccaccuuaaaagcauuuuaaagauuaugucauuuaaaaauuuugcauuauagaugaguaaauguaagccugaaaagcuucgaugacuuuuccaauaauaagcccucaacaagcacuaacauuuauugugugcuuacuguaugcuagucacuguucuaaguacgguaggugcaauauuuuaguccucacccuagaguuauaugugaauuacuauagagccacauauugaaucuaaaucagaagagcaaaccaguacucuuccaauugaguuuuugccacagauccaaauuagauuuugccacuucauauuucuuuagagugcuuuauccagcaguccaaaaacacuucuaacuaauguuuaaaaucacuaaaaaaaacuucaaauacuaagguggauuauguaugcuuuuggaugaaauaauuuuuuuuuuucauuuuacuuguauauaauacuauggucaaaugauaauaaauauauacacacacacacauauauauauauauauauauauaccauauacagaauaauauuuaagauaucuggucuaaaauaugauauuuucauucuuauaaugaagcugauuaaaccuuuauaauuaauuuuuggaagaaauuguauaauuuaaauugccuauggagauguuuuguaaaaaacugagaaguuauguaagauacaauuccuugugaaugcauguaaaucaguguuucacaaccuuuuuuucauuauugucucccuaaggagccuuuuucgguauuuuuuuccuacucucuuuaccccauaaaauuuuagugccacagaugugucauauaucuuuuauguaccauauguauaucuguacauaccugcuuuauacauaaaaagaggaaauuuuuugaccccccaucaagaaccaauuccaucuguugagaaugcaugauauagaaggaugauuccauaacauuguucccaauucuguuguaaaugucuuuuucauuuuuuuauccuaugcuucucauauaauaauucaucugugaaaauuuuaucuuaauaaguuuuucagacuuguuuuacauuccuuggagaaaaaggugugacaugggaugugauuaaacugcagauaaacauguauacaacaccaguuuuacuuagcgccuuccugggaauuuuaaauauuauucugauccuugccauacuaagguaauuagauagaaaugauaaaacuauuuuuguagauugugaaauuuaaugagcuuuguaauuguuggaagauaauuauccuuaugaaguguacguaguuuuuuaugucuauaguuuguuuauauuuuuuggucagguaguacuaaagcauguaauacuggcaaccaaaagacaaccugauaaaugagaacagaaaaggaaggucuuugaagauucaaaguuuuuuuuuuuuuuuuuuuuuuuuuuuugagacaagaucuuacucuguugcucagacuggagggcaguggcacuaucucggcucaaugcaaccuccaucucccggauucaaggauucucauaccucagcuucccgaguagcuggggcuacaggugcaugccaacacauccagcuaauuuuuguuucaccauguuggccaggcugaucuugaacuccugaccucaaagugaucugcccaccucggccucccaaagugcugggauuacaggcaugaggccaugugaggcugugcccggccucaagguuuggucuugauuuacuaacuacauguugcuaaguaggggaaaggcauggaaguaacauuuuaaauagauuaauggauuuguaucagucuuaaauauaaaaguuacuaguaauguauaucucuuaucuuuuauauauucgaaaaaauuuuuuaaaauuauguuuuauuuagagugcuuuauucaauagucuaaaaacauuuauuacuaauguuuauaaucacuguaaaacuucaaauacuaaaguagaucauguaugcuuuaggaugaguuggauuuuuuucauuuuaccuguuuaugauaauuugauaagaauuguaacuucugucuuaaguuuauugguuauaucucauugguaacaguuuuauuacugaaaaaccaauaaaagaaacuauauuagaaugugaaaaaaaauacaaugccgauaauaaauuuaaacaacuucucuauuaagcauuuuauagguacaauauuuguguuuuucuuuuuaagagaacaucguguggaugacucaggaagacaguguaaaaguauuaauuuugaagaagguacuuuuaacccauuuggcugaauuaauauaacauuaucaaaguguuucuaaugauucuguuuguuugguauuuacuucgauuuugcuucugaggacaacacagugggugauuggggaagaucuucaaagcugaaagugaccuaaauuuauuuauuuauuuauuuauuuauuuauuuauuuauuuauuuuuuuuuuuuugagacagaguuucgcucugucgcccaggcuggagugcaguggugcgaucucugcucacugcaagcucugccuccgggguucaugccauccuccugccucagccuccugaguagcugggacuacaggcgcaugccgccacgccuggcuaauuuuuuguauuuuuaguagagaugggguuucaccauguuagccaggauggucucgaucuccugaccuugugauccacccgccucggccucccaaagugcugggauuacaggcgugagcaaauugauuuuuuuuaaagaggcauacccauauugguuauuugguggucaugauugacaagguuacaaacauuguaaaaaaucgcuuugucuuauuuucagagagccaguauccuaaagccuuugagauauuugcaaugauuuccauaucuuuacuaccaaauaaauaugucuauuuaaagcaguucuuuauuaucuuaaguaugaaaauggguaugguuuugccuuuuuauuuuuguuguuuugguauacuuuagaaauauacauuuucaucuuuuagaucuucucugauucauauaagccagagaacccaguaaguagcuauauuuuaccaaaaaaaaaccuguuauuuagguacuaauuauauccuccuugcggaaagaaugcaaggacugauccuggcccucaguaguucauaaaguuguggaaaagacauaguauuauuuuacuauuuuaccagguacuuucauagcucuuuuauuuaauuuucacaaaagaaauaguggaagauaaauguaguagagcagaguggugaggagcuacaguaaguuuuugaacuaggagaaguuugacauugauuccaugcagaggcuaauccagauugguuauaucucacugguaauaucucauugguaacaauuucauuacugaaaagccaguaaaagaaacuguaucaaaugugaaaaaaauacaaugccaguaacaaauuuaaacaauuucuuuauuaagcuuuucauagguacaauauuuguguuuuucuuuuuaagagaacauuguguggaugacucaggaagacaguguaaaaguauuaauuuugacuaggccugaaguagggcagugacugagaauggagaagggauaaguaggaguuguugaaagaggaaucaagauagagauuuggauagagaauauuaaggauuagagaaagccaacauugcugccagguuuugauucuagaucaccuggaagaaugagagagaacaagaauuuaggaagggagguuagaugaaaagagaagaugauuucaauuuggaucaagcugaauaugcuguuacucuagaacaacuaaaaaaucccacaggcauuuguaauuuugacaguagaaauaaaagcuagagauaaaaauuuaugagucacccagugaaacacacuauggcagcagaaagggagugagagaaaggauggcaugaugauucaaguguggcaaaagauuguugaaucugaggaaugaauaugugagaauauguuugaaaacuuucaaaauaaaacacaaagaaugagaggugaagugccagcagugcguauaaacuccuuuuuucaaagguaaaaaauaggaugcuaacuucaaggagcuaucagguaaagugacggaggaaguuaagagggugagguagagguaugacaaagggaagauauguaaaaaucaguauuucagaacuuggaaggggauaaugauauacaucagugcuucauuuacuuuaaugugcuuagaaaucaccugggaaccuuguuaagaugcaaauucugauucauuaggcuuagggugauacuuaauaggguugccuguaaaacacaggauguugcuucucagaauaggggaguuaauaaagaaauauaaaaauauauaauuuauaauaaaaaauaaaacacagaaugcccaauuaaauuuuaauaauguuuuaauauaaauaugucccacccaguuaaauuuggauuucaauaaacaacaaauaacguugguuuuuuuuucuuuaauagagacaggaucuugccauauuguccaggcuggccuuaaacuccuggacucaagugaucugccucccugggccucccaaagugcuaggauuacaggugugagccacugcaccuggaaacaaauaacuuuuaguauuaauacaauccagcugggcacaguggcucaugccuguaaucccagcacuuugggaggccaaagcagguggaucaccugaggucaggaguucaagaccacccuuggccaacauggugaaacccugucucugcuaaaaauauaaauauuagcugggugugauggcaggcgccuguaaucccagcuacucaugaggcugaggcaggagaaucgcuugaaccugggaggcagaaguugcagugagccgauaucacgccacguacuccagccugggugacagagugaggcucugucucaaaaagaaaaaaaaaaaguauaaauacaauccaaauacuucauggaacauucuuauacuuaacuuucaaauauggcacagaacauauuuauauuaacacuuauuguuuaucugaaauuuaaauuuaacugggucuccuguauauuuacuaaaucuggcaacccuagugagaugcugagcaucuacauuuacaacaaacuaccaugugaugugaugcuucuggucuacaaaucacacuuugugcagcaaagauugagagcuaugcugcccaauauaguagccauuagccacauguggcuauuuaaauaaaguaaauuuaagaaauuauuuucugucauacuagccacauuucaagugcucaauaauggguauauguggcuaguggccacuguauuagcauagauaaauaacauuuccgucaugucacaguucuguugggcagcacuguucuaaaguacaaaugggaaugaguuuagagaagauguaguguuuucuuuuaugagauuucuaguuacuucaaaauaauuuuuauaaaauaaaauuuuuaaauuucaauaaauguuugcauaaaauaugucugguaaaaacuuccauaauuguuuuaauuuaaagcuauucaaauuuaaagagguuauuaugagacaggauuauaauuucuaauugcauagaauuugaauccauauacuaauguagucuuuuaaaaaauguguaauuaggauaucuagucaauccccauagucuaggaugcaacauuucugagauaccccacugaagccaacacugaguagaagcuauaggaaacuaaccacauauuaugaagcaaacuccagucugacuuggggcaauauugauacugacuugaaggaguaaagacugacuucuagguggugauuaagaaucagagaggucuauccaaaauaguacaagagccacaaccaucagggccuaccccuggcaaagguucuggacaaagguggccaguucucuuugugugauuacaaaggaaggucauaaggcuauguugagcauccaaggugcuuaauucccuuuaaguauagcagacuauuuccaaaucuacuuauuguuggaggaggaacuccuucucaagaauccugagauagaaaagcaggcauuauuaugaaaaaaaucauagaaacuuacugcaucuuaggaaagcccccccacccacccacuaacaacaacugacacuacacacaauuuaagauagcauaaauaaacauauuuuuguaauauuuuauguauuaauaccuggcauaggcugggcgugguggcucacaccuguaaucccagcacuuugggaggccgaggcgggcagaucacgaggucaagagauugagacuauccuggccaacauggugaaaccccaucucuacuaaaaauacaaaaauagcuguagucccagcuacucgggagacugagacaggagaaucgcuugaacccgggaguuggggguugcauugagcagagaucgggucucugcacuccagccuggcaacagagcaagacuccgucccccccgccaaaaaaaaaaaaaaaaaauaccuggcuuauuuugguauuuauuuguguaaaaauacuauuuuauucugaauaaguggauaaauuacaaaacagugugaugaauauauaugaguagauuaauaugucugcaugauucucaguuacaucaagaauagcuuaauguguauuaaccuuaaggcguuguucaagaugagaagucaguacacuuacuuuguccuccuuauuuauaaaaccaccgucaaauccugauuauuucuuugcagaaauauaaaugauagggguuuuuaaaaugguaaugauaacauaaggaucuuuacgaauacuaauuucuuguuauuuauuuauuuauuuuuugagacagggucucugucacccaggcugaagugcaguggcucaaucuuggcucacugcaaccucagucuccugguuaaagcaauucucgugccucagccucucaaguggcugagauuacaggcauguggcaccacgcccggcuaauucuuuuuuguauuuuuaguagagaugggguuuugccauguuggccaggcuggucucaaacuucugaccucaggugauccaccugcacuggccucccaccugcuguaauccacauguaauccacauguaaaccacauguaaucccaccugcugggauuacauguaugagccaccacuccuggccaugaguacuaauuucauguaacacugaaauucaaaauauauauccauuguaguaaaucauagaacugggaacugauuuaauaaaccacuggaguucuucaugaaauucuuguaagucuaagauuuaaguaagguggaaaaaaucugcaguugaaauuuaaagcaaauauauuuaguaugagaucacuauguuaacagaguucuauaaauuacauucccauuuuuggauugagauauaccaaguacaaaauacaucugaguauuucuuaagauaacaggauugaaguauaucucuggggaagaaaauucaccuugcuuuuaaaugccauuuaaaaauuauuucugucauauaaauuaucuuauuguuggccaugcacaguggcucacacguguaaucccaacacuuugggaggccaaggcgggcggacugguugagcucaggaguucaagcccagacuggguagcaugaugaaaccucaucucuacaaaaaauauaaaaauuagcugggcgugguaguacaucuguagccccagcuucuugggaggcugagguaggaggaucaccugagccuggggaggucaaggcugcagugagcugugaucaugacacugcacucuagucugggugacagagugagacccugucucaaaaaauaaaaauaaacaaauucucuuauuauuaaacuacuuugaagccuaaaaauuuuuuuaaauguuuauuuauaaauuuugcuacaauguaauuucuacauuacuuuaaugucauaagaaaaauuagauguauagguaauguaauuuuucuccuauuucccuauagcaaguacagaugaagcucagguuccccaaggaaauauugaccagguugcuguuguggccaucaauguucuguuuuuugugacucuauuuaucuuugcccuuuuugaaacguaaguuuuauuccaucuucaucugaaucagauuauguuuuaaccuuuauuucuuaaugcaauguuaauuaggcauauagauguuauugaaaaucuuauguaaggcaaauuuuucuuaccaugauguaaaaaauguauauacauuuuguugcuuguaacuugaauguaguuaauuauuuguccauaaucuuaacuaccuuaucuuauuuucuuauaaaagaaucuguuucacuacucuuucccucuuucaucugaguuuuaugauaaauacaguuauaaaacuuuagugccaugauuuaauuauccuuaagcucuauaauuuccuacauauauguauauauauauaugauucaaucugguaauuuuaacucaauuuaauaccugaccuugaagaaaaaccuaguauauuacaaaaucucugccuugugcaggcuuuauugaccuuuaucauauggcuguuuuauuuuuaaaauaacuuuccaugaaauuauaaaaauaguacauucaaaucccaaauauuacaacuguauuucuauauccacuccuuucugugaaaguaaccacugcuaauacuuuaguuuguguuuuuucaaacauuuuuccuauguauguauaagaguguauguauauacauguaucuauuaaacuuacauagauuaugugauauuaucauuugacaacuugguuuauuuacuuguuaauacauugugucauuuuuauguuaguacuuguagguuugcuugguguuuuuauuuucaaaauuauugagauauaugaaaguuccagcucaccugauauuuuaggggcaauuuuuuauugugggaaaauauacauaacauaaaauuuaucguguuaacuuuuuuuguuuuguuuugagacagggucucacucugucacccaggcuggagugcaguggugcaaucacggcucacugcagccuugaccuccugggcucaggugaccuuccagccucagcccucuaaguagcugggaccacaggcaugcgccaccaugcucagcuaauuuguuuauauuuuuuguagagacaggauuuccccauguugcccaggcugaucucgaacuccugggcucaagugauuugcucaccuuggccucccaaagugcugggauuacagacgugagccuccgcgccuggcacuaucauguuagcuauuuuuaagguaugcaguucaguagcauuaagugcauucacaauguuguacaaccaugaccacuagcuauuuccagaauguuuucaucauccuaaacagaaguuccauacccauuaaacaguaacauaccaauuaaacaauguuaaauaaauuucagacugggugcgguggcucacgccuguaaucgcagaacuuugggagguugaggcagguguaucacuugaggucaggaguucaagaccagccuggccauauggugaaacccugucuauacuaaaaauacaaaaauuaacuggguaugguggcaggcgccuuuagucccagcuacucaggaagcugaggcaggagaauugcuugaacccaggagauggagguugcagugagccaagaucaugccacugcacuccagcccaggugacagagugagacuuuggcgucucaaaaauaauaguaauaaacaauaaauauaaauugcauuuuguagucaguuaauagagaucgaauguagggagagaaacuuggcaaggaaggauauagucauauaaaggaagagacauugagaggcaaagagaaaaauauauauauucaaaaauccaguauauucugauaacuuaauauaacauuauugcauugaaagagaccaauuuaauuaaaaauauaaccaugauuauuuaguaauguuagaaugauaggcauuaugauugguguggcuuguuuccuuuuccuuuguuucagacuuucuguaauauggcuauauuaguuauauaauuaaaauaaacauuaggaaguaaaauaugaguaggcagacuuaguaacuuagguauguaacaacaaacgcuuaaaauguguucaaacuuuugcuuaggucuguugucauugcuaaaaggcaugcacauucuugaauguguagaugucguuauuaaaacuuacacuucacuuuaaguauaacaguuacugugauuuaaauaaaauaagaauaauuuuuuuuuucuuagcaucauuacuccauuaacaauggauauguaugccuggacucaagaacaagcuguguuauauaauggcauaauacuugcugcucuugggguugaagccguuguuauuuucuuaggaguuaaguugcuuuccaaaaaguaaguuaaguguuuuugguuuuaugucuguuuuuaaaaaauaaaacaaaaaacagagcuaacaaugcaaauggauauaccaggaaaauaauuuaaagcuuuuuuuugcacacaaauuuacaauuuauuaagagauuaucauauuucuauacauuacagcauuucuuugguaaaacaaaauuucucacaaaguauauaauugacucuuauuuaucuuuugucuacuauguuuuccugaaaguauauuucauaaaccauuguucuacuguauuguaauauauauugugcaacaaaaaagauucaugguuaaguuuggaaaaucuugguuaagauuaccaaacuuauucuagaacuucuauccauaguauauauauucuauaucaucaucauggcaaauaaaauuugugucauuucccagaccacacaacacucuuuuuuuuuuugagacaaggucucguauuguuacccauacuggaaugcaguggugcaaucauggcucagugcagccugaugggcucaagagauccucucaucucagccuccugaauagcuggacuacaggcaugaccaccacaccuggcuaauuucuuuuauuuuuauuuuuuguagagauauuaucucacuauguugcccaggcuagucucauuccugggcucacgcaauccuccagccucagucucccaaaguguugggauuacaggcaugagccacugcgcccagcauaaguguuuuuuaauugauacaugauagauguacauauguuugggguaugagugaucauuugauacauucguauaauguauaaagaucaaaucaagauaauugggauaccaucacuuuaaauauuuaccuuuucuuuaugcuaggaacauuugaauuacucuuuucuagcuuuugacauguacacuaaauuauugcuaacuauagucacccuacugagcuauugaaaacuaggucuuauuucuucuaacuguguauuuguaccuauuaaucaacuauuguuuauugccuccuucccgcuauuauucguggccucugguaacuaccaaucuagucucuuucuuucuuuucuucuuuuuuuuuuucuuuuuguaaaagauggcgucucacucuguugcccagaauggaguggaguggagugaucauagcucauggcagccucagacuccugggcugaagcaauccuccugucucagcuucaugaguaguuaggacuacaggcaugugccauaaugccuggcuaauuuuuuuuuuuuuuuuuaacuuuuuguagagacaagaucuugcuuuguuuccugggcucaccaaucuacucucuaucuucaugagauucuuuuuuuuuuuuuuuuuuuuuuuuuuugugacggagucucgcucuguugcccaggcuggagugcaguggcacgaucucagcucacugcaaccuccaccuccuggguuccagcgauucucacgccucagccucccaaguagcugggacuacaggcacaugccaucacaccuggcuaauuuuuuuuuuuauuuuuaguacagacggauuucaccauguuagccaggauggucucgaucuccugaccucaugaucugcccgccucagccucccaaagugcugggauuacaggcgugaaccaccgcugccgaccugagauucacuuuuuuagcucccacaugagugagaacaugugauaauuugucuuucugugcuuggcuuauuucacuuaacauaaugaccaugaauuccaucuauguuaccccaaaugauggcauuucaugguuucaauggcugaauaauauucccauauauauauaccacauuuauccauucauccauugaugaccacuuagguugguuucauauuuugacuauugugaauaguguugaaaugaacaugggagugcagaugugucuuugauauauugauuucauuucuuuuagauauauaccuaguaaugggauugcugguucauauggcaguuccauuuuaaguuuuuaggaacuucuguacuguuuuccauagugguuuuacuaauuuacauucccaccaacaguauacaaggguuccccuuucuccacauccucgccagcauccauuauucccucuuuuugauuaaagccauuuuaauuggguugagagaauaccuaauugugguuuugacuugcauuucucugaugauuagugaugucgaacauuuuuuauuuacuuaguggccuuuuauaugucuuuugagaaugucuauucacuguuuaaaagaaucauuuugagggccuggugcaguggcucaugccuguaaucccagcauuuugggaggccaaggcagcuggaucauuuggggucagcaguucgagaccagucuggccaacauggugaaaccccauuucuacuaaaaauacaaaaauuuuucuacuaaaaauacagggcgugguggcacauuucuacuaaaacaaaaaaauuuuucuacuaaaaauagagggugugguggcaugugcguguagucccagcuacucaggaggcuaaggcaagagaaucgcuucaaccugggagguggagguugcagcagugaaccaagaucacaccacugcccuccagccugggugacagagugagauuucaucucaaaauaaauaaauaaauacaaauaaauaaaagaauaauuuuggccagguauggugacucacaucugcaaccccagcaauuuaggaggcuaaaaugggaggaucauuucagcccaggaguuaguuugagaccagccugggcaacauagugagaucuuaucucacuaugauauaaugagaucccuauuucuucacagacacacacacaaacacaauuagcuggguaugauggagcacgccuguagucccagcuacuugggagguugaggcgagaggauugcuugaacccaggaguuugaggcugcagugagcugugauuguaccacuacacuccagucugggugacagagcaagacccaucucuuaaaaaaagaaucauuuuguaaaaguacaacuguaaggaacauauuuuuagggaaaugcuuguguaaaauuaaguucagucauauagucuaugguggaacauuaguugaugaauuuagacaguucuauuuaaguauuccucaaauacagauacucuuuaacuugcaauggggcuacauccugauaaacugaucaucauaaguugaaaauagcacuaaguugaaaauacaggcugggugcaguggcucacgccugcaaucccagcacuuugggaggccaaggcgggcagaucaccugaggucagaaguucgagaccagcccggccaacguggugaaaccccgucguaacuaaauacacaaaaauuagcugggugugguggccagugccuguaaucacagcugcuccacagguggaggcacaagaaucgcuugaacccaggagguggagguugcaaugagccauugcauuccagccuggaugacaagagugaaauuccaucucaaaaaaagcgaaaaacaaaaaaaaaaaaacauuuaauacaccuaaccuacggagcauuguagcuuagcuuagccuacuuuaaacacacuccaacacucacauuaguuuucaguuuggcuaaaucaucuaacacaaagcguauuuuauaauaaaguguuggauaucucauguaauuugccaaauacaguauacuguagauuauaguacuggauguuuaccuuugugaucauguggcugauuaggagcuguggcucucugcugcuguccagcaucaugaaacaguaucauaccacagaucacuagucuggaaaaauaucaaaauucaaaauuugaagugugguuucuacugaaugaguaucacuuuccuacuguuguaaagcugaacaguucuaaguuggacacucauaagucagagacuguauguacuuuaauaagguucuaaaauuaaucaacaaauguuaagucaguguaucagguucagugcuauggggguacuaugagaauucuuguccuuauggagccaaguagagggaucaagauauaagauagacauauauuuauauucaaaguuaauaggaaguacauuacaucuugcuacagaaguagagcagugcugcugauacacauucuuauagaauguccaauaccauccccucaaagcacguguauuccaguagggggaaagccaauaaacacaaaugugaagucagauagugguaaguacuacaaagaagaauagaagagaaaagaauaaggagugacaagggcagggcugggaaguggggaaauguuguauuugauacacugcucaaggaagguauauaugaggaaguuacauuuaagcugagaccuuagugaagucagcaaagagccaugcaauggccuggauggucucgaucuccugaccucagaugauccguccuccucagccucccaaaguacugggauuacaggcgugagccaccacacccagccuuuauuauacuuugaguucuggaauauaugugcagguuuguuacauagguauaaauguacuauggugguuugcugcacccaucaacccaucaucuacauuagguauuucuccuaaugcuaucccuccucuagccccccaccccgcaauaggccccugugugugauguuccccucccuguguccauguauucucuuuguucaacucccacuuaugagugagaacauguggcguuuguuuuucuguuccuguguuugcugagaaugaugguuuccagcuucauccauguuacuguaaaagacaugaacucauccuuuuuuauggcugcauaguuuuccaugguguauaugugcuacauuuucuuuauccagucugucauugaugggcauuuggguugguuccaagucuuuacuauugugaauagugcuguaauaaacauacaugugcaugugucuucauaguagaaugauuuauaauccuuuggguauauacccaguaaugggauugcugggucaaaugguauuucugguucuagauccuuggggaauugccacacugucuuccacaaugguugaacuaauuuacacucccaccaacaguguaaagguguuccuauuucuccacauccucuccagcaucuguuguuccccgacuuuuuaaugauugccacucuaacuggugugagaugguaucucauugugauuuugauaugcauuucucuaaugaccagugaugaugagcuuuuuuucauauguuuguugguugcauaaaugucuucuuuugagaagcaucuguucauauccuuugcccacuuuuugaugggguuguuuuuuucuuguaaauuuguuuaaguuccuuguagauucuggauauuagaccuuuaucagauggauagauugcaaaaauuuucucccauucuguagguugcuuguucacucugaugauaguuuauuuugcugugcagaagcucuuuaguuuaauuagaucccauuuaucaauuuugguuuuuguugccauugcuuuugguguuuuagacaugaaguccuugcccaugccuauguccugaaugguaaugccuagguuuucuucuaggguuuuuaugguuuuagguccuauguuuaagucuuugaucuuucuugaauuaauuuuuguauaagguauaaagaaggggcccagucucaguuuucugcguauggcuagccaguuuucccaacaccauuuauuaaauagggaauccuuucccuauugcuuguuuuugucagguuugucaaagaucagaugguuguagaugugugguguuauuucugaggccucuauucuguuccauuggucuauauaucuguuuugguacaagaaucaugcuguuuugguuacuguagccuuguaguguaguuugaagucagguauugugaugucuucagcuuuguucuuuuugcuuaggauugucuuggcuauaugggcucuguuuugguuccguaugaaauuuaaaguaguuuuuuucuaauucugugaagaaagucaaugguagcuugauggggauagcauugaauccauaaguuacuuuggacaguauggccauuuucacaauauugauucuuacuguccaugagcauggaauguuuuuccauuuguuuguguccucucuuauguccuuuagcagugguuuguaguucuccuugaagagguccuucacaucccuuguaaguuguauuccuagauauuuuauucucuuugcagcaauugugaauggcaguucacucuugauuuggcucucuguuugucuguuauugguguauaggaaugcuugugauuuuugcacauugauuuuuuauccugagacuuugcugaaguugcuugucgcuuaaggagauuuugggcaccacuggucccacagaaauacaaacuaccgucagagaauaccacaguauucucuaauacuauaaacaccucuaugcaaauaaaauagaaaaucuagaagacacggauaaauuccuggacacauacacccucccaagacuaaaccaggaagaagucgaaucccugaauugaccaauaauaaguucugagauugaggcaguaauuaauagccuaccaaccaaaaaaagcccaggaccagauagauucacagccgaauucuacuggagguacaaaguuuccauuccuucugaaacuccauuccuucuguaacuaugccaaaccguagaagaagagggacuccucccuaacucauuuuaugaggccagaaucauccugauaccaaaaccuggcagagacacaacaaaaaaaauuuaaggccaauaucccugaugaacaucgaugcgaaaauccucaauaaaauacuggcaaacccaggccaggugcgguggcucacgccuguaaucucagcacuuugggaggcugaaguggguggaucacgaggucagaggucgagaccauccuggccaacacagugaaaccccaucucuacuaaaaauacaaaaaaaauuagccaggcgugguggcaggcaccuguagucccagcuacucaggagacugaggcaggagaauggcaugaacccgggaggcggaguuugcagugagccaaguucacgccacugcauaccagccugggcgacagagcaagacucugucucaaauaauaauaauaauaauaauaauaauaauaauaauaauaauaaauaaaaauaaaaaauaaaauacuggaaaacugaauucagcagcacaucaaaaagcuuauccaccacgaucaaaucugcuucaucccugagaugcaaggcugguucaacauacacaaaucaauaaauguaauccaucucauaaacagaaccaaugacaaaaaccacaugauuaucucaauauaugcagaaaaggccuuugauaaaauucaacacuccuucaugcuaacaacacucaauaaacugauauugauggaacguaucucaaaauaauaagcgcuauuuaugacaaacccacagccaguaucauacugaaugggcaaaaacuggaagcauucccuuugaaaaccggcacaagacaaggauacccucucucaccucuccuguucaacauaguguuggaaguucuggccagggcaaucaggcaagagaaagaaauaaaggguauucaauuaggaaaugagaaagucaaauugccucuguuugcagaugacaugauugcuguauuucuuaaaaacuaguacuugcaucuagaagcuugaugaaauuuggguucaauuuuuuggcaagaauacuuuauaggugggaauaugugcuuauaucagaagaaauauaauguuuuguuuaucucuucuuaacauguaaguagccacugauuauuccauagauccauuaauucauuaaugaaucauuacaaaauucugguauuuuaauucuaucauuccuuuauuuauuugcuagaauacuuaccaugaagagaaucuuucccucaccaacuauuugguuaaccugagcuauaguuguauaggaaaggcaggauaaaggcuugauuauuuucuuuuguuucccuaacauccucaaaaacugaccaaagaguacuuuauuuuaauauacuaugaauucauagauuauaacacuuuuuuuuuuuuuggcgacagggucuugcucugucacccaguuuggagugcaguggugccaucacagcucauugcagccuugaccuccugggcucaaguaauccuccugccucaaccuccuaaguagcuagaacuacaggcaccaaauaccacuccuggcuaauuuuuaaaauuuuuuguagagauggggucuugcuauguugcccaggcugguuuugaacuucuggcaucaagcaguccucccgcuuuggccucccaaaguacugggguuauaggugugagccacuacaccaggccacagaugauaauacuuuuuguguguuucaauccauugccauuauuauucuguuuugguacucacauugucacauuuuuggccagcuucuucaaauuggcugagucaaaaagacucaugaccuaguagucacugauaacuucugugcuuuuugcugugaaagaucugagcucaucuacuuuuugugucccagaccuuaagucagccauuuuucagaggaguccugguuauuuuuaguggaaaauuauauuuagcauucuuuuuaauggauauaucacuaaaaguacaagauauuauuuuuaguuuuuaaaauuaugaaaguaaugaagcuauguuauaauguuucauuuuaaaauuacagaguuucuguucuuuaacaggauuggcgagcgugcuauucuacugggaggacucaucguuguauggguuggcuucuuuaucuuguuaccuuggggaaaucaauuucccaaaauacagugggaagguauagccauacauaauucuauaauguuaaccucuguuauuuaucuaaaaucaacaaguaaugcacugcaaugguuuuguuuuuacagauuugcacaauaauucaaucccuaauaccacauuuggggaaauuauuauuggucuuuggaagucuccaauggaagaugacaaugaaagaccaacugguugcucgauugaacaagccuggugccucuacaccccggugauucaucuggcccaguuccuuacaucagcugugcuaauaggauuaggcuauccagucugcaaucuuauguccuauacucuauauucaaaaauucuaggaccaaaaccucagguaagccagguacccugacauugcaauuauagaaaauauacuuguaagcacucaacauuuuuugcugccauucucuauuuuuacacagacugauuugagggauuuuuaucauauucagcauuuaaaauuuuuaaaaaucccacaacuucuauaaaguucauucuuggguagguuauguggguuauaguuuuggauacagaaguuguaggaguggcauugugguagaguguaaaguggcacaguggagucagccaaauauggcuucaaaccucuugaacaaguuacuuaaacuuucugaguuucagcuucuaccuuuguuaaacaggcauaacaccugucaucgaaacuugugaacauuacaaaugauguauuuaaagcaccuaccucagugacuggcauguagcagguacaaaauaaauguuagcuuuaaaagguauuuuaaucaauuuuauuauucccagggcuucagcagacaguaaguuuuucccuuuacacuccuuuuauuuuuuuuaaucugacuuaauauuaaaugcuauauuuauaggaggcauuuuauguuuaauuuaaaaguaaaagaugcagaaaugauucuuguaaguuugcuguaguuugguaauaccauuucuuugcuuuuaaauaacuaaaccccaauaucaaucugcuuguccuccauuucacccccaacaggguguauacaugggcugguuaacagcaucuggaaguggagcccggauucuugggccuauguucaucagccaaguguaugcucacuggggaccacgaugggcauucagccugguguguggaauaauagugcucaccaucacccuccugggagugguuuacaaaagacucauugcucuuucuguaagauaugggaggauucaggaauaaacuagcuaagacugugauggaaacuacuugcuguguggcacuuccuggucuaaagcucugcuagacaauugcggugagccagucuccaagaaucagacuacagauauugcagauuuugaagaacaagaacauauguugaauaacagagagaauucuacaugucauugugaauaguagguuauauaaaaacauacuagaugauaauuuccuuaccucagaaaugaaauauuauucuuauaauaccuuuuugugguugcaugaacuaaugagugaauggacaaugaugaauaaaugugaagcuguauucuuaauacccacugcagaagugucauuaaaauaauauacaguggaaccagaaagaggguucuguaagaauuagccauagcagaacaaaauuauagaauuuuaaauaccucuacccaaguagagguauuuuuauucagacaccuacuuuuuauuuauaaaaaaaugcauuuucuauuaucaaguucacuuaugaaauaaaaauuauaacacauauuuuccauuuagcgugccuaacauccuaccuugccuucuaugagucuuucuucuaauacuacaccucugccuuauuuuaguucaggguuucacuaaguaaccccuacauuaauaaaugaguauggauaaugcuaauauuugagcaauacagaggauuaagagaucaagauacuucacugccuauuagccuaauagggauaccuacuuucuuucaaaugccaaaaauucacauuagaaacauaauccagauauguguuauuuuauauauauauauacaaaacaguaaaugguuucuuaaaauuauugcuauuuuucaacccccuuaaacuggagaaaaacauuuaauuaguaaaacauuaauuaauuuacuuuaauuuuucccaucucucaguaguggcggggaggaacacaacaguuuucaaucuaugucugcauaguuguguagagcugcagaauuuuaguuggauuuuuaauuuggaugaucccugacagccccaaacuagucaggcuaauaaguauuugaggcaaaauggcuuuaaucuaacaauuuacugaguuuaccugaaguuggcuaaauaacacuguauguuuaacuucuaccucuacauaaguugaaugcugauaaaaggaacuaguagauaacuauguauauugauaagcacuguuaagaaaaugcaaaaauauuucuaaacacuuuuccaaauguuuucuacuuuaaguuagaaauaguuucaaaucugagaauaaacacuauauaaucugcacuuuauagguugggugcagugucucaugccuguaaucccagcacuuuggaaggccaaggcaggaggauugcuugaggccaggaauucaagaccagccugggaaacaaagugagacccugucuuuacaaaaaauaaaaacaaaaauuuaaaacuguauaaucugcacuuuaugcuaaacuagcugugcucuuaaacucaauuuuuucagcucuaauaaagggcuuaauuugauagaauuauucuacgauuaaauuuugaagacuguuuucacucuccucugccgcccauagcaagacugcuuccauagauuucucagaaccguagccaguucuggcuauuuggucaagucugggaucccucuuaccugcuauucugcagcugcuuucucugucuuacauuuuuugggccacgucuaaucuuaaagaguaaacucuacccuugguuugcauagugugcaugacaaaaauaacaagaauaaugguaaugaugaaaaugauaagagcaaaauuuguggagugcuuuccacauuccagguaauguguaacauacaauuuaauucuuacagcagucuuauggagugaaaauacuauuaugauucccguuuuacagaugaaagaauggaggcacagaaaaguuacuugucuaaguaacagucuauccuuaaaguccacagucuuaaccacuugauuuuucauagugaggaaaauaucccagaaaguugcaguuucaauuaaucacuaauuguaggguaauuuaacuauaccagugaguccuacuagcagaaauauuugggcaacauaagcccacugacuggagcuuuugucuuagcauaauaaccuguuuccagcaagaauauaacagaaaaaaguuucccagcuuucaaagguuuauaauauugauuaaaauuuagauaaacuuaaccuuacacaaaugacucuuacuuuccuuuuuauugagagcauuuucuuuggagcauuuucuucuuuggaggauuauaccuugcucaucuuggcacaaaagaaggcgaaaggaaguaacaugggauugggaaaagagcaaggagauaaaguuugaggaaaaaaaaucaccauguugaugucuucuugaguaggccaaguugcguauaaagagaaaaugacaacaggagauuuuaagguaugauauauuguuaagaguaguacauauuuaagaagagaaaauauguuuuugaaaacaaauuuaaacuugaaaggaugauuuucauauuuugaagggauuuauaacuucacaaagcaucuccauucuaucuuguucagcuuuacauuuaaaaauaaacucuucuuguucauauaaaccuuaucucuuacauaaagugaaaucuguuaauuuuuuguuuugacaaggauaaacuacuuaccugcaucuguuuaagaauagauuaacuuauuuugagaagaaauucugggcaccauuuuugaccauugaagacuuauuuguaauuuaauuucuacuuuacauugugaauguucauuuucuaauaaacaagauuauuuugcauaugua

SEQ ID NO: 34819 - RNA, 17561 nt, Homo sapiens
gucacauggggugcgcgcccagacuccgacccggaggcggaaccggcagugcagcccgaagccccgcaguccccgagcacgcguggccaugcguccccugcgcccccgcgccgcgcugcuggcgcuccuggccucgcuccuggccgcgcccccgguggccccggccgaggccccgcaccuggugcauguggacgcggcccgcgcgcuguggccccugcggcgcuucuggaggagcacaggcuucuggugagcgcuccgcggccuccgggacccccuggccgcacggggagagcucgggcgcccccugacugcgcacugugagagcuucagagaccggagcucccuccucuggggcccuggcucucccgggcccgccccccgccguguuuguggguggguccuccaccugagugggcgccggggcgugagccugggccgcccccugcagcccaggccgaugcccgggauccugcucuuugagguaaaccaggagucuccccugggaguggacggcccugcagcgggaccuggccugccugucccauuccuuccaccuagagcugagguacccgccuuccuggcagggccagggccagggcuggcguuggccccucgucuuacugcugcugccguuccccaugaagaugggaccuccccacauuccuggcccuaagggucauuuuauuagucacugaacgcacgggcagcgccuggauccugcgcccgggcaguccugggcuugaacgugugugucagccgcgcugccagccaugcugaggcucgggacugagccgccccuuuguuguccccagccccccgcugccacacagccaggcugaccaguacguccucagcugggaccagcagcucaaccucgccuaugugggcgccgucccucaccgcggcaucaagcagguccggacccacuggcugcuggagcuugucaccaccaggugggcggcgggcagggucugggcgucccagagccccuuacagaggcacagaugggaggggagggcugggggcugcucggaagaccccuuguucccccaccucccgccgaagcacccuguuggggagagcguguccuugcuggcugugcuggggugagggcugugugcuggagggagccccugcauggggcacggugggcuuccugcaggucucccugcaggcucaggguuggcugcgccgcaccuggcuccuggugcacccgugagcaucccugugugugucugcuggccaggcuggguagggccacugcaccugagggcugagcugaggucucaucggucacagcacccugggcccugacgcuggugcagguggccacccugugagggggaggcacgaggugugaggggcacuuggguguguggggccuucuggaaacacagagacccucgugcacuuggccagagccgcuggcuccuaccagcagggugggcaccgggcaggccugggcauagggaguccucuuggcaccuuggaggcugcaugauggcgggggacccuuguucaaauaagaugucaacccugagcgucaggucaggcccaucccuccugagcugagggacggugcauuggggcccagccagcacugugggccagccugucucggaggcagagguucuugauuucugaguguuuggguccugcgugugaucagagggccuccuuucccaguugggguuccccgguuuccccagggcagcuguggcacaagagugcagcucuuggguggcuccucccugggaagggucucagcaguggcuugcagacgucugcuguggguccccaggagggagcagaggcugcugggcaggccuggcccugcuacagaugggcaucgguggccuccagcucccuguggcgggcucgugcugucugcacggcaucgugcacacugaggaacagcugcuccuccucagccguguccccggggcccuccccgaggaagccuccucugcucagaaugucucucacaggcgggcugcagcaggcuagcagcaggcugaugcccagggccccguagucucggcgcagguccugcagcgugcucacaccggcugcgucuaggaacagcagcggggcgcagucgaugaccacuguguggaagccggccgcugcgggcaccagcgcagcccuggugcuaaccgggcccagguccucgcccugggcagggccucccucaccgacccccgucucugagccccccuccuuccuccuggcagccaugcacccugcguccagccccgugaggcuguagagugacugcaggaagaaguccuuguuggcauaguacagcggccccccaaagcggaacacccgcacgccgggcucagggacgaggcccucgaacucuguggcauccucguagaaggccguguccccgaugcgggccagcagggcggugcgugggcguugggugcggccggccaggcugagcagcgagaggaugacgccagccagcagcccggccucugugcugaccagcauacagguggccgcggugccugcccagaccagcgcgucagccgggcucauccgccacagccgcgggaggucccacaccuugcgcagggccccccgcaggcugaccacgaugacgcaggccagcacgcuucgcuguaggucguggaacagcggugccagcgccagcagcaccagcagcaccacgguggcgcugaccacgcuggacagcuguguccggcagccaguggcugucuucaccaggcucuuggccagggcggcgcugguggcgaagcaguggaggaaggcggguagcacguugcagcagcccacagccagcagcuccugguuggcacgcacagaguagccgugacugcgggcgaacaucuccgccagcgagauggagaaggcggcagccacgagggccagggccacggcauccaaagccacacgcugcaucagccugggcucugggaccugagggggcaugaaacccguggggaugucgccagccacgcucgagccaaagcgcuuguggagcugcccgaagugcgacacgaguguggccaccacgaugaccagcagcuccgugggcagcggcacccucaggcggugucgguagcggucugagagcuccuucgcggcuagcagcaccgccaggcacaccgugcuggugaccacgucgcacacguuggccugcccggcgccgcgcagcaggcucagccaugugaggaccaccaugccgggccccuggugccgcgggauccgcacgcccagcagguguuugagcugcgaggucaggauggucacggaggcccccauggcaaagccaucgagcaguggcugugagagguaggcggacacgaagcccagccggaggacgcccaugaggaccuguggacggagugcggucaggccagcaggcgccuggcgggagccaccugccccucaccagcaccuggcauggcccgaggggugguggucacggcacaggaccugacaauucuguguugcggccccguguguuccaaaccagacuccucacacgggccugaguucugguuccacgcgugcucaugcccgcagacaacugugacauccacgugagcaucacacgugcacacagcuggccauagacacgucuaacccuugucacgugcagcagcccguuuuauuucagaauuaagaccucugguaucagaaggcaaccccuuccugcugcuuccuacacauggugcccacugccccccaugcagauguggagccaacgggggccaagguggacaggccaaggcaggagaccuucggggguggggaggccaucccccacuccaccuaggacagaaggccugggaggccacauggccucaguccagcaccacugagccacagccacaccuggccugcugguccccaccaaggccauggcccaccggacuggcuccccgugccccuccccuccugcauccacagccucuccgcgucggugccucgcccugggaugccccggcacgccccagcucugcccaagccuugcugucuugggccagcaccuccucugccaacccugugcuugcccccagccuugcccucguggauggccaaaaccuaagggggggugcccugggccccucccugugcccaagcagggcuccucaccugguaaagcccggucaucagcgugagggcgguggcgacacggauggcguagcagucacgcccgcaguccagcauggcagccgagccguugagggugcugcuguuggcuccgggcugcaggccguccugggaggggucaaagccggccagcuggagcucccgguccaccaccugccccaccaugaggcaaagcaggcugaagaugcccacggagacaugccgugaggugcccaugaggaaguagaugagguuggcgaagaaggacguauagaggcuguagaugggcugcagcccggccagcaaugaguaggcgauggccugcggcaccaggaugaugccgaugaccagcccagacaugacgucgccugccagguacucccgcgggcgguacugacgcagccagcgcguggcggggagcagguccugcaccagcgcccggacgcacagcacacugcacgagcagcugcaccacagccuggccuucagcaucucacgcagaccccggggugcugggcgcugccgucggaccggcaccggcccucugcccugcugcagaggcucaggggacucguccauccuguugcgucaggucccguggccgaccugcggccgagaagagggcauggucacaggagcccccggauccagggccaaacgacaagguccccggcagcaacgggccccuuggggcggaccccucgcccacccagggccggggauuggugcugggccuucuccuggcagcgcgggccccagcccccugcccgguauggauggacgcugggcccugcuggauccagaauccaucgugaggugagaugggauuacgacaccaagcccaugccauggggugugcugaggccagcagugcugaggggcggcguggcggcacccuguccaggcucagcuccggccuauuggcucugcgguuccuggcugaaaaccacccuguagccuccugaagcucaccuccccaacggggcaggaacaggcugggcugccaccacgcacaugugccuaccgucagaaugucacagucacuggacacaggugcaggcaagccugaguccagcugcuccguguccaccucccuggcuccccagguuggcaaacgguccugcuguccaccccaugcccacaccagagcccucccucccccauccaaaccaucgccugcucuccuggagacaccuccacccaccccucugucaccugcccuguggguccuggggcuggcggaagucucaggaagaggccuccuaugucccugccaagcuuuguggguacugggaccccaagucugcugggggagcagcacucagacacuagccuagcccauccgccuggacuugggacagaauucugagaauaugccuggacgggggccccaucagggccagcugggaggggaggagggugacuggcgucugucuccccugcccagacaguucugggacgugaggcgcccuuuuucccaggcugcaccagcucacuguggaacggccaugacacacugucccgaggcagcaccgagagggcccagcccgcugcacacagucacccugggccggcagagccggaagggcaccugaccuuucccuugaucucggaaaacaccguggcguuagggaggcggugcuuagaggccugacuggucccacgugaggccucgggucuguccuguuugcagacuccaauguacuuucacuuuaaacauucuucucagcgacguuaggcaaagacuuugcucccaggacaccaggugcccaggacacccuggagccugggcugagccugcuguuugcacgcuggcccagggugugcgagcuccagucuccuggcggguguguuggggcagugagcccagccugguagguugacacaugcaggcugggcacagcaccccuggggcacagagcggggguccuggcccucaggcaacauugcaagaguuguguccccuucccuggaagaccccaccacacugggucccuggaugcccugaagcccaccccaagccccugggguccagguguguggaauggggacaguagggccaccugccuugagccugagggugccccuaagaaaccacgaguccagggcauuucuggccucggcucccacgccccccucugcugcagcugagaucugggcccaggaugguucuuaccugagggaguccucacaggcgcggagggcccugggaugacgaggggcuggcaagaccaccgaggaccgcagggcccucuggcucccgcgagcagcggggagagugggggugguggcgccaaccugcaggcaguggucugugcccuggacucuguaguucaauuauuuaccuacagauugcugagucauggguuucuccagccauguuaccugaucggcugauccgggaguugaacuguaaucaggggcuuguaggaguuagagcugugugggccucugaggagcucccagccucccaggagccgcugcagcuguggcucugcggcccugccgggggggcuuagggaccagcgggaggcgggggcucaggggcugagcacagguaaaccuucagcucuggggucuggggucgagugcagcagccuucaaacccaggcggggcugagggaggcuuggucuccguguccagucgccggacacccuccugguccugcaaggagccagccugguccaagcuggagcagggcagaggcugacagccggcucagcccaaggcugccggugcgugcauaugcgugugugcucgcguaagcccuguguguggugcucaccgcccagggcgaggacugccggggucaaggugccgugacuggccaggaguccuggucugacuggacccagcaccgacccacagcgccuggucacccucacggcuccucugcccuccccucuaccacagaccaggaccggcagugccugccucauagggcuggggugaagauaaaugauuuuuuuaagugaacuaaauuaggcccacacgugaaaauaaggguaagcugcuuuuuaaaaggaauuauuagccaggcacgaugguucacuccuguaauuccaacacuuugggaggccuagacaggaggaucgcuuaaggccagcaguucaagaccagccuggucaacauagugagacgccccccaccuuuucuuuuuuuuuuuuugaggcggagucuugcucugucacccaggccggaaugcaguggugugaucucggcucacuggaagcucugccuccuggguucacgccauucuccugccucagccuccugaguagcugggacuacaggcgcccgccaccgcgcccggcuaauuuuuuuuuuuuugagacggaguuucgcucuguugcccaggcuggaguacaguggcaugaucucggcucacugcaagcucugucucccggguucaagugauucuccugccucagccucccgaguagcugggacuacaggcacccgccaccacgcccggcuaauuuuuuguauuuuuaguagagacgggguuucaccauguuagccaggauggucuugaucuccugaccucgugauccacccaccucggccucccaaagugcugggauuacaggcuugagccacugcacccggccgcccccugccccccaaccuuuaaaaaauuaaaaguaaaaaauuagcugggugugguggugugugccuguaucccagcuacucaagcggcucaggugggagcauggcuugagcccaggaguuugaggcugccaugagguaugauuaggccacugcacccuauccuaggccacagagcaagagcccgucucaaaaacaaacgcugucauuggcccagcacuuugggaagcuaagguaggaggauugcuugagcccuggagguccaggcugcagugagguauguuuguagcgcuucacuccagccuacaagucuuuuuuuuuuuuuuuugagauggagucucgcucuguugcccaggcuggagugcaguggcacaaucucggcucacugcagccucugccucccggguucaagcgauucuccugccucagccgccugaguaguugggacuacaggcgugugccaccacgcccggcuaauuuuuguauuuuuaguagagacaggguuucacuauguuggucaggcuagucuugaacuccugaccuugugauccacccgccucggccucccaaagugcugggauuacaggcgugagccaccgugcccggccaguucugucucaaaaaaaaaaaaaaaauuccuugggagccucagguccccccgacuuugacagugaguacugggugggagccugcacggggcaccuguggccggagggugaguguaacgaggggcugcagcccucagugcucucccaucccaagggaggccaggaggcugcggugggucccucggguggggcuggaaggccaacccggcccuggcaccuugggcagccugacucuguccggggaacagaagccacaggcucuacuucuccuguccaugugggauugaagccgagggucucgcagaaccagcugaugugccggggcuccauuuccccaagacgaggacacugacauugauggggcacagccccggagggaggagacccuggacacucaccccaccaaagguaccuccuuguggaagccgucugccaagcgcugcuaguuccccacagcccugggugagcccagggaagacugggcugcagugcccccauuuggaggugaaaugggaguggaauguaguugggauggccagagaguaggagacauccuaagugugagauguggacagggcugaaugcuccagggucucguaccccagagugugagaugcgggcagggcugaacgcucuggggucucguaccccugagugugagauucgggcagagcugaacaggcuccagggucucauacccccauagccuccaccugggaugcccucuccaagucugauuucuccucgaagccccugcccuguccuccagagucugagcccuugcuuccaccccagcccaaccugggccccaguggucccugggaagcagcuguuugcucagcaguugggagcugugcuguaagaagcgguuggccagugggugggguaaggcagucacgcagggccucaggucccucccugggacagauaagggccccucugggugcagccaccagcaggguuguuggagaacuggggagacccagggggcugggguuguucccucaaggucucccuaaaggaggcagggaggaccugggugcuacagcagggguggggcaccuggugcagacgccugcaugcaggguggggugggcagugccaccuggggccacagaaaaaccuggagugggagguggcccuuccccccucaggaaaggugguggagguuuccagaggcuggcuuauggggaccuguggugagguuuuaggcaggugagcguaguucaggaacagccucagccgcacugcaggggccuggccucaggucuucugcaggcauugggccuuaugcccuuuuaguccccaccuaggcugggugucuaaaguaggugaggucaucacugcaggauccuuggggccugaccugcccccucccacgugucucugccucaguuucucugagcauugaggcaguggcuggugcuguccuguggccaggcccagaggcugagugcccaggggguccaggggccuugcuggccagagagaguggguagcccauucuaccccgagccugugcacgcgcagggcugccaacaccuccuuccuuccccgcuuggcccacgcaggacagggggcgugggggccccagcaacugggaccugccugaauccgccucccuccugaaccccccucccgccugaaccccuggccagucuugugucacacgcuuacuuccuuaguuuugucuuuaaaucagccguuuuacauuggaguccauuuacugggaaaggagaccuugcauccuugccucccacccgugggaagaagcccggccgacagggcuuugagaccggacccgaguuuauucccagagacccucccgcgggugggcgagcuccgaggucuggagaagaggaggccccggcccgcacccucuagcaccuguguccccuucgucccggccacagaugcagguucucccaagaggcgggucuguacccgccccgcgcccccagcccagcgggcccggccuccgccccugccccgcacucccacccccacccucaggagagcgcggcccugcuccccaccccgcgcggucuccccccaccgccugcgaacccccaugcacgcgcggccccgccccgcgcacucaccaggcccggcagccgcgcggucuuagcggcucacgcgcucgggcccaggggcggggacguggggacccgggcggccgcucagccgcggccgcgcggugaaugagcccguugugcggccgccgcggccccagcgacaccccgcgcggggucuacaagggcugacgcgcccccgcggcuuccguucccgggcugggcgguggcucgucugcgucuccggcccugggggugggcugcgcgcuccaucucgccggcccaguccccuccccagcgucggucucucaaggccccucccaaugggggccaggcggagggugggcccucgggccuguggacugaccccgggguuccugggccugggggcggggaucccugucccgggcuccccucgcugcgaggcuggcccugccagaugacacucagaggcgccuugggugucaggccagggacaucucugaugcuggggcuccccccgcuagggucaggggcugccgggcuaucgccuugggguucugcagagaaaaccugaagcccagcugggucuucacuuuccuccaggucaccgugccccgcuacuccaacuccgugggacuuuggaaugcaccuucugggcauuuaauucuuauccaagugccucuuaaguuauacuucuuugcuaccaguguguccuuuggauggaggggaggagaggugguaggggccgggugggguggaccccagggacuccugcugcuccugcuggacacccagcccgggguacaggagcagguggggaccagcagaggcggggcggagcaggagcccacacccaaaggcuguagacuccugccaaggcucugccuugaucuuguacaccaugggaggaccagaagggaggcguugagguguccagaccuuugcuguggagcugggggugcuguggcauggggagacugacagacggggagcuguauagggccagauuccgguccauggugguaaccccaucccccaccacugcagaugcggcacaaagccagcugccacaggaggugcacugccccacgggcagcugugcucaccugcguggcguccgcaggaagcccucagacccuggccagccuggucucugcuucucacuccaggcucaaggcuggcugcuauuccauucaccccauucccuuucccucaggccagaagcaucacucacaacuccagacccuugcacaccaaucuccucacucaguucacccucagauguccaacuccacauggccaaaaccgagaccagucucacuccaagcucauccacccgccuagcugcccaagcugaaauccacaguugcccuguacgaccccccgaccccccaccucaccccccagcucaccucaaaccucaucagucccucugcucacagccugcacagccaccacccagucugggcaccauaccucucugggcaacccccauggcccccagccagucuuccagcucccacccugacuccagugagcugccagagggauccuugaaaaaugcucuggaagccaaggugggcggaucacgaggucaggaaauggaaaccauccuggcuaacauggugaaacuccgucucuacuaaaaauacaaaaaaauuagccgggcgugguggcgggcgccuguagucccagcuacucaggaggcugaggcaggagaauggugugaacccgggagggggagcuugcagugagccgagaucgcgccacugcaccccaggcugggcaacagagugagacucugucucaaaaaaaaaaaaaagaaaaaagaaaaaugcccuggcacugcucagcucagaaccuugaaagggauccuuguuucgcucugggucagggucccauccucaaagcagucacuuccagagccccauggagccucauaucccaugauauccacccuuauucugucucaggcccaccagcugccucccugcugccugauugucaugugugcauuccuguuccagagccuuugcacuggcgaugccaucugcugccuggaugucuuccugcuggcuggucccguugcaugguagccuuaggugucuccucagagaggucccucgcugaccaucaggcuccucacucccugucguauccccuucaccaaagauucccauucccugacgacgccuguccccucggaaugcaggccucgugggaauucagcccauccgcaagugcaguggcagggcggcccccuucccccuugacgacgccuguccccuuggaaugcaggccucgugggaauucagcccaucugcaagugcaguggcagggcggcccccuucucccuugaggacgccuguccccucguaaugcaggccucgugggaauucagcccaucugcaagugcaguggcagggcggcccccuucucccuugaggacgccuguccccucguaaugcaggccucgugggaauucagcccaucugcaagugcaguggcagggcggcccccuucucccuugaggacgccuguccccucggaaugcaggccucgugggaauucagccccaucugcaagugcaguggcagggcggcccccuucucccuugacgacgccuguccccucggaaugcaggccucgugggaauucagccccaucggcaagugcaguggcagggcggcccccuucacccuugacgacgccuguccccucggaaugcaggccucaugggaauucagcccaucugcaagugcaguggcaggguggcccccuucucccuuuccugugcacucauguugccucuuggggugugggaggggaaauggggcacuccugggccuccaggaggugcagagaaccagggugagguguccaccagguccugccuggcuccugaccccuggccccugcugcucgcgacuggccugccucgugccacugagccucagagccauuccgaacccccaccccaaguuuuccaucucuugaugguguaggguuggggggucuccauguacagauacucuaguucauaccaggccuucauaggguuauuuuccaaggggaagggccccucgggaagccgggaucggaguccuguguggcaccuugcaggcucccacaugcuccguuguggccacgguuccagccuggagcauggagcugugugggcacccugcuuccugacgcugaccguccuucugcaggggguccacuggacggggccugagcuacaacuucacccaccuggacggguaccuggaccuucucagggagaaccagcuccucccaggugagcugugggcucugcccucccagcccgccugcacccccuugcccugcccacccucucccucacccagccccucugaguccuuggauguccauucagggcuggccuuggugccggagcacaggccuggcagagcaugggugugguguguggugggcgguggggcagcccuccuguguuccaggguuugagcugaugggcagcgccucgggccacuucacugacuuugaggacaagcagcagguguuugaguggaaggacuuggucuccagccuggccaggagauacaucggugggcgagcgcaggcccuggggcccuggccggggcggggguacuccugggcagguugcaccccuaucacgcaggcugcugccuggucaggagauacauuggugggcaggcgcaggcccuuguggggggaugggggugacaagggauagguugguggucggcgcaggcccuggggccccaggcugggggguacuccugggcuuggugggugggcgaaggcccugggccccuggggugggggguacuccugggcaggcugcaccccuaucacccaggccgcaccccuaucacccaggccgccgcccaggucuuggacccccuugagccagcgcuuccugauguggggcgggaggcuggccugcauggagaugggguucaucuugagucagacgcccuucaucaccuugcacccucccuccgugggagucacugaggcgagauucaccugugcuggggggacagcaaggcuccucugcagguagguacggacuggcgcauguuuccaaguggaacuucgagacguggaaugagccagaccaccacgacuuugacaacgucuccaugaccaugcaaggugugcaccgcuuccugggguccugcccggcugaaagggggcagaggaaggcaggagcagaggcuaagccgcucauccccagggcagguguagacgcagugcucccccggcccaggcuuccugaacuacuacgaugccugcucggagggucugcgcgccgccagccccgcccugcggcugggaggccccggcgacuccuuccacaccccaccgcgauccccgcugagcuggggccuccugcgccacugccacgacgguaccaacuucuucacuggggaggcgggcgugcggcuggacuacaucucccuccacaggaaggugcgcccugccccuccguccgccccgguguucugcgcccucagccgcugugccccgggccgcgcugacccugguggugcugaggcggccccgcccgcagggugcgcgcagcuccaucuccauccuggagcaggagaaggucgucgcgcagcagauccggcagcucuuccccaaguucgcggacacccccauuuacaacgacgaggcggacccgcuggugggcuggucccugccacagccguggagggcggacgugaccuacgcggccaugguggugaaggugggccggcccaacgcccugcgcgccccccggccaccuuccucccgagacgggacaggcgagcgguggccgcgccacccggucccagcugcccuggacacccgcaggucaucgcgcagcaucagaaccugcuacuggccaacaccaccuccgccuuccccuacgcgcuccugagcaacgacaaugccuuccugagcuaccacccgcaccccuucgcgcagcgcacgcucaccgcgcgcuuccaggucaacaacacccgcccgccgcacgugcagcuguugcgcaagccggugcucacggccauggggcugcuggcgcugcugggugagccggggccgcuggggugggccggccagggcccuccaggcuggggagcggcuccugcgaaggccccgcugcggggagcgcacuuccuccagccgcgcgcuucccggggucggccuccgcguggcggggccuggggacuccuucaccaaggggagggggagcgaguggugggaggcccggcccugggucggggggcggcugggcaacgaccccacgcggcgacggcccccccccgccccgcagaugaggagcagcucugggccgaagugucgcaggccgggaccguccuggacagcaaccacacggugggcguccuggccagcgcccaccgcccccagggcccggccgacgccuggcgcgccgcggugcugaucuacgcgagcgacgacacccgcgcccaccccaaccgcagcgucgcggugacccugcggcugcgcggggugccccccggcccggguaagccgggguuccagggaggucucuggccccgcuggggcucuggagggggcggcccggggagccgaggccugagugucaggccccgcaggccuggucuacgucacgcgcuaccuggacaacgggcucugcagccccgacggcgaguggcggcgccugggccggcccgucuuccccacggcagagcaguuccggcgcaugcgcgcggcugagguaggugggccgcggaggggcgaggggccgggccgggccggggucccgggggggugggguccggggcgggggcuccgaggcggugugggugggagguggagcggugggccgggggcguucgcccugaggucgggccgagcguccccagcuccccuggagaacccugaggaccggccacugcgcccaggacccgguggccgcggcgccccgccccuuacccgccggcggccgccugacccugcgccccgcgcugcggcugccgucgcuuuugcuggugcacgugugugcgcgccccgagaagccgcccgggcaggcaaguggcaguccccuaacccgcgccgcggcccggacuccccuuccccgacgccaucacagcccuucccucccccaggucacgcggcuccgcgcccugccccugacccaagggcagcugguucuggucuggucggaugaacacgugggcuccaagugcgugaguggggccgccccucccucugccugguccuaggcaggucccugggucccgaccccuucacccaugcggucacucgggccacuugccguggcccaucggcucccucccucgccgcccugcgucccugcccuucaccccacacacugugggccacgcgccaggcccugccagugggguguggguucuccuaggggacaugagauggacauucgggcuccagcccucuccugccugggcaggaagagugcccaggggcuggggaggugccgccgaggggcuugagggaaugaggcuguggguccacgcggccgugcccugccugcucccaccuuugaggacugucuugaccccagccuuguucuuggccugaccuccccaggugccuguggacauacgagauccaguucucucaggacgguaaggcguacaccccggucagcaggaagccaucgaccuucaaccucuuuguguucagcccaggugcgcccaccacccgcugcccuggacucggccaccccauucuugggccucagggcaguacugggugggggccucgagaagccuggggucagggggcuuucgggugggggcagguuccgguuggcacacauguccccuugucuccagacacaggugcugucucuggcuccuaccgaguucgagcccuggacuacugggcccgaccaggccccuucucggacccugugccguaccuggaggucccugugccaagagggcccccauccccgggcaauccaugagccugugcugagccccaguggguugcaccuccaccggcagucagcgagcuggggcugcacugugcccaugcugcccucccaucacccccuuugcaauauauuuuuauauuuuauuauuuucuuuuauaucuugguaccaacgcccccuuuaaagcggcuuugca

SEQ ID NO: 34820 - RNA, 17561 nt, Homo sapiens; identical to SEQ ID NO: 34819

SEQ ID NO: 34821 - RNA, 12279 nt, Homo sapiens
gaauguagccaccuuucuuaacgguccgggaaaccagaggucucuccagcuacucaggguagaggaauuucuccuaucuccaugugacaucuucugauuuagaagaacuaauguuagauuucucuugggccuuuccaccuacagcuauagucuucccuuuguuuagcuaaaauugaggcagguaggaaaauauuauugggggcauaagccuauuaguguguaaacguauuuuuaugaagugugccuccagggagccauuaaaaacugaccucucaaccacagaaauagaugagauuuugagaacauugagaagcugccuuuugcaaaguaaauuugcaaugguccuugacgaaggggggucgggggcggggagaaguccagccgagagaggagcucauuccacgcuauauuuuugcaguugaaaagcugccuaaucaucgcuaaccgcuucccgcauaagaguucugggaagacuucagaaacaaggcaaaugaagacuuuucacugccuccuucgggcugucgcuuccggaagccgaaguccuagcacgcagagcagcaggagaggguuacuuucaggcaauuccacugagcaaaauaaaucacuuaauggcauaacguucuggcuuaaaaaauuggaauuuaucagaggcaaaaauauccuucaagaaacuauggacacuccgcgcccuauucauuuccauggcagcagaguaucugcaucuugagccaccuauacagauucaugccucguaucgcucucaccuccuuucuuuuugaaguaaagcccuuucccaagaaggcggccagaaaguggaccccaccgggggaaaaagaaaaaugaaacgcaaaucagcuuggcacugcuugcgucuuccaaaacgcggugggacaaggcuauugagucuauagcuaauucuuucauguauauaaaauguauacauauguauauauuuuuauauacauaaaagaauucauauauauguauauagcuauguggagcccugaagcaauucuccaugcuuuugucucccucaaguuccccagguggaggcagucauaagcauuauaagccgccuuagugaccaccagggacggaaaccguuaauuaucacguuuccuuucaucuccaggggcccuuuggcccgugacacaagaggcuucgguauuggcgcuuucccagaacuggcccagaggagccaguucagagugugaggucgggucugcauugaacguacacaccgaggucuaucagacucccccgauuuuagcgaagggugcugacugcugugcugcuagaggcuagcaagcucccugugcgcagcugaugaguuucagcaacucgccaccugggcgcuuuucuuuaaauuuugggaguaaacugggaaaauaaaaaaaucuccacguccacuggcucucuccccuucuccaacuuccucuuucgacucguuugugggaguuuucuccucuuugcugggacuauaaugugaugcgcaaucguuugugaaugaacaaaagucaccggcaagcagggagacggggacagaucgcugacggcagauugaggguggcagcaaaggcccggccuccaaggauaauggggagccguuuucccucacgccuggucucuauggcccccuucgucuuccagguaaaaugaauguuccuucauccaucauccgcagaguacccucaggcgugcguagaaucugcugaugaaaccuauuagcgccgacugggcagcuuuguggagccacccgaggcucuccauuguggccuuugucugcagaauuuaagcauuuacauaaugcauuagcacggaacucagcacccgguggggacaucgcgugccaagccuggcgcggccaacgcuucagcggcucccucacccggcagcucccuaggaccacccucgaggaggcauuggagucgggcugcaggcgcacgggcaaagaacuuagcaucucauccaaguacuucgccuuccuuggccgucuccgggagguuaugcuuaaaaacauaaaaauaaaaauaaaaauaaaaauaaagggaggcggacaaaguuucggugggugaacugaagcuggguccaugugacccugaagccggagaaauaaacuuaacaugaaucuugcuuuccuggcgggcguugggaccccgccguuuuucaugccaaccguuggaagcuucguacucaacggccacaggugccuaggagcgcagagaggccucggguucaaaucaccggcgcgcagggacuggacucgcggguagcgacccccccaacccccccccccccgcccuacacacacacccucgcgccggcugaaagcauggaggauucagggcauuugaaaaaagaggggcugggcgcgguggcucacgccuguaaucccagcgguuugggagguccagaagggcggaucacuugaggucaggaguucgagaccagccuggccaacaccagccuggccaacauggugagaccccgugucuacuaaaaauacaaaaauuagccaggcguggugccuguaauaucagcuacuugggaggcugaggcacgagaaucgcuugaaccugggaggcggagguugcagugagcccagaucgcgccaccgcccuccugcucugggugauagagcaaggcacugucucaaaacaaaacaaaacaaaacgaaagauucggucaggaaagaaucugcaggcauucgaggcgcucgcacuuugcaaaguaaaugcaaucucuuuauuaagccgaagucccucauaucuauccuuuuagaggaaggugguccaacucagaaaucucucccaagaggacuuuccaccgaagacuaccgcgaagugccaggaacucgccccagucccgacaggugcaggaccuuucgugccgccacaccuugggacucuaccucccuaaauaggccacuuaaaagccaguagugcaaccgggaucccgcggcgauaaagaaucacugugcagaacccuggagcugggagucggcccgccccccucccaaagaaaccgggaucccgcguccuccccgccgcuagcgcagcgcgccagcggcgcccaaucagugagcuuuccgggucugugacggccuucggcuccgcccccucgacggccauaaaaagucgcagcgaagccugcaccuccgagcaccgcgcgcggcccugcccccggcacggcccccaggugcgcuccuucuccggcugcuuguagcacuggucucacuguccccgccgucagccaccgguuccuuauccgucucauuccccauuguggcuuggcugagccggucgccaggccucgcuguccuccuuugccuuccucucuccucagcggccguacuuugcgccguaccucaccuggccugcaggugagcagcagcgcagcaccccugcccggcgagcuuaacuugcccagcccggccccugccggaguggcaccggcaccucuccaagacgcccucuucccugcaggaugaagaaccccaugcuggagguggugucuuuacuacuggagaagcugcuccucaucuccaacuucacgcucuuuaguucgggcgccgcgggcgaagacaaagggaggaacaguuuuuaugaaaccagcucuuuccaccgaggcgacgugcuggaggugccccggacccaccugacccacuauggcaucuaccuaggagacaaccguguugcccacaugaugcccgacauccuguuggcccugacagacgacauggggcgcacgcagaagguggucuccaacaagcgucucauccugggcguuauugucaaaguggccagcauccgcguggacacaguggaggacuucgccuacggagcuaacauccuggucaaucaccuggacgagucccuccagaaaaaggcacugcucaacgaggagguggcgcggagggcugaaaagcugcugggcuuuacccccuacagccugcuguggaacaacugcgagcacuucgugaccuacugcagauauggcaccccgaucaguccccaguccgacaagguaugaugugugacucccaggggaagugggcuccgcggagaugcccccucccaucccugaccuuuucucuuccccgcgaguagggaucuaauuccuggacaccuccccuaccacuuccauaccauccuuuuucuuuuuccuuuuuuuuuuuuuuuuuuuuuuuuuuuuuugagacggagucucgcucuguugcucaggcuggagugcaguggcgcgaucuccacucacugcaaacuccgccuccagaguucacgccauucuccugccucagccuccugaguagcugggacuacaggcacccgccaccacgcccggcuaauuuauuuuuguauuuuuaguagagaugggguuucaccguauuagcaaggauggucccgaucuccugaccucgugauccucccgccucagcaucccaaagugcugggauuacaggcgugagccaccgugcccggccuuccauaacauucuuaaaguucuagauuaaguaaggaaaguucugguguuccuaagguaggcuaaguaaauaagcaaauggcaacgugccuugcaggauaucucgaaaugcuuagagaaaggauguggcaaugcaggaccgcuuccagagauuccagagcugcccaguauugcugcagaagucaucagguguccacccacaguguaguucaaacgacaaagggcaagugacugggggugggggauacaaggaaucagucaccgcugcuugcaacuuuaaccaagaauuucacuugaaaggaagagguccagaguuuauauuuaauccauaacacuauaaacaaagugugugccuuuaaaauaaggaaccaugcaguuuucucccuuugaaagcugcauagagggauuuuucauugcuugcuauaagcuaucaaaauucccaguaagagggccccccugguaguucccuuauucuuuguguuggugcuucagaguuguauuuuccaugguauucugaauucuuucuggguuggcuuugauccucaucuagacuucauuguuaagcauccuuuacccauuagcccugaagguagauuacauuguuuauggguuccccagagaucaauacaauuaguuuucaagaagagauguuaaacauuggaagguaauuuuuaugaguauuuugaaaaaauacucaugauuauuaaauuagccacaaauccaaagggaaaaauggauuuuuauuuccuuuuaaaaccucuuaacuuuuaaaaauaguuaagauuuuaagccugaaacuucacuuacaauuggaaacuuucucagccuucauugcacuuguuaaagaagucauuguuaauguucagucuuuauaauggaaaccugggcaauaacauaugagcuuuaguguuacucuucauguuuagauauuuuugggaccagaaaaagcuaagucaguuuuuuucauguaaccaguuuuuaauugcuccacaucuugguuaauuuuuuugacccauuugggaacaucuuucucuauccucugugggagagcauggaaguauuuugcuuuuauagaucgguguaugaaacuccuuauagauuuuauagagccacaaaagacucaaucuaggaauucuuuuccaaguaaaauaaaaauacaguuagagcacugugcagcgauucaagaaucacagcucuaguccaggccuguuuagaaaugaacuccaccacauuuacaaacacgggcucccaaaguguacaaaaggaaacaugucagauuuacuuaggaaccaagcaaaucauuucucuaaggaaaaacaguauuucuaucagguaauuaggaguuacccuuucauggaacacauauagcgcugcauuauauauuucuacagaaaaacaguaacuagugcuuuuguaagguaguaaaauauuuaaucugcauaaauaacuaguuggaguaguuuuucaucuuuggaaacuuuguuagggucuacagaaguagagaaguguuuuaauugcuguugcugcauagcaccucuugugaaacugaguuuugucuucacuuugaauggucuaacaaacaauuuggccacagaguagauuucccgggggaaaaaaaaaaguuuucaucccaaauuuccuaauucuacaaacuguuuuugaacaugcacugagagaaguaggucauuaauacugaaggaaggacugguuucuacuuuuuagaaacauaagaaauuauuugauucugggucugauugcugaguucuccauauaugcaacuaauauuaacaugagaguuacaaaguugccucuuacuuaaauuugaguuaauaaaaacucucaagaacacacuaccccuaaggaaaacacugcaauuaguuugcaaaugaaugaacuggaaaagaacauuuacuccuuugugguaacacucuauuuuacaaguuuagaagucauaaaauaaugggauuuuuauaauacuguugacaaucaguauuuuguaaacuaaaaauuccuuugguuaauaacuauuacuauuccuuaugcuuuuucuacuaugauuuuuuuuuacuuuguuaauacugcucuuucauugccaaaaaugauugcaaaugccccuuuuaauuuguguggauugagugcucacaagaguguuccuacagacuuauugaccccuucuagaaauuuccuacuguugagcaccacuaaagaugccugcuggucugcugaccaagugaacaggaacaggguauuagacaugaguugcuuuuugagaaaaaucugcuuuugugggaaauacagucgaaaaugauucugauugacuuaauuauaaauuaccaaggaaaaaaauaaggauaacuguauuuacaacuuagucauuuacaaaaauaugucuuccaucaaccuccuuuucuccuuguccugaaaacuucaauuugaucuuuaccaucuuaaaauaguauacuucucaaugccuugcuaguuuauuaaaaaaggacaaauaguaugucugauagaaaaauaggccaacaucuagauaaguuucacacuuguuuagguaauuguguaaaaguauggauagagauaaccauacugucaaagugguguauuaaaacauauugaacuuguucauucuaucacuuaauaauuuggaaaccuagcugcccaguaccauguaagccacuguagaaaacccuaaaagaacauaaaaugccaugucuagaaacagagcuuaaaauuaguaugaauagcaaaacccauauagaaaugacugacaaucacugcauucuggcaucaacggcaauaugguagagauaacugucaacaaauagaguacuaauaauaaucacuguaauaccuuauguuuauacagcacguagaagaauacagaggacuugugcaucaaacaucucaguuaauccucagaacaauuugaguguucccauuugacuacuugaggugacauagccaauaagagcuggagccaggacucagacauaggccaucauuucuaaguaaaauuauuuuucuaaggaaaacauuacacauauuagaaggaugcauuccucagggguaaggacaauauuugucuuuuuuuccagcagccaguuaugugucacauaauugauccugaauuuagcauauuuagucaggaaaugggauuugacaauaaaauuagacuuucuaugccuguagauuuugagacuuauaaaaaaguuaucauugguaucauuagauuuuagaauggcagauuggaggaauugaaucuacuuuuaauuggccaaauucuauuauuuuuacucaagauuagagacaccucuuugcucaucuaauuuuaaaauaugcuauuguuauugauaagcaguuugauguuuuaaaccuuuaguccugaauaaccaugugguuauacuuucuauaguuuucuauaaaugcuguauuuacauaggcaacugccauuauuaguugccuaagggaucauuucugcuacuauacgguauagaaucagaacuggacucuuaacauuguaaauuuuuuuguaagucauaagaaaaagucuaguucuucugguagacagaaaauagcugggaaaacugauuuacuguuugauauaugugauucuucuuggguuuagccaccuuuccuaauuuuccaauauuuuauuuuccaguuuugugagacugugaagauaauuauucgugaucagagaaguguucuugcuucagcagucuugggauuggcgucuauagucuguacgggcuugguaucauacacuacccuuccugcaauuuuuauuccauucuuccuauggauggcuggcuaacuucauacccccaugucaguguguguauucuguauguaaauauguuuauauuuauagagcaucaaucaauauaagcauuauugagaaaaaugugacccguaacacuguguucuggauaaaaaugugauuaggaaucacgcaaagugcuuacuguguaagcccaagaacaaaggcuuucugaaucuucucaggcaguucagauuuaaagcaccauccaaaccuuggaaauacgacagggugugguagaauucagcaauaugagaaaaccagccccuaaaaugauagccacaagagauuaauuguguuuuuuuuucuccuguaauccuuguacuguucggcugaauuugaagauuggaagacuuauauugagaccaguaacuuuacuguaaauuuacuuuguuucauugaaaaaacaaauugauaaacauauuaaacuggaagaauuuucuuuauucaaaugaaaacauguuugaugacuggucaaaaaauaagcucauaaucuauuuuuuucauguaguauauaagucaagaauguuuuauugucauuaugugaaaccaauauuggcaaauaguacuuuaaugaugaaguaaaugaccagaaauuauagaaaucuguguuuuccuguaaaaauagcacuauaguaucacuugaacaauuugauuuggcuuuacuuacuaggaagccuggaauucauuauuuuuuuccuuuuaugugccacuguggcuacuuuaaaucacucugagagguaaauggauauaggauugaaguuauguggguauuuggcaugugugugugaaauaaauauguagauagucacauauacacagacugagagauaaauuguucuugauugcuuuauuaucaucauacuaguguguucauuauagaguaucuguagaggugaauguaaaaguaaguccaaucuauuuucuuaugucauugaauuuguaguguuaacuugcauauauguuauuggauggguugucuuuuaaagcauuuacuaauguacucugaaauuuuuaaaagccuucagauuuguuuucuagucacuuuuuuccauaucauuucuaauuauaguuuauauccuuaaaagaaggaugccacaguaguauguaaaacccaaacaaguagaacccaagcaaauaaaauuauuuaaaauaauuuuaaaguggcuuaguacugccagucauguaaauugauucugcugagggucuuauaagaauugagauauaacaaugguaaaacaagcauucaagcacuuuuacaaaauuaccaaauucuuaaaaugaagccacagcuagacuugcauuucagguauuaaaauugcuuucuuaacugucaagaaucacaaaauaacaaaucauauuaugagugaauauggggagggcggggccaaucagucaaugauaaucugaacaaauuuuaagagcagauuuuagauuaauaauguuuuaucaccacuaauuugcccacaacaaacucaguauuuaauuuuucaaauuaaauauuaaauuauuuaaguauuuuaaauaauuaaaacauuaaauggcaacaccauagaauauagguguucucuggaccuauucuaaccacuuaaaauuaucuuaaguaugcauacauaaaagcaaccacuaugagaacuaccguguuagugguuuuucacuuacuguauauuacccuuguaggaauaguuuaaggaaauucauuucuuaaaaauauaguguccucaaauaauuaauuuuuuugcaaacuuuaguuauuacaggcagcaaaaaccacugucugaaacuaaaucuguguucaaagaugaagaccccucauuaaaagccaaggacguucuuaagauuggaacugacauaauuagucuugacuuacuucauuaaagcaagauucaauuccuuguucauuugaguguucauuauaugccaggcauugaccaguugcaauuuuaugguccagaauuaauauuauuauucguaaacuagcuauaauagaguauauacagugcugugggaauacaggggaagaagcaauuaaaucugcuagaaggguaagagaaaucuguaugcaggaggcaaugcuagcauuaagccaagaaauagugugaggugaucuuaucacacugauguguucaacuguuuaugggaaaaggaaacuaggaugguuuuauuugugaaauguucuacaacgcuagaacuguugaacuucuugggagaaaaggagaaucuuuguuuuguugugcugaguuugauuaguugcuuaaccaaguagaaagaaaagcacaucuuccugaucacaguuauaaaagaaacccugaggccgggcgcgguggcucaagccuguaaccccagcacuuugggaggccaaggagggaggaucacaaggucaggagaucgagaccauccuggcuaacacggugaaaccccaucucuacuaaaaauacaaaauuagcugggcgugguggccggcgccuguagucccagcuacucaugagguugaggcaggagaauggcgugaaccgaggaggcggagcuugcagugaguggaaauugcgccacugcacuccagccugggcaacaaagugagacuccaucucaaaaaaaaaaaaaaaaaaaaaaaaaaaaaaagaagaagaaacccugagccauuaaugugucucguaacuugaggaaguucaugaauucucugggcuucauccauuaagauucauccuuaugcuccugcaaguuucuuauauuuauguauuucuauucugauuucugaaaugauaaccuaguagugucugaugaaguuuuuucaugcuuauuuuauucuuugucacagaugaaagaagaauaggacuaauuggggcuaagaugaauuaauguaagugucagauacuaggcagguguuagggaugaaaugaugaaugaggcauggaccuguuccucagaguuuauggcccaguagacauaauuguauuaggacuuucugcaguugacauuugcauaaagcugacugacugaaggaacagaaagugagacagacagauaugaccaaauuuauacaaaccauguaccaacacuugaaagauggguggauauuuuccaggaaacagauuuugggcaggacauuccaugcacuggaaauagcaugaacaaaugcaugaaaauugccuacaacaugccuggcacauagcugugagguacccuaugaguuguugacuugaaaacauggaacugcacagggcauucaggcaagugcaagugguucaggggccagcgcagagcagagugcugaguaaagaugucagaaaaggaaagcaauggucugguacaagucuuguauagaacaagaaguuuagacuuuugaacaggcaaucgagauuugggguucagaaagauaaaucccaaaaguauggagaacaaaggaacucauuuuaaaggacuagcuaagaugcucaaucucuaaaaaaaaaaggaucuguauucgugagaguagagagaaagguuguuuaggaagagucaacagacuuuagcaaaauccuuuuauuugauucaugcauaacuccugauggagugucaaggaagacucauucacuuuucuuuccugccagaaaguugguucuugcaaaauagauuaacuugaugacuauguguauauuggauacuccuaauuuuagcucuguuagauauguuucuuucuaaggacaagcaacuauguauagacuuguuguuugaauuuuuuuucaguauauauauguuucuuguuuuucuauuuuucuacuucauacuguuaaugucaaauaucaaaaauguuuuccagcaauaucaaguuauggcaauggcaaaaguccuuguuguagaugagaagcauauaagaaaugguugccaaucuuuguuuuguaugaucuauuuagaguuuuaaccaaccuagaucugucagcuaagcuaauuuuauauuugguauacaugcaugucaaauaaaguuaauuuuacauacu

SEQ ID NO: 34822 - RNA, 9149 nt, Homo sapiens
uaaaaagucgcagcgaagccugcaccuccgagcaccgcgcgcggcccugcccccggcacggcccccaggugcgcuccuucuccggcugcuuguagcacuggucucacuguccccgccgucagccaccgguuccuuauccgucucauuccccauuguggcuuggcugagccggucgccaggccucgcuguccuccuuugccuuccucucuccucagcggccguacuuugcgccguaccucaccuggccugcaggugagcagcagcgcagcaccccugcccggcgagcuuaacuugcccagcccggccccugccggaguggcaccggcaccucuccaagacgcccucuucccugcaggaugaagaaccccaugcuggagguggugucuuuacuacuggagaagcugcuccucaucuccaacuucacgcucuuuaguucgggcgccgcgggcgaagacaaagggaggaacaguuuuuaugaaaccagcucuuuccaccgaggcgacgugcuggaggugccccggacccaccugacccacuauggcaucuaccuaggagacaaccguguugcccacaugaugcccgacauccuguuggcccugacagacgacauggggcgcacgcagaagguggucuccaacaagcgucucauccugggcguuauugucaaaguggccagcauccgcguggacacaguggaggacuucgccuacggagcuaacauccuggucaaucaccuggacgagucccuccagaaaaaggcacugcucaacgaggagguggcgcggagggcugaaaagcugcugggcuuuacccccuacagccugcuguggaacaacugcgagcacuucgugaccuacugcagauauggcaccccgaucaguccccaguccgacaagguaugaugugugacucccaggggaagugggcuccgcggagaugcccccucccaucccugaccuuuucucuuccccgcgaguagggaucuaauuccuggacaccuccccuaccacuuccauaccauccuuuuucuuuuuccuuuuuuuuuuuuuuuuuuuuuuuuuuuuuugagacggagucucgcucuguugcucaggcuggagugcaguggcgcgaucuccacucacugcaaacuccgccuccagaguucacgccauucuccugccucagccuccugaguagcugggacuacaggcacccgccaccacgcccggcuaauuuauuuuuguauuuuuaguagagaugggguuucaccguauuagcaaggauggucccgaucuccugaccucgugauccucccgccucagcaucccaaagugcugggauuacaggcgugagccaccgugcccggccuuccauaacauucuuaaaguucuagauuaaguaaggaaaguucugguguuccuaagguaggcuaaguaaauaagcaaauggcaacgugccuugcaggauaucucgaaaugcuuagagaaaggauguggcaaugcaggaccgcuuccagagauuccagagcugcccaguauugcugcagaagucaucagguguccacccacaguguaguucaaacgacaaagggcaagugacugggggugggggauacaaggaaucagucaccgcugcuugcaacuuuaaccaagaauuucacuugaaaggaagagguccagaguuuauauuuaauccauaacacuauaaacaaagugugugccuuuaaaauaaggaaccaugcaguuuucucccuuugaaagcugcauagagggauuuuucauugcuugcuauaagcuaucaaaauucccaguaagagggccccccugguaguucccuuauucuuuguguuggugcuucagaguuguauuuuccaugguauucugaauucuuucuggguuggcuuugauccucaucuagacuucauuguuaagcauccuuuacccauuagcccugaagguagauuacauuguuuauggguuccccagagaucaauacaauuaguuuucaagaagagauguuaaacauuggaagguaauuuuuaugaguauuuugaaaaaauacucaugauuauuaaauuagccacaaauccaaagggaaaaauggauuuuuauuuccuuuuaaaaccucuuaacuuuuaaaaauaguuaagauuuuaagccugaaacuucacuuacaauuggaaacuuucucagccuucauugcacuuguuaaagaagucauuguuaauguucagucuuuauaauggaaaccugggcaauaacauaugagcuuuaguguuacucuucauguuuagauauuuuugggaccagaaaaagcuaagucaguuuuuuucauguaaccaguuuuuaauugcuccacaucuugguuaauuuuuuugacccauuugggaacaucuuucucuauccucugugggagagcauggaaguauuuugcuuuuauagaucgguguaugaaacuccuuauagauuuuauagagccacaaaagacucaaucuaggaauucuuuuccaaguaaaauaaaaauacaguuagagcacugugcagcgauucaagaaucacagcucuaguccaggccuguuuagaaaugaacuccaccacauuuacaaacacgggcucccaaaguguacaaaaggaaacaugucagauuuacuuaggaaccaagcaaaucauuucucuaaggaaaaacaguauuucuaucagguaauuaggaguuacccuuucauggaacacauauagcgcugcauuauauauuucuacagaaaaacaguaacuagugcuuuuguaagguaguaaaauauuuaaucugcauaaauaacuaguuggaguaguuuuucaucuuuggaaacuuuguuagggucuacagaaguagagaaguguuuuaauugcuguugcugcauagcaccucuugugaaacugaguuuugucuucacuuugaauggucuaacaaacaauuuggccacagaguagauuucccgggggaaaaaaaaaaguuuucaucccaaauuuccuaauucuacaaacuguuuuugaacaugcacugagagaaguaggucauuaauacugaaggaaggacugguuucuacuuuuuagaaacauaagaaauuauuugauucugggucugauugcugaguucuccauauaugcaacuaauauuaacaugagaguuacaaaguugccucuuacuuaaauuugaguuaauaaaaacucucaagaacacacuaccccuaaggaaaacacugcaauuaguuugcaaaugaaugaacuggaaaagaacauuuacuccuuugugguaacacucuauuuuacaaguuuagaagucauaaaauaaugggauuuuuauaauacuguugacaaucaguauuuuguaaacuaaaaauuccuuugguuaauaacuauuacuauuccuuaugcuuuuucuacuaugauuuuuuuuuacuuuguuaauacugcucuuucauugccaaaaaugauugcaaaugccccuuuuaauuuguguggauugagugcucacaagaguguuccuacagacuuauugaccccuucuagaaauuuccuacuguugagcaccacuaaagaugccugcuggucugcugaccaagugaacaggaacaggguauuagacaugaguugcuuuuugagaaaaaucugcuuuugugggaaauacagucgaaaaugauucugauugacuuaauuauaaauuaccaaggaaaaaaauaaggauaacuguauuuacaacuuagucauuuacaaaaauaugucuuccaucaaccuccuuuucuccuuguccugaaaacuucaauuugaucuuuaccaucuuaaaauaguauacuucucaaugccuugcuaguuuauuaaaaaaggacaaauaguaugucugauagaaaaauaggccaacaucuagauaaguuucacacuuguuuagguaauuguguaaaaguauggauagagauaaccauacugucaaagugguguauuaaaacauauugaacuuguucauucuaucacuuaauaauuuggaaaccuagcugcccaguaccauguaagccacuguagaaaacccuaaaagaacauaaaaugccaugucuagaaacagagcuuaaaauuaguaugaauagcaaaacccauauagaaaugacugacaaucacugcauucuggcaucaacggcaauaugguagagauaacugucaacaaauagaguacuaauaauaaucacuguaauaccuuauguuuauacagcacguagaagaauacagaggacuugugcaucaaacaucucaguuaauccucagaacaauuugaguguucccauuugacuacuugaggugacauagccaauaagagcuggagccaggacucagacauaggccaucauuucuaaguaaaauuauuuuucuaaggaaaacauuacacauauuagaaggaugcauuccucagggguaaggacaauauuugucuuuuuuuccagcagccaguuaugugucacauaauugauccugaauuuagcauauuuagucaggaaaugggauuugacaauaaaauuagacuuucuaugccuguagauuuugagacuuauaaaaaaguuaucauugguaucauuagauuuuagaauggcagauuggaggaauugaaucuacuuuuaauuggccaaauucuauuauuuuuacucaagauuagagacaccucuuugcucaucuaauuuuaaaauaugcuauuguuauugauaagcaguuugauguuuuaaaccuuuaguccugaauaaccaugugguuauacuuucuauaguuuucuauaaaugcuguauuuacauaggcaacugccauuauuaguugccuaagggaucauuucugcuacuauacgguauagaaucagaacuggacucuuaacauuguaaauuuuuuuguaagucauaagaaaaagucuaguucuucugguagacagaaaauagcugggaaaacugauuuacuguuugauauaugugauucuucuuggguuuagccaccuuuccuaauuuuccaauauuuuauuuuccaguuuugugagacugugaagauaauuauucgugaucagagaaguguucuugcuucagcagucuugggauuggcgucuauagucuguacgggcuugguaucauacacuacccuuccugcaauuuuuauuccauucuuccuauggauggcuggcuaacuucauacccccaugucaguguguguauucuguauguaaauauguuuauauuuauagagcaucaaucaauauaagcauuauugagaaaaaugugacccguaacacuguguucuggauaaaaaugugauuaggaaucacgcaaagugcuuacuguguaagcccaagaacaaaggcuuucugaaucuucucaggcaguucagauuuaaagcaccauccaaaccuuggaaauacgacagggugugguagaauucagcaauaugagaaaaccagccccuaaaaugauagccacaagagauuaauuguguuuuuuuuucuccuguaauccuuguacuguucggcugaauuugaagauuggaagacuuauauugagaccaguaacuuuacuguaaauuuacuuuguuucauugaaaaaacaaauugauaaacauauuaaacuggaagaauuuucuuuauucaaaugaaaacauguuugaugacuggucaaaaaauaagcucauaaucuauuuuuuucauguaguauauaagucaagaauguuuuauugucauuaugugaaaccaauauuggcaaauaguacuuuaaugaugaaguaaaugaccagaaauuauagaaaucuguguuuuccuguaaaaauagcacuauaguaucacuugaacaauuugauuuggcuuuacuuacuaggaagccuggaauucauuauuuuuuuccuuuuaugugccacuguggcuacuuuaaaucacucugagagguaaauggauauaggauugaaguuauguggguauuuggcaugugugugugaaauaaauauguagauagucacauauacacagacugagagauaaauuguucuugauugcuuuauuaucaucauacuaguguguucauuauagaguaucuguagaggugaauguaaaaguaaguccaaucuauuuucuuaugucauugaauuuguaguguuaacuugcauauauguuauuggauggguugucuuuuaaagcauuuacuaauguacucugaaauuuuuaaaagccuucagauuuguuuucuagucacuuuuuuccauaucauuucuaauuauaguuuauauccuuaaaagaaggaugccacaguaguauguaaaacccaaacaaguagaacccaagcaaauaaaauuauuuaaaauaauuuuaaaguggcuuaguacugccagucauguaaauugauucugcugagggucuuauaagaauugagauauaacaaugguaaaacaagcauucaagcacuuuuacaaaauuaccaaauucuuaaaaugaagccacagcuagacuugcauuucagguauuaaaauugcuuucuuaacugucaagaaucacaaaauaacaaaucauauuaugagugaauauggggagggcggggccaaucagucaaugauaaucugaacaaauuuuaagagcagauuuuagauuaauaauguuuuaucaccacuaauuugcccacaacaaacucaguauuuaauuuuucaaauuaaauauuaaauuauuuaaguauuuuaaauaauuaaaacauuaaauggcaacaccauagaauauagguguucucuggaccuauucuaaccacuuaaaauuaucuuaaguaugcauacauaaaagcaaccacuaugagaacuaccguguuagugguuuuucacuuacuguauauuacccuuguaggaauaguuuaaggaaauucauuucuuaaaaauauaguguccucaaauaauuaauuuuuuugcaaacuuuaguuauuacaggcagcaaaaaccacugucugaaacuaaaucuguguucaaagaugaagaccccucauuaaaagccaaggacguucuuaagauuggaacugacauaauuagucuugacuuacuucauuaaagcaagauucaauuccuuguucauuugaguguucauuauaugccaggcauugaccaguugcaauuuuaugguccagaauuaauauuauuauucguaaacuagcuauaauagaguauauacagugcugugggaauacaggggaagaagcaauuaaaucugcuagaaggguaagagaaaucuguaugcaggaggcaaugcuagcauuaagccaagaaauagugugaggugaucuuaucacacugauguguucaacuguuuaugggaaaaggaaacuaggaugguuuuauuugugaaauguucuacaacgcuagaacuguugaacuucuugggagaaaaggagaaucuuuguuuuguugugcugaguuugauuaguugcuuaaccaaguagaaagaaaagcacaucuuccugaucacaguuauaaaagaaacccugaggccgggcgcgguggcucaagccuguaaccccagcacuuugggaggccaaggagggaggaucacaaggucaggagaucgagaccauccuggcuaacacggugaaaccccaucucuacuaaaaauacaaaauuagcugggcgugguggccggcgccuguagucccagcuacucaugagguugaggcaggagaauggcgugaaccgaggaggcggagcuugcagugaguggaaauugcgccacugcacuccagccugggcaacaaagugagacuccaucucaaaaaaaaaaaaaaaaaaaaaaaaaaaaaaagaagaagaaacccugagccauuaaugugucucguaacuugaggaaguucaugaauucucugggcuucauccauuaagauucauccuuaugcuccugcaaguuucuuauauuuauguauuucuauucugauuucugaaaugauaaccuaguagugucugaugaaguuuuuucaugcuuauuuuauucuuugucacagaugaaagaagaauaggacuaauuggggcuaagaugaauuaauguaagugucagauacuaggcagguguuagggaugaaaugaugaaugaggcauggaccuguuccucagaguuuauggcccaguagacauaauuguauuaggacuuucugcaguugacauuugcauaaagcugacugacugaaggaacagaaagugagacagacagauaugaccaaauuuauacaaaccauguaccaacacuugaaagauggguggauauuuuccaggaaacagauuuugggcaggacauuccaugcacuggaaauagcaugaacaaaugcaugaaaauugccuacaacaugccuggcacauagcugugagguacccuaugaguuguugacuugaaaacauggaacugcacagggcauucaggcaagugcaagugguucaggggccagcgcagagcagagugcugaguaaagaugucagaaaaggaaagcaauggucugguacaagucuuguauagaacaagaaguuuagacuuuugaacaggcaaucgagauuugggguucagaaagauaaaucccaaaaguauggagaacaaaggaacucauuuuaaaggacuagcuaagaugcucaaucucuaaaaaaaaaaggaucuguauucgugagaguagagagaaagguuguuuaggaagagucaacagacuuuagcaaaauccuuuuauuugauucaugcauaacuccugauggagugucaaggaagacucauucacuuuucuuuccugccagaaaguugguucuugcaaaauagauuaacuugaugacuauguguauauuggauacuccuaauuuuagcucuguuagauauguuucuuucuaaggacaagcaacuauguauagacuuguuguuugaauuuuuuuucaguauauauauguuucuuguuuuucuauuuuucuacuucauacuguuaaugucaaauaucaaaaauguuuuccagcaauaucaaguuauggcaauggcaaaaguccuuguuguagaugagaagcauauaagaaaugguugccaaucuuuguuuuguaugaucuauuuagaguuuuaaccaaccuagaucugucagcuaagcuaauuuuauauuugguauacaugcaugucaaauaaaguuaauuuuacauacu

SEQ ID NO: 34823 - RNA, 38195 nt, Homo sapiens
ggcgcgggcagggagcggcuggcugucagcugagccgcgcugggcggggucgccaggccgcgcaucagcccuaggcaccccagucccggcugcccccuccgccaccgccgccgcccgccggcagguucccuggucagcgucccaucccggucgggaguucucuccaggcggcacgaugccgaggaaacagugacccugagcgaagccaagccgggcggcaggugagccagggcagggggcugcagcggugggcgagggggcggcggcuccuucccggcgggcgcuuccgcggccugaaaacgguacccgccgcccugccccgcggcccggagccugucggggugaggguggcgagggguggggcggcccucccgcgagacggcugcccugggaggauccccaagccucggcggguccugaccuggugggagaggguggguagugaacacagggugggcccaagaaggguccagggccggccucuuggccgcagguaaccccucuacaagucacccagagacuuggaggugacguccucccgcaggcugggaaggauuccgcagccaguuccucgccauaaggaggugguuacagacacgccugugggagacaugggaccacuacccgagcugaaugaggugcccagggucggugggaauccacauagacugcugugucuaggagaguguguacacucuauauagagagaauauuugaugaggccgagaaccccaaaggaauuguuuuugccaucgaaaugcauaagcuacaggaaguaaacaucgcucaaagaaaaugaaacccagguuccgaccuggccuccaccagcaggaaaacuguuguauggaaauguacaccaaggaacuguuuguaaggaugaaauggaaaaugaaagcauagaaaaguaaggcaaugugaggaccucagaagccuuuggaucugguuagcaaggugcaggcugugugaacagaagaacccaccuugcucuuuugacccagggagagaagaguuaguggugccaggcugccucccaggacaggcccaguuuuggggcgggggcuggagaagucccagggcagaccccaaggccagggauugcccuggaguggacaaggcaaguuuaaaugugaccuguagacagaggacgaucauugauuuaaguccuggcauaauucaucuguuuuuccacugggccaauuuuaggcguucuuuauauauuacguacaacacaauaaaaguaacagcuucuuuuuuuauaaacuaaccuuuagguugcauauuaugcuaggaauauaacuaaccuaaccuccacccccccacccccccacccacccccggaaaaccaaacuuuauucucgagggcaacuggacacuguauuauguccugccgaacccccgcccuuacuuagguagaggcgcauaaguauucuggccaugaaauacaccuucuguuuuauagagauuuggcauauuugauauauguucuuuggaauuuaugaaauagaaaacccaaaggaaaaagaaaaaaauuaaacuuuuuuuuaaaaaaauauuucauuuagaaagaaaaaauuaaaaguuuuuguuauuuccacuuugacauguguaugaggagcauuagaaucuguguuaugaagugauacccagauggcuuugcagugacagaaaacacuucuaauuuuucaaauaaguuagaaaggaggauuuugagaaucuggaagugaaugccguggaacuguggagaaacuccuaacaauacuggcaugcugaguuugucaccuacacagcagaaagcauuuuacagguauuagacuuaaaaauaccucauuaugcuauauuuucauuucauuucaaccaacauuuacugcaagccugcuaugugccagucucuaguaagaauaacauggagagaaaauagacgggcagacgauagcaguaauuucagaaugggcggaggagguggaaaugcagaguguucuugggugcucggaguagggaacaguucauaugacacaggacaucauauuuaagcuggacauugaucuguccaguggaaguuugccaggacacaaggggagccagacauuucgggcagagggcagaagggaggcaaggacgcagagacagaagaaugcagggaaccgugagcucuuuaacgugccuuggguacgaguguuuugguggcaggaggugacucuggugggucaguugggccugggcccugaaaggccacguuugucuuguuaagaaacugaaagucugucguguaugggaaggguggacucaggggaaugaccucauauugcaaaagaaaccaugagggcaagaggacugaaauugacagggcugaaagccagucauuuaggaggcuguuaaaauguauucaacagauauuuaccgaguccugccuucuauguggcaaguaauguucucaguccuggggauacagcaguggacaaaauaggcagaaccccuguccuuuguggaggucaacauggcugugguacagacaagauaagggccugaacuaagccuguggggauggagaggaggcaguggauuuuagaaacacuuagaagggccaggcaugguggcucaugccuguaaucccagcacuuagggaggccgagguggguggaucacuugagaucaggaguucaagaccagccuggccaacguggcaaaacccugucucuacuaaaaauacaaaaauuagcugggaaugguggcaugcaccuguaaucccagcuacuugggaggcugaggugggagaauugcuugaaccugggaggcggagguugcagugagcugagauuuugccacggcacucuagccugggcgacagagugagacugagucuuaauuuaaaaaaaaaaagaaaaaauaaauauuuaggagguagaggugauggcauuuggugacccauuagacuuggggaaaagggggcugggaagaaucaagccuuacucccagguuccugccuuggggagcuagguuaaagcugcugccauuuucuguauauuacuaaaauacgaagucacaauaucccuucuaguguguaaugacgaggcugcuuuuaccccauuaguaggaugcauacucuaaguucuuuuuccaaggugggaaggguuuagucaaugcaauguuagaaucuuaccccccuugugaacccaaacucuucauagcauuugccaguagccaacucuugucucuggucaaaaagcaaguuuucacuguuuaaaacucauuuaucccauguagggauugaaccuacgaauacuucauuagcaaauuugaagacuuggccauaccagggcaagggccuaaccuuauacuaugugcaguguccacuggggggaagucaguguaaggcagguaccauuugacacauuaugacuuucugaccacuagagccaucccacaguggaacagacagugccugcuaaggucacugcacucgugcucugucauugaaauacucaagccugcucuauaggaucaugugccaucgaaaccagacaagacauucuugcauugaauauauuggucuggaucauuucuaaggccaacucagcaaucagauguaugcucguguuuacaaggucaggucauuacuagaauuacuugaucucuggaauuuaaauguauauacacacacaugcacacacacacacacacacacacacaaucaggaauugagauagcagaucugggaauaaaaucuaggggacuugcuuuuggccauccaucuacuaggcaguccucagucuuccucauugguggaaucuugacaaauccugugcucaauuaauucauccuuccaucauuaaauaucacuuuugccuagaaauaacauacuucacaucuaggucaguugauuaugggaaacucuguuauuugauagaaucuuagaauaaauggcuuaguuccaauuucuguaaccuucgaagacaugugcaaggauauguaauguaucucugucuuuccucaguugaauguagcucaaggugauguuaaaaacagagaaugaagcuuucuguaacuggcauuccaccgacagauauuucauaugugcacugcacagugauagcucauagugauguccuaagauaaccuaagaauuaugaagugcccuuugagucauccaaaaucaguuaaauuaguuuuuuuuucuuuuuuuuuuuuuuuuuuuuugugagacagggucucacucugucacccaggcuggagugcaguagcaugaucuuagcucacugcaaccucugccucccagguucaagcgauucucaugccucagcucccgaguagcugggacuacaggcaugcaccacuacacccagcuacuuuuuuuuuuuuuuuuuuuuacuauuacaaaauuuauuuaacaaaaagucuaauaugaaaauguacaugaccuaacuuuuacaucauaguaaaacaggcccuauggagagaggacauggguuucucugcugaacagccauuuuuuauacucauuccaaggcuucuaacaugaggauacuguuuccucguauuaccaccauuccaguauuguucuguugcccacuagucgccaucuccacacauucaucuaucacaagauucauaaagggaucaagucccugcaauauuccuuggacgugucugccaccauuuaauuucaaugauaacuucuuguccauaaaucccuucuagccaucugguuagaacaugaugcuauucgagauguucaacaaaagguggcauucgagaucuucaaggaacgaagaagggacagcaugggggugaccaggggcccgaccgcaggaccgggaggcgagucggccagaaagaggugcaguggcugcuggugguaacuacgccgacgugcgagcucugcuacuaauuuauguauuuuuaguagagaugggauuucaccauguuggcugggcugaucucaaacuccuggccucaaaugaucugcccaccuuggcuucccaaagugcugggauuacaggcauaagccacugcacccggcaucaauuaaauuacuuuuaguaaaauuuugguauuaaguauuuacaugcuuauauuuaccguuuaugcuaacuucuuauguuugaugacauuugaauuacaaaauauuuuuucuaacaauacacaauaucacagaauuugcugucauuaggacaguuauagcuauucaugagagugacuggccugcccgugauacuugguguauaugcauugaagggugggguuuagauuguggucuuucuagaaacuaaagaauauuuuucacagaguucauaaggauuaucauuugcuggaugagucaauaaauaccacuagaggucaugugacuucccaaggccacacaucuggcuaaugguacaaauguuuuuuucuguggccucccuuagcacgaccccacuuuuuuccucguaugcuuauaaaauccgggcaaugugagaagucagaaacacugauguaacaacuagaaccaguuuuaacuuuauuauggugguaucuguaggcuugguggaggcauaaaaggucauggaggggcccggcaccguggcucaagccuguaauuccagcacuuugggaggcugagauggguggaucaccugaggucacgaguucaagaccagacuggccaacuuggcaaaacccugucucuacuaaaaauacaaaaauuagccgggugugguagcacaugccugugaucccagcuacuugggagguugaggcaggagaaucacuugaaucugaaaggcagagguugcagugaacugagauugugccacuguacuccagccugggcgacaaagugagacucugucugaaaaaaaaaaaaaaguucauugaggaaaaaaaucuuaacaguuuucaaagaaacgucucucucuuuucuucccucucuucuccccuccccuuccuuucauuuucagaaaaaaaggagaaauuugugcauauaauaagaugaaaccaaacacacuucuaaaaaucugcuuagauccuuucuuuaaaaaaaucuguugaauauuuucauggccuuugcaaaauauaguauaaucacugaauaccuaagaaaaauuaacuguuggcaaguaaaugauacagaugacaaggauuuucucuuuuaggucuauuaccuagaauuuuaguauuccucugcaaauuagguaggaacacuguuacucaguaaaacccuauuuuaaugagaugauucuggguacaaaaaaaugaauuuuacagaaaauuagaaacugauggucuauucagauuauuuuugugagaagaagagcagucuguucuagucaccuaaugcuaagcuauggaacacuucugcauuauaccuguuuucuaagugaauuugggugugugacacauagauacaaaaaguucaaaaaugaauccuaugguuuaucaguguuuucugcuucguaagauugccaucacccucauuacaugacuacaugagaaugccccucuugguacuagcucuuguaggaagaaguggcacaggcuguacugucacagggugugguagguagcucugucucugauuaccuacaaguuccucacaccaaaaggagguuaccagguauugcuuccagaagaucuacagaaagcccaagguauugccuccuguggccaaggacgcaacaccacaguggugcauuuuguuuuauuuuaauugauggcuauuaaaugcacacauagauaucaugacacaguuacaugucagaaacaggcagugcucuuaucucuaucuuccagggacugauaucauguguaauggauucuucacaacucaggguucacacaggcuccauagucaugaguggcugauggaucucauugagaccagugccuuucccccguuagaaaugggaugcucgcuuccaaguucucuccucaccccuuuugugcaugcguggcuuucugccugaucacaguuguauaguguacauuggugcuuaauaccuauuuauuggauagauggauuuuaaauuauuuucuaagguccaggagcaguggcuuaugccuguaaucccagcacuuuuggaggccgaggccagcagaucaccugaagucaggaguucgagaccggccuggcuaacaugaugaaaccccgucucuacuaaaaauacaaaaauuggccaggcaugguggcugacgccuauagucccagcuacuugggaggcugagucaggagaaucacuugaacccaggagguggagguugcagugagccgagaucgcuccacugcacuccagccugggcaacagagagagacucucaaaaaaccaaaacagucuuuuuuuuuuuuuuuuuuugagacucugucgcccaugcuggagugcaguggcacgaucucggcucacugcaagcucugccuccuggguucacgccauucuccugccgcagccuccggaguagcugggacuacaggcaccugccaccaugcuuggcuaauuuuuuguauuuuuuuuauuagagacaggguuucaccguguuagccaggauggucucgaucuccugaccucguaaucugcccgccucagccucccaaagugcugggauuagaggcgugagccaccgcgcccggcucaaaaacaaucuucuaacaguaaacauccuggaaguaaauaauaugcuuuuucaggcaugucucuggacuuuggccauucuugaccuuuguagaaugcgugugugggccauguguacacagcgucagcggggaggaguugccuuugcuauguauugcuuuauaaucuauccccaucagcucuugaagaaaauacaucauuuucaccaagugugaagguggaaauuugugcugaaacauguuugccugggugguugguaacacagaagcagaguggggauuuacucauuggucuugcauuucuauguccacauggaugccucuacaaaacaaaaugauauguguaaaaaaauuucagaccaugcaauaccuaaagauaucuuagucuuuucaguaugcauugaaaaauagacuauuaaagccuaaguacucaguaauauaacuuuguuguuuuacaagguguggcuuugauagcugguggugccacuuccuggccuuggaugagccguacgccucuguaaacccaacuuccucaccuuugaaacagcugccugguucagcauuaaugaagauuagucagugacaggccuggugugcugaguccgcacauaguaagcauucaaagaauguuaauucucccuuucuucuuaaccaaaaacacaauaaacuaaauauagguuuuaaaacagcuuuuuugagauagaauucacuuaccaugcaauuuacuugaaauaaggagauuugaauuugaagauuugcaugggaaauuuuuuucaugauaccuugcccaugucuacauauauccugaucaucaugaugucauacccucgucucccucccccauuucccaaauccuuauuguacccuuuuuuuuuuuuuuugguuugagacggagucucgcucuguugcccaggcuggagugcaguggcgcgaucuuggcucacugcaagcucugccucccggguucacgccauucuccugccucagccucccgaguagcugggacuacaagcgcccaacaccaagcccggcuaauuuuuuguauuuuuaguagagacgggguuucacuguguuagccaggauggucucaaucuccugaccucaugaucuguccgccucggccucccaaagugcugggauuacaggcgugagccaccacgcccggcccucauuguacccuuuuauacacccauacacacacacgcacacacacacaugcacacaugcgcgugcacacacacacacacuuuucugaagcuacauauaccuuuuuuguuuaaaaggaagaaucaaaaauguccaaaauguaacuggagagaaagugggcaacuuuuggaguaaguauuagcaaucgccaauggguuugugggacucccggggaccccuuguggggcgggggacagcucuauuuucaacaggugacuuuuccacaggaacuucugcaaugucccaucaaccucucagcugccucacugaaaaggaggacagccccagugaaagcacaggaaauggacccccccaccuggcccacccaaaccuggacacguuuaccccggaggagcugcugcagcagaugaaagagcuccugaccgagaaccaccagcugaaaggugagcagggcuggccccugugugccccauucauccugggccugcaagaaaugccaucccuuugcacuaaggcuugguggugagcucccuucuccccguuuccauaggugguagcugguggggaagcacaggauuuagcauuuggcaaggcuaaaucuguucugauuuuuacuuuuggaaacagguacaaguaaaaacuguguguaucucaaggaaguagcauaaugauauuuagcccauucaaaaggaaaaagaggcugggcgugguggcucaugccugucauuccaucacuuugggaggccgaggcagaaggauugcuugaguacaggaguucaagaccagccugggcaagauggcaagaccugaucucuacaaaaaaauuaaaaaaaaaaaaaaaaagcugggcgugguggugcacgccucugguccuagcuacuggggaugcugagguuggaggauugcuugagccugggaaguuggagcugcagugagccaugaucgugccacugcacuuuagccuggaugacagagagagacccugacucaaaaaaaaaaaaaaaaaaaggaaaaaggaagaaaggcugcuaugguuccagaguuaguccuauauauuaccuuauuaagagaaagcauccugguaucucaagauggcuuugggcaggaccaguauuugaaucuaggaguaguaagaacuuccuuagcuccuaguaaccauagauauuuagauauuugugcuguaguggcgguacccaaauccacuuuauuuucuugggauuuuuaaggacuagaaaugauguucaucccgcuagucuuuucuguaagcaaaaaccacuucgucuuuuugcugcugacccuugggccaaggcuaagcauggcaucuuucaauucagagccauguggucaaguggacuagagggagauuugguucaucagaucaaguccacuuuccuggugugugacuccaucacucugaaccuccugcagaagccaugaagcuaaauaaucaagccaugaaagggagauuugaggagcuuucggccuggacagagaaacagaaggaagaacgccaguuuuuugagauacagagcaaagaagcaaaagagcgucuaauggccuugagucaugagaaugagaaauugaaggaagagcuuggaaaacuaaaagggaaaucagaaaggucaucugaggugagcagaccgauccauugugauguuguuuuuuuuuuuucccuugacauuugcaguggaaucuuacgugucuagacuccuagaucaaaaccuuucaugguucagucuggauugguguuuugccuggucuuggaagaagugcuuuugcugaaaagauugguugcccuauuaagggucauggauaaucucuuuuagaagaaagaaauuuguaaagcuuugaccguacugauuguaggcaaaagaacaguaagguuauaaaucauuguauuguauucauuauagauggugcagaugggccucugccuagaaccaacaauuguuuuuaguuugucuuugauauaaaaaauauguuuaaaaaacccauuacucagaauuuuuacuuguugaccuugucuguucucucagucuaaaauggagauuauucacuuuacauuuuccuuuuuaaaaaugcuuuggaaaaugucauguugugguaggaggcuaucgcauugccacagaugaaaagagaaagagacacauuuuucuuaacccaaagaaccuggaaaaaugugcucauaccugggaguggaugucaaagaugauaguaaugacacaacccagaacaaguuugaaauccccacugggcgugguuuguuaaggaguccucugcuguccaugccaaguguggggagaaugggugugggugggcuuugaugggaggaaaagggcaggagguuggguggugggaacguuuuuuccuuccuuucuggaauuuuagacacagcuuaugaguccacuguugccaaagugugguugauuauuucuaugauaucagauuauuccagcauggcaaggaaggcuuucuuucuugucaugaaguuacuuuaaauuuugauuauuugaauacaauaaaauaauguaaaaauuuccauuuuaaauguuaugucaaaauaaaucgugggcuaggcacgguggcucacaccuguaaucccagcgcuuugggaggcuagggugggcagaucaccugaggugaggaguucgagaccagccuggccaacauggcgaaaccccaucucuacuaaaaauacaaaaauuagccaggcaugguagugcgugccuguagucccagcuacuugggaggcuaaggcaggagaauugcuuaaacccgagagguggaggaugcaguaagcugagaucgcgccauugcacuccaaugggcgacagagugagacucugucugggaaaaaaaaauugucagguaaaagcugaaauuuucuacauuaaagcacaaggcauaaagguguugagaaacuuccuugucaguaggugugggggcaauugagucucauggccagguccuuaguuugauuuguauuuguuuuuugacuguuuuuuuuuuuuuuuuuuuuugagauggagucuugcucuguugcccaggcuggaguacaguggcauaaucucggcucacugcaagcuccgccucccagguucacgccauuguccugccucagccucccgaguagcugggacuacaggcgcccgccaccacgcccagcuaaucuuuuuguauuuuuaguagagacgggguuucacuguguuagccaggauggucuccaucuccugaccuucaugauccgcccaccucggccucccaaagugcugggauuacaggcgugagccaccacgccuggcuuggcuuuuuuuuuuuuuuuuuugagacagggucuuggcagucuuaaacuccugggcucaggcagucuuccugccucagccucccaacuaauggggacuacaggugugugccacuacaccuggcuaauuauuaaauuuuuuguaaagaugggggucuugcuauguugcccaggcuggucucaaaauccuggccucaagggauccucccacuucagccucccagagcucugcgauuaagggcaugagcccauggugcccagccuuaguuugaucuguucauucacuuuacuccuugucaucuccaggaccccacugaugacuccaggcuucccagggccgaagcggagcaggaaaaggaccagcucaggacccagguggugaggcuacaagcagagaaggcagaccuguugggcaucgugucugaacugcagcucaagcugaacuccagcggcuccucagaagauuccuuuguugaaauuaggauggcugugaguuuuugguuuuauuuuuguuuugagcaaacuauaaagccuccccuggaaagaugaaacaaauaccacuuuuucuugucaacacaagccaaggauugaggaaauuccaguguagcaaagauaaauuggcucucauuuucuaaguauagcauaaugcauguaaggguuaucauagcuaaaauggaaaaauauuaauuaccuuuuaugaugaaagcuguagucuuuuuuuuuuucuucaucauguccuggcaaauugaacauuuuugugaccagaaaaggaaaaaacccacacgaacaugaacuuucugucauuuuucaaacuaggucucaaagcuguauuccgcaguucacuuaagggagcgcaaacauauuuucacaacagaacccucuuuuuuuguuuugagacagagucuuacucugucuucccggcuggaaugcagugaugugaucucggcucacugcacccucugccuccgggguucaagagauucucgugccucaaccucccaagucgcugggacuacaagcgcaugccaucacacccggcuaacuuuuuguauuuuuaauaaaaaagacagguuuuugccauguuggccaggcuagucucaaacuccuggcuucaagugauccacccgccucggccucccaaagugcugggaugacaggcgugagccaccgcgccuggccaacagaaccuucuuuucaaacaaagugguaugaggaacccugauacauuaaaaagaagaagaggagaaaagaaagagcagaacugcucugguuguagguugagggaguguccuggcuuuuccuucccuuucaaaagcagcuacucaggagccucugagaacugaguuugaagccauugcuaucaaaaucaaauuucucugcaaccccagaugaagugggcuaagcgagggggcccuaagcucuugagaagcaucuguuacaacugugccugggcauaggggcagcccuauugaagagcagagcaggucgaugcaccagcugggggccuguccuucauugcuacuaacaaagauuagacagggagaaagauagacaaggauaaaauccucuguaguauagauggucacuuucgaugagucagaguacauaucugauacaggaaaagggacuggccggguguaauggcucacgccuauaaucccagcacuuugggaggcugaggaggcaggaucccuugagcccaggaguucaagaccagccugggcaaccuggcgaaacccuguguguacauaaaaaaaaaauacaaaaaguuagcuaggcacauuggcacacaccuguacucccagcuacucaggaggcugaggcaggaggaucacuugaaccugggaguuugagaugcugcagugugccaugauugugccgcugcacuccagccugggugacagagcaagacucugucuuuaaauuuaaaaaaaaaagaaaagaaaaaaaauuguguccuuggaagagaaaaauguacauuguagauaagucaggaggaguggggaacaacuugcaaaaaagcucaccuacugguuauaucugaaauaugaaugucugacugucuuugcuuucugauuuauuugcugcaauagaguuaggaaacagcucugaauaacccugccauccauucccccucauacauuucaguggccaaaaucaagauaauuaaaaugucaauugaaaagcguauuuugccagaguaccccuucugcaagugaucgaagauuacugagacagaaguuuaaccaaagaaacuuacccuucugucaauaaccgauaagcugcaggaaacccaacagcauaugagaaguuuccagaugaagcuucuuccuucagggugcaugguuagcaucucauucucccugucagaugagugacaguuauuuuuaguguaaacacguuuugcaugcguuucuucugugaacuggaaagcacugcccaagauuuaggaagaaacaucaaaaauaucuagaacccccauggccccaagcagagaaaaaauauauguaucuauguuuuuuauaauagauauaucuguauuuauauuauauaaugaauauauaauauauucuauaauauauaauguagaauauauucuacaauuauauaauugcauauauaauuauauaauuauauaauuauauaauuauauauacauauauauaauuauauaauuauauaauuauauaauuauauaauuguauaauauauucuacaauuauauaauuguauuauauacacuuacauauguaucuguauuuuuuauaauagauauaucuauauuuauauauauuuauauauagauauaucuauauuuauauauauuuauauauagauauaucuauauuuauauauauuuauauauauagauauaucuauauuuauauauuuuuauauauagauauaucuauauguauauauauuuauauauauagauauaucuauuuuauauauuuuuauauauauuauauauauauauaaauuuauaauauagauauaucuauauauuuauauauagauauaucuauauuuuauauauauauuuauagauauaucuauauuuauauauauauuuauauauagauauaucuauauauaucuauauuuauaucuauauuuauauaaugaauacauauaauauauucuauaauauauaauauauaauauaacauagaauauagaauauauuauacaauuauauaauuguauaauauauauacacuuauauauguaucuguuuuauaauagauauaucuguauuuauauuauagaauauauauaauauagaauauauauaauauauucuauauuauauaauauagaauauauauaauauauucuauauuauauaauauagaauauauauaauauauucuauaauauauaauauagaauauauuauacauuauauauuauacaauuaauauauaauuacauauauaacauuauauauuuauauaauauauauuucuauaucuaaauaucuaaauauauuauauauauauuuauacguauauaccuagaacuaucuuugugcauuuuugaagauuuucccugggagcuuauuggaauauaaaugucuuucaaauccugugggucuuagacuaucuuguucccuaagugaccuguggugcauacaaauuucuaaugggaaccaacuuggccaagauggugcuuugugaaucucauucacagaaacugccucuuuuuuaacuuuaccucagugaguucuagcauuuugcauuuuaaaggaaggauauguggaguugucaccagcucuguaugaccuuaaccuugagaaagagggaacugccaaggaaagggaggagcagauaagcuuucauguuuacagagucagguagaauguguauggcgagaugaaacugaccuucacgccuuagcugggauauuuauaaucccgacagggcgugccaggugaggggaggguacguuuccauuuccucugagccaccccguuuaaacagugcacaucugaauguuuggaagcuuccuuggguugcaugucacaaaaauucaucuuuugucuuuuucuucuuuugacaaagaauuugucuuguagacauauuguguuaaaucccuugcauuucuguuuucacaggaaggagaagcagaagggucaguaaaagaaaucaagcauaguccugggcccacgagaacagucuccacuggcacguaugugaaggaagacucgggcugucaggcagacaggcugggcaggcucgucacugggugcuugucaccggaggucaaauguugugaccugaggaaguaacuucuuuaugauuuauaccaggaucuuuccagaauauuugguuugaaugcuauuuaauguugcagcucaaacuggcaaagauuaaaaacuguuugguuccuguuuggcucacacugacugcucuguucuaguggugucucaccuccagcagaugaaaagugaaagcaaacugguucucaaucaagucaaugauuuguuccuaaucaaagacauguuugcucauugguuccccggugccauuugacccagaccagccugcccagcuuccauaagugaaauauuuucauuuucuuuucccugcuacuucccaguuauaagcuggcauggccaauacuggaacaucuuuuguaacaaugacugauagcacucucagucauuguggguguugccugaaagugcccagauuucuuaucuguggagucucaaguguaccuguccuauguagaugugaggaaacagacaucuuaaauaguggcagggccuuggggagggaggcagaccuagaacugagcgccugaaccucuugacucucgcaaagcagugcucaccaaggagacugcuagcucgccuucugcaagcugcuuacuccuguaaucaucuauucaagagacgauugucugaaaagaacucuaaggaucucuuuuuuuuuuuuuuuuuugagacggaaucuuguucuguugcccaggcuggagugcaguggcgugaucucggcucacugcaagcuccgccucccggguucacgccauucuccugccuuagccucccgaguagcuggaaccacaggcgcccaccaccaugcccggcuaauuuuuuguauuuuuaguagagaugggguuucaccguguuagccaggauggucucgaucuccugaccucgugaucugcccgccuuggccucccaaagcgcugggauuacaggcaugagccaccgcgcccggccaggaucucuuaucucacagacggauaagagauccaucuuuuuuuuuuuuuugagauggaguuuuuuuuuuuuuuuuuuuuuuuugagauggaguuucacucugccacugaggcuggagugaaguggcgcaaucucagcucacugcaacgucugccucccggguacaagcaguucuccugccucagccuuccgaguagcugggaauacagguggccgccaccacgcccagcuaacuuuuuguguuuuuaauagagacaggguuucacuguguugaccaggcuggucucgaacuccugaccucaggugauccucuggucucagccucccaaagcgcugggauuacaggcgugagccacugcgcccagcuaucucauagauuuguaaaaccuucuuuguauaacuugaugaaugugcauauagaaugacuuacaaaacgugaaaaaaauugucuuccguuauguuucuaagcccuuguauaaggaagaaaguaaguauuagauaauauucuuucgucaaacacaguaauuggcauaaacgaaaguaauucccuuuuuugguuaacaauucuucacguuucccccaaauugcuuuugucauauuuaaagacguuccuggaaguagugggaaauaaaaaagcccugguugaaauaucaaagccacuuccucaucauucauauccagaugcaaagaccgcuuccucuuuuaagccacauggcuauuuuuaaaauaacagcucuguaccauuugugaguaucguaauuaguuugagauugauuuccagguuuggaguugaagcuucagaguccuggaaaccgggauuuaauccuggcuguuuauuagcuaugcgaaccugagucggugacugaaagaguagcugccguuagcaucaucauagucaucccucauguuuuguaacagugaucaugauucuguuugucacugauaugucucuugauuuagucagauuuugaaaucgagaaaaauacuugacauaucaacagagccuccauuucucugcucucauuauuugaaaccacaagugaaaaagguuuucuccccuugacuuaagcugugauggucucuguuaacuuggagaaaggccaguggucuguacaaugugccuuuaucuuuugucugacugcaguccccuuugagacuagaucucuggaaagcuuggcaccuucagccacggcugccucugcugaacuguuccgugaguuuugugguguggugugagguacacagugacuguuuggaggacgugggugugugcauuguaagcuggccucuccagagccucacugagucuccacaccuucccuaggaagcauggaggagcuuggcacugggggucccaggaccagcugugcuuguucacuaguugagaauuaguuggagaauguucuggaaagcaguuccuuuaagcuggucccaguuauauuggguuacucucuucuuagucuuuggaauuuuucugaugaaaaccuuuuaaccuuuauacugaacagggcauugucuaaauauaggagcagaucugcagauggggccaagaauuacuucgaacaugaggaguuaacugugagccagcuccugcugugccuaagggaagggaaucagaagguggagagacuugaaguugcacucaaggaggccaaagaaagguaugaaauagguuaacuugaaauauguguuuuuuuaaaacagcuuuccugagauauaauuaagauaccauacaguucacccauuuaaaguauacauuucaguguuuuuuagaauauuccaggauugugcaaccacuguuacuacaauauaauuuuagaacauuuuuucccccaaacagcacucacugucugcuccuccaagcaaugugcuuucugucucuauagauuuggccauucuagacauuucauauaaauggaauuauacagucugugguuuuuugugacuggcuucuuucacguagcauaauguuuuugagguucaucuacaacguagcauguaucaguacuuccuuuuccuugcugaauaaccuuccauugucuauauauacaacauuuuguuuauucauucaucaguugauaaacauuagaguuguugccacuuuuuaccuauuaggaauaaugcugcuaugaacaguguguacaaguuuuuacugggauauguguuuuuaauucucugggguauaucguuauggguggaauugcugggucauacgguaucgcuauuucauauucuaaggaaccagcaaaucauuuuccaaagcagcugcgccauuuugcauucccaccagcagugcaugagcauuccacuuucuccacguccauaccaacacuuguuucuuacuguuuucacuuugacuucagccauccuaguggaugugaauugguaucucauaguucugauuuguauuucccuagugacagcgauguugagcaucuuuucauguugaccguuuguuugauuuggagaaaagucuauucagagccuuugcccauuuuuaaaaauuggguuauuugucuuuuuauguugaauuauaagaguucauuuuacauucuggauacaagacccuuauuaaauauaugaucugcaacuauuuucuuucuuuuuuuuuuuuuuuuuuugagacggagucucguucugucacccaggcuggagugcaguggcgcaaucucggcucacugcaagcuccgccucccggguucacgccauucuccugccucagucucccgaguagccgggacuacaggcgcccgccaccacgcccggcuaauuuuuuuuuuuuguauuuuuaguagagacgggguuucaccauguuagccaggauggucucgaucuccugaccucgugaucugcccgccucagccucccaaagcgcugggauuacaggcgugagccaccgcgcccggcugaucugcaacuauuuucucccauucuguggaucgucuuuucccuugaugguaucauuugcagcacauuuguuuuuauuuugauguaauacaguuuaucuccuuuuucuuuugucaccugugcuuuugaugucccaucugagaaaccguugccuaacccaaggucacaaagauuuacuccuauguuuuucuccuaagaauuuuguaguuuuggccuggcgcgguggccaaaauuacaguuggccaccgcacuccagccugggugacagagugagacucugucucaaaaaaaaaaaaaaaagaauuuuguaguuucaucucugacauuuaagccugugguccauuuugaguuuguuucuguguauguugugauauaggaguucaacuucauuagacucucaguucuguuucauugaucuauguuuguccuuacgccaguaccacaaugucuugaguacuauagcuuuguaguaaguuuugaaaucaggaaguguauuagcccguuuucauacuuauaugaagaaccgccugagacuggguaauuuauaaaagaaagagguuuaacugacucacaguucagcauggcuagggaggccuugggaaaccuaacaaauccuggcggaaagcgaaggggaagcaaggcaccuucuucacaagguggcagaaaggagaaggaacgcaggaggcacuaccacacacuuagaaaaccaucagaucucaugagaacucacucacuaucacgagaacagcauggaggaaacugcccccgugauucaauuaccuccaccuggucucucccuugacacauggggauuauggggauuacaauucaagaugagaucuggguggggacaacaaagccuaaccauaugaggaaggaguuaacugugagccagcuccugcuguggcuaagggaagggaaucagaagguggagagacuugaaauugcacucgagagauagugccuuccaacuuuguucuucuuuuuaaagacuguuggcucuucuggguucuuugcuguugcguaagaauuuuaggaucagcuuguuaauuugugaaaaaagccagcugggaucuuacuagggauugcauuguauccccaaaugauuuggggagaauugcuaucuccaggauugugucaucgcagagauagucuugcugcuucuuuuccagucugaaugccuuuuauuucuuuuucuugccugauuauccuguaaaaaaaaaaaaaaaaaaaaaaaaaaaguguuacauagaaauggagagagcaggcauccuugucuuguuccuaaucuuagggggaaagcuaaggccccaccuuugucaucacuucagagguuccuggugucacucaugcuugaguguccuggaguucccacagugugaaucugguugcuucuuggcugucccuacuguuggcucaaaggucggccuucuugggcugguaaggccccacucagaccuguacugccaaauuuuccuacuauuauuuccucucccuuuuucuuuguuccuguaggcacauggcuuuuugaagguccuuuuaguagaguuugggcugggaaaaaaauugcaugcaucuguucaacccauuaucuuuaaccacagucucuuguuucauuuggauugggacggcuuuccugugguuaugauuugguguuaagaaugguguuacuuuuuuuguugucguuuauucggugacuuuuaaacuuagcuguguccuaaaaggaaaagucuuuccuucucuaaugaauucuuaugaaugagauaccauguucauggaacacacaugcauccacauguguaaacacaaacaauuucaaaaacauugcugcauaggacaguugcauggaaacaaaugguguucaagaugaguuucacuugccuuuuaccucuguguguauuugucugugaaucaauucuagccaauuuuaggaugaaaaauaaaacuaaugcuaauauagugaauguguagagauuuugaaaaccccugauccuuuaucccaauuguaaacaauguucuuuuuaguacuucuguaauaauugcuauuucucuuaaagccaaagagaaaguaacuuuucuaucuucugugauuuuccagaguuucagauuuugaaaagaaaacaaguaaucguucugagauugaaacccagacagaggggagcacagagaaagagaaugaugaagagaaaggcccggagacugugaguccuaagauuccacggccacuaccacacccacacacacgagaguaguccagccacugaauucaaaucuugugauggguuauuugcuuuagaaauauagaaaucauguugauauugaauauuaucuaucuauuccuuuuauauguccuuguccugcucugugucaauuguagcgagauguauuucuuuuuuguuguuguuguuggagauggagucucacucugucgccaggcuggagugcaguggcacgaucucagcucacugcaaccuccgccucccagguucaagcaguucuccugccucagccucccaaguagcugggauuacaggugcccgucaccacgccuggcuaauuuuuguauuuuuaauacagacaggguuucaccauguuggccaggauggucuugaucucuugaccucgugauccucccaccucggccucccagagugcugggauuacagauaugagccacugcgcccagcugcaagauguauuucuaucaguauucuacaaaacgauuuccuaugucucuucuugacugauuucuucuccucgguccuucaaugaacaagccuacuguaggaaaaggaauguuguccacuuuauaaugagaucauuugaggauaugacuuagaaacuugagggagaauugaaagauuuggguucuaucccauuacugguuugaauaaaguaguuugaaaggaaaagguucacuguugucuuguucaguguugucugguaauugagagaggugccuucgagucugcagagagucuucagcuuucggaaguuaaugaagccgugaagguugauagccauaggggcccacgugaaaggcauuuacauaaaauauucacuuuagguaauuaauuuauucaacaaauauguacauugaaugccuauuguaugucaggagacugagaccuuacuguugaaagaagagagaacauuuagaaaacagaugaagagaccaccagugaauaauaguucccuguugacuaaaacgaauucaacagccaguagcagggaaauauggucuuucaaggcaucagaaacucauuuacaaaaauuauagagcugccaggaaaaaggcugcacaacaaaaauaguugaguaaacuagaaacauacacugggaagagaguaugggggcaaguuguuagcuggauagauaggacugugcuuugacaccucuguggucuaugaucucugaaccuggaauaggguucauuuuaauagcgauaaagucauuaucccagugcauccaaauugauuaguucaugcuuuauuaggaaacagaaguuacccaaaacuuagcaaaccuaaguaccaaguauccaaaacauucuuuuccuacacaauguuugggguauugucaaaguuggauugauucaccagccagucuuaauuggcuacuaaugguucagccuguuuucuccuaaagagguuuguuuaaugucagaugauaauuguacagauauguuugggauuucccguaugauagguuggaagcgaaguggaagcacugaaccuccaggugacaucucuguuuaaggagcuucaagaggcucauacaaaacucagcaaagcugagcuaaugaagaagagacuucaagaaaaguaagaaugagagagcaauuuuauccuccuuugaaauauacauuuuuacaaaguauacuacuauauaaaaacauaguuuuuuaacuauguuaugacuaaaagaaaaauagacaccuaauuaaaauauaaauucagaauauacuaauguuccaguuaaugugugagcaugaaauacuuguaagaugggggguuggggacuggagaacuuuaauucugccauuuaggggcauuuguuaaauguacgagccuggguaagaucucuacaguaaagcugugagcuaguuuuccuguuacugacuuaagcugaugacauugaugugaguaagcauaaagaaagaugaaaagagcauaaagaucuugagugacauuuauuuggaaaaaggucaauuucaauuuguuauuucaaucaguuaauuauuucaggcuaacauguagauugagcguuuggcauuugcuuguuucucuugauguaagaaguuacccaaaacuuagcaaaccuaaguugaugcuguucuauuggauucauuggcaaacauguuucuagcacaauacggagguguguguguuuucuugagguuauaauucccaacacucuguagaauuaugguaacgugauacaacauggcagcuacaacuaaggacuuuggacaaacagaccuagauuuaacauaugagucugcaacuuauuuguguugggcaagguauuuauuucaauucucugagccugucuuggcauuuguaaauuguguguuguaauuucuucuauauacauuguguuaaaugauaugucuaaugggcugggcauuaaugcuuugugcauagcugucauuuauuuguauuauauugaaauccucuuuccgaucuuuaagaagacuuaggggaacuuccuuuuucccuuauugaaucuuugucagaaacuaaagucuuugcaauugacagaaccuauaacuuuuuuuuuaauauaaaagauauccacacaucacuacaugagaagcgccuuagcuaauuacuacuguggucuguguuuaaauacuaaaaauguaucuguaugacuaguuuaaacaauuauucaaagaggacaguacugcaugugagcuuagaucuguacuuuuuuauguuuaggcguaaggguucagaaauauggccaggucuagugaagaagcaaggaggauuauguauuucauuuugcauucauaaacccuacagcccuaaaauucuuauauuguacauaaccuugggguuuguuuaaaagccacugcgacguaaaggagcauuguuuauccucaugaaaucuugaccuuucuuaggugucaggcccuugaaaggaaaaauucugcaauuccaucagaguugaaugaaaagcaagagcuuguuuauacuaacaaaaaguuagagcuacaaguggaaagcaugcuaucagaaaucaaaauggaacaggcuaaaacagaggaugaaaagugaguauguugagucagaagggcagcgacggggcagaggagggagaaucgccuuuuuauacagauuggaauucggauuugagaauaaauuuuaaaaaauuucuuuuucacuuaucugaaggaguccuagcagaccucucagagagggggauaaaauuuaaaaguuuugucauaauaaaauuaugcugauuguuugcacucugucuugauuuuucagaaaagauuuuuuuugagaguaagaaaugcuaguaggucguggggugauaaagguaggcgagaagauuuuucuacuggaguguucagaagguugggaggcaagacuauaaguuucuaugauauuuuccccaggauuccauuuuuuaauaucuuuuuuaauagguccaaauuaacugugcuacagaugacacacaacaagcuucuucaagaacauaauaaugcauugaaaacaauugaggaacuaacaagaaaagagguauucacugaaaaaaauuacuuccauagccuaguaaugaacagaaacuguugaacguuuuguauauaaaauaguuacaugaauccuucacuaaaucugguuucaaagguuguuuuccaauguaucauuauuucuugcaucuaggguuuguaacuucugauguuccacauauguguaaugugcuuuauugcguacaaagaugaugugaauguccuauggucagggauuaagcacuucguauuucuuuuuuuuuuuuuuugagacggagucucgcucugucgcccaggcuggagugcaguggcgcgaucucggcucacugcaagcuccgccuccuggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucgugauccacccgccucggccucccaaagugcugggauuacaggcgugagccaccgcgcccggccagcacuucguauuucuaaggauagguuuguaggagagcuaagagcaugggcuucuauggguaggaagggccaucugcucuggggaauugugcaagaccagcgugccugcugucagugaauuugggacccuggaaucaucagccugcaguuuaaauucauaauaauggaccaggugugguagcucaugcauguaaucccagcacuuugggaggccaaggcuggaggaucauuugaacccaggagucugagaccagccugggcaacagggaggcccuaucucuacaaaaaauaaagaguuaaccaagugugauguucgugccugcggucccagcuccuugggaggcugaggcaggaggaucacuugagccuaggaggucaaggcugcagugagcugugaucacgccacuguacuccagccugugacagagugagaaccugucucuaaaaaaagaaaacaauaaauaaauuaguaauaaugccagcauggugugauaguuuagagaccacagaagcuugugaauuagaagggaucuuugaauuuuuagccuuguaaauauacucuuuguuuuucauuuauuuucuuuuaaagaggagguuuugccauguugcccagaaugguuuugaacuccugagcuuaggcaauccacgugccucagccucccaaagugcugggauuacaggugugagccaucaugcccagcaguaguguuccucucuuggaccuaauaauuuuaaauuuaaaacauguuucuucuuuuccacugacugcaggaaguaacaaguggcaaaauaacaguaucaacgagucacagccuuauuaacauuggaguuuguuauuguaucccugauuucgguguuaucaccuuuuuuuuaggaauucauuauuugcaagccacaacuuaaauacaacuuucugaauaaguuagcguugcugauuaauagacugguuagagcugauacauuuuuuagaucucgcuauguugcccaggcuugucucccacuccugggcucaaacgauccucccaccucagccucucaauucuaggcaugagccaccacacccggccagagcugauaauuaaaaaaauaaaccuuuuucuaauauuuuacuaaaacaggcagaauuauuucaaaaccauuucuagaauaaauguuucuuuuucagucagaaaaaguggacagggcagugcugaaggaacugagugaaaaacuggaacuggcagagaaggcucuggcuuccaaacagcugcaaauggaugaaaugaagcaaaccauugccaagcaggaagaggaccuggaaaccaugaccauccucagggcucaggugaggcaccuuccaaaaccccagcugagcgaggccagcccugacuguauucucgcauuggaaagcaaugguguuuagaauguuuguaauuuucuauuuuauauauuuuuucacccgugaguguauuaaaacuuuaaaauugaaacauuuggaaagugcucaguggaucuuaucuguucuacauuuaauagguaauuggauucuuuccaguuuguggcauuaugauuaacguugcuaagacauuccugugcauguugcucuguucacauguggauauuuuauauuucuguuggguacacaccuaggaguggagucgcuggaucauaggcucugcauguuacucacuuuuaacagguaaugccaaacaguuuuccagagugguuggaccaguuuucacucccaucaacagagaguuuccauggcucuacaucuuaccaacacuucuauuaucagucauuuuccuuuaaccacucuggaggguauauagugguaucucauuuaauuugcauuucccugaucacuaaugggaaagaguacuuuuucaaguguuuuuggccuuugagguauccucuuuugugaagugccuuaucaagccugccuuuuuuuuuuuuuuuuuuuuuuuuuuuuuuuugguuugguuugccuggcauuuuuuuugagacagagucuugcucugucgcccaggcuggaguacagugguaugaucucggcucauugcaaccucugccuccuggguucaggugauucuccugccucagccucccauguagcugggacuacaggcaugugccaacaugccuggcuaauuuuuguauuuuuaguagagaugggguuucaucauguuggccaggcuggucucaaacuccugaccucaggugauccacccacuuccaccucccagagugcugggauuacaggcaugagccacugcgccuggccuggcuuuuuaaaaaaauguaaugacuucuauguauacugcacauacaagucuuugucaguuauuuuugccuuuucacucucauaaaggugucauuugaggaacaaaaguucuuaguuuuaagguaguccaguauaucagccuucucauuuaugauuaguacuuuuuguguccuguuuaagaaacuuuuacuaccccaaggccaggaagauauucccucuguugucuucuaaaaauuuuguugucuuaccuuuuacauuaagauguacaaaccauuugaaauuggcuuuugucuauagaaaaugagguaaggguaaauauuuauuuuuuuccuauaugaauauccaguuaacuuggcaccauuuaagccaucuuuucuuaagugcucugcugcccucuucaucauaacuuguguccauauaugcaugggucuguuucuggauuuuguucuauuuuauuggucuacucauauaucuuugcucugguaccaugcugucuuauuauaaagcaucaaacuuuuuuuuuuuuuuugagacagagucuagcucugucaccaggcuggagugcaguggcacgaucuuggcucacugcaaccuccaccucccggguucaagccauucuccugccucagccucccaaguagcugggacuacaggcgcacaccaccacgcucagcuaauuuuuguauuuuuaguagagauggaguuucaccacguuagccaugguggucucgaacaguugaccucaugaucugcccagcugggauuacgggcgugagccaccgugccuggccagcauccauuugaaugguuggaucaugaguuauguccauuucucaguuaaauaaauauuaccaagcugucuucuaaaacugccuaaccaaaauuauacucucaccaaaagauaagcacuccuauguccucacauucuugcauuauuuuaaaaaccuuggccaaucugaugaacauauuauuuuuaauauaauaaugucagcaguuuguuauucccuacauacagacucauuaucaccagcugcccagaguggcugaccccugugaaaugcagccaguugacugguacuuauagcuuuaguuuuauuucuacaggaauagagccucaaccugcauucucagcucuucagagcauuuccuugcuuggguaacucaugucauuggguucuuccacucugcugcagucauguauuuuugcucauucuagacauagacauuuguuuucucuugauggauacucuugcucauucauucaauaacuucuuuuuugagcacuuauaauaugucagagacggccgggcaugguggcucacaccuguaaucccagcacuuugggaggccgaggcaggcagauuacaaggucaggaguucgagaccaaccuggccaauauggugaaaccccgucucuacuaaaaauacaaaaauuagccgagcguguuggcgggcaccuguagucccagcuacucgggaggcugaggcaggagaauugcuugaaccugggaggcagagguugcagugagccgagaucaugccacugcacuccagccugggcgacagagcgagacucuaucucaaaaaaaaaaaaaaaaaaaaaaaaaaaaaucagacacuguucuuacugccugggauauaggaauagacaaaacaaagacucuguucuuacuggcucaaagcuaguaagugauagaagugagacuaaaucgaauuuaagucauacuccaaaacacccaugauccacugccaacacugugagaugcugaaccacucacauugauaggauaucccuuaaaaugaucucuuuauuacauacuuuuaaguaacuauaguuuugauagaauauuuagauuuuuaauuuuacuuuuaaaauaauggauaauaauuuauaucucagaaccagcaaauuugaaaagaaaaaacuaauuuuaaacauagaaagugaaaaauuaguauuaaauuccaauaccaauggaacaguucacucaauuagcugacagcauuaaauauuaaaacacuauuaaguguuuuguuauuuauaauuuuuuaaaaauuacuuaauuuuuaaaauguuguguuguuuuguuuuuugaggcagggucacacuccugucacccaggcuggagugcagucgcaugaucgugguucacugcaaccucuauuuccugggcucaggugauccucgugccucagccucccaaguagcuggaacuacaagugcaugccaucaugcccagcugauuuuuuguauuuuuaguagcgaugagguuuugccauguugcccaggcugucagcaggaggccucaguuccucaccauguggucuccuccagagggaugcuugggugcccucaugucauggcagcuggcuucccccaaagcaagugauccaacagagagcaaggagugacagcgucuuuugugaccuagucucagaagccguacaccaucacuucugcggcauccuggagguuacacagguuggguuuauucauugugggagggaaacauacaaggugaugaauaccaagaggcaaggaucacuggagccaucuuaggaggcuggugaccacacaugggacauggauugaauauggaaaaguucaugggaaauggucuucugucugguucaaaugcugauuuggccacuuaacaaauuuucccaagauuaagagccguuaaguuuguaaaaugaggauagccauucuuuauucucaggauauuucauaagguaaaauaagauaguaaauguaaagcacccaacauaggaccucacacauguuuggaauuuaacaaauagcaucuauuugugaugauuauucuuuuaaauuuagcuuaagaccagccuucauaaauacaccuggcagaaucaauuuacuauauuaaguaaucauuuacuauauuaaguugauccugaauuguuuauuaucuaaaaguccagauaauuuugcugaauuaaugguaccuacaguauuuaaacuaccuauaucagugcaguugcaggauuuguguuguuuaaagcacacacacaaacacagcuuguaucugcuaucggaauguaccuggaaagucauggucauuauacuguuuucuagcaggauugugcaucugugauucacaagggcuauugaaggauacagcacuaccuccucaucgcauaaacacuguaagaaucugcauucaucuagguacuaacuucuguaucuuuuuuuccucuaacagauggaaguuuacuguucugauuuucaugcugaaagagcagcgagagagaaaauucaugaggaaaaggagcaacuggcauugcagcuggcaguucugcugaaagagaaugaugcuuucgaagacggaggcagguaaggaaaagagagaggaggacccagagcucacaucagcauggccguagaagaggugccuguccaaagacguuccugauuugaacuauaagaauagcuguguucgcgccacugcacuccugccuaggugacagagcgaguccccugucugaaaaauaaauaauaauaauaauaauugcuucacuuacacuucaugugaucauguucccaacacuuaguuugucuuacaggaaagcuugacagagacuugugggagcuugaucaagcuccuugcuuuuagauaagcaaggauuuugauuugauuuuaaaauguuguguuguuuuguuuuguuuuuugaggcagggucucacuccugucacccaggcuggagugcaguggcaugaucaugguucacugcagccucaacuuccugagcucaggugauccucgugccucagccucccgaguagcuggaacuacaagugcaugccaccaugcacuuguaacaauaauguuacgugucccaaugaccuaucuugccaucgucacggaugaaauauucguagcacuuuaaauuccugaauauucuuuaaaaaauacuaacaaaaauuacuucugacuuuuagaaauuuauuuugagaaaguuuuaaaacacagcaaaauucagagaauaaaauaacagacucuacuauguacuccuuccugcauugacaacugcuuuuauuugcuucaaguauuuuuuuuuuauuaaaggaaaaagggaguuguaguuagaaucaaagucuccuuuguuccccauccaucauuauauuccuuucuucuuuaccuugugcuguuaggaauuugguggguagcuuccccaucuauuuuauacuuuuacauaucacauacacacuuaccuauaucauaucucaaaaccagauaauauugauuucucuguguuuaaguuacaaaaugaucacuguagguauuguucugcagcuuacuuuacauaauauuaugauuuugagcucucuugauaugugcggauguaauuuauuauacuucauugcuguauuuugauuuauaaauaugccacuucuuucuaaucuguuuccuacugaugacaguuugguuauuuccugauuuuuuuuaacuguaauuauuuacuuucacuagucuccuagugccaauaguauuuaaaacuaaaauuagucugguuuuuaugaaccuuggcaguguaguuugagucuuuuuuccccuacuucuguggacugucugcucaguguugucauguuucgggguuguagaacaucacacagcguguugcuuuucguccuggcaggcaguccuugauggagaugcagagucgucauggggcgagaacaagugacucugaccagcaggcuuaccuuguucaaagaggugagucccgugugauccuggauuuucaggaaauagcuauccuaugaaaaagaugcuugaagaaaaauuccacuucauucucuacaauggauuccaaaucaaggcaccaaaaauauagcacccgucagucucauuaccacagcacucccaucuccauccauuacccaccgaauccagaccagacccuucacccugccagaaggugccuggcacggccacacuuuuucuuuuuuuucuuuuuuuuugagacagaauuucgcugugucguccaggcuggagugcaguggcgagaucucggcucacugcaaccuccacuuccuguguucaaacgguucuccuuccacagccucccgaguggcuggaauuacaggcgugcaccgccacacccagcuaauuuuuguauuuuuaauagagaugggguuucaccguguuggccaggcuggucucgaacuccugaccucaacuaaccugccugucucggucucccaaaguaccgggauuacaggcgcaagccacuguacccggccuacagccacacuuuuaaaccgugucucccucuguucucuuacagacauuagccagacugaaucauccccuugaacuuguccuaagcuuguauuugcuuguauuaugcccuucacagagacgcccuuuucuuaugcauauuccugucuuccuccagucucuuuccagugaccucuuaccccaucuuuaaaaucuauuucaaacuccaucuccaugaacuguuuccauuuugaacuuccaaaguacuuuauuccucuauguugguaccugucugcuauuuuauagguguuuguguguucuagguagauacuuaaguacuuuauuuuuauuucuauuuuuauuuugagacagggucccacucucuugcccaggcuggagugcaguggcaugaucguggaucacugcaaccuccgccucccggguucaagcgauucuccuggcucagccucccaaguagcuaggacuacaggugcacgccaccacgccuggcuaauuuauuuuaguagagacaggguuucaccauguuggccaggcuggucucaaauuccugaccccaggagaucugcccacgucggccucccaaagugcugggauuacaggcgugagccaccacgcccggcuaauuuguauuuucaguagagacagcguuucaccauguuggccaggcuggucucaaacuccugaccucaggugacccacccacccaggagaggucuccuagaacagaauguaccuucucagaagcagaggcaauggucucauuuauucagcagauacuuuugaguccuccaggaugugcaagagguacugcuuaugcugggagucagagagcaaaggcagccccggaugcugaccccucuucucuggcaauggggugauuagaaagcucccugcuuuggaaaccaugcuuuaugaucaauacauaccucuucagaaaugcuucuuaaggcugcugaacacaaucucaaauauucauacauguuacuacauccaaguaauguacuuagaagcaaauaaagguugccuccaaaaacaaacauuuugagagccaaaccaaagucuaggcugaguccaaaaaaccaagacgguuugcauugguccagaaaggucagaacagagagaugcccgggagccagaaauaauuucuugcauccaucacaguuuguauggauccaggaccuagcuagggucagggcuuauuucgaacaugcucugauugaggcuugaaccucaguacuacuccaaaacugggggaaaugauagggugcauucuuccaucauuccuccuuguuaacuuuauguagauaacuccuguucauucucaaggccccucucaaguuaauuggucgcaucuaggaggccuuucugcaccaagaucuaaacuaggggcccuucccuuucucccauggacacccuugcaccuaacacucaccuggccuaacacucgugccuaacacuuuugccacgccacugcugccacaucucucaccuggcuucuccaccacgucugucucccggcacacagcagugucuuuauacaucccagaggauucaaaagugucugcugaacaaaugagaugauugccucugcuucugggaagguacacucuguucuaggagaccucuccugggcucuguggauuucuuucuccacauucccuuccucuuuugcuuauauccucauucaucccuuuucuucucgcagauauccuaguauuuacuagaacaugcauuguccuguaccuagaacugaaaccauguauuuucgcauaccuugaaacugggauacaguuuaaauccuaaaagaaugcaccaaugcaccuguaaucccaguacaugggaggcugagauggaaggaucaguugagaccaggaguucagaaccagccugggcaacauagugagaucccaucccuacaaaaauuuuaaaaacuagccaggugugguggcacgugccuguagucgcagcuauucaggaggccgaggcaggagggucacuggaucccaggaguuagaggcugcagugagcuaugauugugccacugcacucuagccugggagaaagagcgagacuccaucugucaagaaaaaaaaguaaagaaaagaaaaaaauccuaaaacaggccaggcgcaguggcucaugccaguaauccuagcacuuugggaggccaaggugggcagaucaugaggucaggaguucgagaccagucuggccaacauggcaaaaccacaucucuacuaaaaauacaaaaauuagcugggcgugguggcgcgcaccugugaucccagcuacucaggaggccaaagcaggaggaucacuugaaccugggaggcggagguugcagugagccaagaucgugccacugcccuccagccugggugacagcgagacuccgucucaaaaaaaaaaaaaaaaaaaaaaaauccuaaaauaauagggaagcagguaucacuuggagagauuuuucucuaugugcaucgugaugacuucaguuaaagaccaaacaccugugcucaugucccacuacguguugaauacgaaguugaacugauguuaaaacucgccaucuguucuucaagugaaacaaacacaacugccugcaaaauggaacuaauggaauuaucauacuuauucccaggagcugaggacagggacuggcggcaacagcggaauauuccgauucauuccugccccaaguguggagagguucugccugacauagacacguuacagauucacgugauggauugcaucauuuaaguguugauguaucaccuccccaaaacuguugguaaaugucagauuuuuuccuccaagaguugugcuuuuguguuauuuguuuucacucaaauauuuugccucauuauucuuguuuuaaaagaaagaaaacaggccgggcacaguggcucaugccuguaaucccagcacuuugggaggucgagguggguggaucacuuggggucaggguuugagaccagccuggccaacauggcggaacccugucucuaccaaaauuacaaaaauuagccgagcaugguggcgcaugccuguagucgcagcuacucgcgagguugaggcaggagaauugcuugaacccaggaaguggcaguugcagugagccgagacgacaccacugcacuccagccugggugacagagggagacucugucucgaaagaaagaaagaaaaaaaggaaggaaggagaaggaaggaaggagaagaaaagguaccuguucuacguagaacaccuuugguggaguuccaucaacucgcaaaguagaauccuuaccuacuacucuucugauaauaauuuuaauauuuuuuauguuugguugaugcgagcagcugcacugcucaugcaguuagcuagcaugugacaucaugugacaaaguucauguaauuagauggaagaaaccucacugauuaauuuuaagaaccuuuuagggaugcaggaacaaugaaguggccacaguaugugcuguuuuugaagcauuuuuaaaaacgaauuguaguuguuuuucuucauuuaaaauggaucuguuggagguuauguguguauguuguaguuuuauugcagccacaauaauuuuaccaaaguuuucacauaggcaguuagccuuuacuuaauaucaagacaagugaaaaaauauuggcaucgaugaaaccgauaacauuggccucauuggauuucuuuacccauucacaguguaaagaaguuaccuucaugcuuucauuguaccugcaggccugugggcuuguacaguagauaauuaauuucuaaaaagaacagcugccuauuuucuuccuagguuagguuauaucuucauaaucacaagaauuagugauggcaaaauaaaauuuugcuuaugaaucuuuuacauuguuuauauaugauuaauaucaucauauauauuuucuguauuaagcucauuuggcuucauuuaagcuguauacuuagucauauaucuuucauuaguucuauggauaugagcagaucccuuuacuggagcccaguaugugcugugugaguuagaagucauucuugcugagaaggugaauagguagggauuugccuuguuuuguaagucuacaauuugccaagaguaaauaacacuggaccagcuguaaaaguaaacaguguguuuaugcauugagauacuaaagcauuu

SEQ ID NO: 34824 - RNA, 38195 nt, Homo sapiens; identical to SEQ ID NO: 34823

SEQ ID NO: 34825 - RNA, 38195 nt, Homo sapiens; identical to SEQ ID NO: 34823

SEQ ID NO: 34826 - RNA, 38195 nt, Homo sapiens; identical to SEQ ID NO: 34823

SEQ ID NO: 34827 - RNA, 14136 nt, Homo sapiens
agagacagcugggccacuggcagugagggagagugaggauggcagagaccagugcccugcccacuggcuucggggagcucgaggugcuggcuguggggauggugcuacugguggaaggugagccaggcagaaccuggggugcagcgggggcccaguggguucugaggacccaggccaccaguguggagcuggcaaggagaggagagguccccaaacccagcuggguguccggucccauuggcugccuuccccucugugcccggacucgggggguguucugacaauugaaccugugaggugcagcacacugcccgcugggagcagagaggaagccaggcaagggucagggagggagggacuuugaaaggggacaucugcccaggagaugaucaagagccaggcuuuaggacuuuucaugucccuccagccgggagaaaauuuaauccacuccuuggaaauccugcugagaaucccacauaagaucagucccccaaaaggcucuggggacagacagcucugccuccugcucuuguguggcuggaaccaagucccuucagcucucugcccucaaugccuugacauuccgaaugggugguuguaaagauuaaaugggauaauggguauaaagugcuagccuaaauagacucuaggguauuuaaguucauucacucccauccucuccagccccaccacuauuuucacugugucuacuccuaugagcccaagcacuucaccucuggaggcaaccugggucugcgagguaccuaccucaaccuagaaucccuaagaugcucgcugaggccagagcuagagacagugucaauccugaaucugggccagcccaagcuaaauugauggagaacgcagcuuugguucaaagcagacccagagaaaucaucagcacguuuucucaccuaaugagaacugacaauggagaggaagugacagucauuagauugguccugaaggcucuggacacgacugucugguggccccagcccgugucucccuuuccugagaacccuacaaucuagcauccuuccagguccucaaacaugccauaaaauuuuaccacuuuauuuuuuggaagggguuuaaauuuacauuuuuauuucauguuuaaugacuagaaaugucauuauauacacaaugcuuugguuuuuauuuuauuuaaaauauguuuuaaauuucaauagcuuuggggauacaagugauuuuuguuuacauagaugaauuacaucguggcaaaugcuaggacuuuagugcacucaucacccaaguagcguacauugugccucauuuguagguuuuuuuaaucccacucccucucccacccuuccccuucugagucuccagaguccauuguguccucugaaugccuuugcguacucacgguuuagcucccacuuguaacugagaacaaacagcauuugguuuuccauuccugaguuacuucacuuacaauaauggccuccagcuccauccaaauugcuguaauaagacauuauuucauuccuuuuuacagcuauuauuccaugauguauauauacuacauuuucuuuauccauucauuggucagugggcacuuacauugauuucguaucuuugcaauugugaauugugccucgguaagcauagaugugcauguguguuuuuggcuggauuaaauggcagaucuacuuuuaguuauuuaaggaaucucuauacuguuuuccauagagguuguauuaauuuacauauucccaccagcagugcauaagcauucccuuuuuaccacauccauggcauugaucuauuguuuuuugacuuuuuaaugauggucauucuuauaggaguaaggugguaucucauuguaccauagcaugucuuugcacaugcuauucccuccuggaaugcucuuccaugcacuguccugcagguaagugcuucucauaguuuugaaggcaggauuuuuuccuguuccucacuuuagauaggggaagcugagguucagagagcuuaaggagcagcaagcgaggcaaccaagccaaaauucaaggucgggucucucuguugccagaguacgcccccuucauguucacuuccaugccuggcguccugggcagcucccagcucuaacaucgacucuucuccuuggagccucucugacuuugcucuacaguccuuggagaaggcauuuugaaauccaaaaggccugaauucaaguuccagcuccaccgcuuacuagcuguguacuuagggcaaguuagcuagugucucugagccucaguuucccagcuauaaauggagaagagaguauccaaguaaagauugaaugagaugacucauauaaagugcuuauccuggugccuggugugugcuaagugccuggcagcugucagugauuaugacuguuauagcaugaagcaugcuacccuauauugauugucuuccuugucuguccaggagguugcugauguuccauccaccccacacacacuguucugaccccagcugggccucagcagccccaaugccagcccccacccuuccuuucagcucucuccggucucagccucaauacccugaccaucuucucuuucugcaagaccccggagcugcggacucccugccaccuacuggugcugagcuuggcucuugcggacagugggaucagccugaaugcccucguugcagccacauccagccuucuccgguaccagcccccuccccaguccacaggcucugggguccugccuggggccugaccccugggcccugggcagccaggccaagggcauuuuuacuacuuacagaaaauuggccaagggcagagggugggcaggcuaaaaugggcugaauuccagauugauucugaagaacgacagcugauuucuggaagacagggguugcugaaaccugaugaaagagaugguaggcuguagagaucaaugguguggguucuguaaccaagcaaccuagguuugcauucuggcuucagcauuucuaguucugggcuucuuccauaaaucggauauuauuuccuaacucauauaggugguuggaaguauuuacuucuauuauguguaaauaacuuaaaauaaugcuugauaccuaggacucuacguaaguguuugugaacacaaaugggggcguuaucaccacuacugcacccguauguaucugggcuccuggaguggagggacaccgaugcaguguggagaggauaagaggcagggaggggcagucauaacuagcuagugucuaauaccuccuuauacaaaaaccagggucuuccaucacagcuucagaagguguuuauaaaauuguuuucugaagcagacuggacauucucauucugguuuuggacacuacagacggaggcuggagcccccccggaugugcaugcucagugcugaccagccuggggggucugcaucagugagaacucuuccucccacagagaauugaaguuuccaccuuugcuugcccuuuuaggcuggggaggccugggaucuccccucugacuuugccuucaucuucugugugaccuuggcuucaguaucuuugccucuuugaaugucaguuuccccaccuaucaaauacaggcaugagcucuccugugacagagggaucugaucacgcagagagagccuauggcccaaccauggugcagucaaagucacccagccuggagagugugcauugggcuccaccccuucagcccaguuacuugagcuccaacgccucauaggaaagacaccaauauuaaggcccucuucagagaagaagggcagcauucaggaacacacacuccaagcuguacuuggcaggugugggagguggaaaggaucggaggagaggucacuggugcccagugucucccacaggcgcuggcccuacggcucggacggcugccaggcucacggcuuccagggcuuugugacagcguuggccagcaucugcagcagugcagccaucgcaugggggcguuaucaccacuacugcacccguauguaucugggcuccuggaguggagggacaccgaugcaguguggagaggauaagaggcagggaggggcagucauaacuagcuacugcuccguguuucccaguacagggaaguguggguaggugugagugugcaugcauaggcacucauuucaggaaaggagggagggugggagagugugcaggagagcuguugggccucucuugccauuaccgcaaccuugggcaagucagggauccucucugaaccuuagucuccuccucugcgaaaugauuuucuuuuucuuuuugagacggaaucgcucuauugcccaggcuggagugcaguggugugaccucggcucacugcaaccucggccuucugguuucaagugauucuuuugccucagccuccugaguagcugggacuacaggcaugugccaccacaccuggcuaauuuuuguauuuuuaguagagaugggguuucaccauauuggcuaggcuggucuugaacuccugaccucgugaucuacccaccucagccucccaaagugcugggauuacaggcgugagccaccguacccggcugagaugauuuuaauaaccaaucucaguuuuauuuugaaaaugaaaugagaucagggauacagaaaaugcccuugcagacaggcacuacucugcagacaggcgcagagaggcuguguguauguguguguagcugggcaugugcccuggcaccccacacuuccaugaggcuucaugaaaacuguccagcucuagauuucacaagcugcacugucaaauaccaucuucauaauuggccauaucaguguacaaacugcuccauuuuuccuuaauuuuuuuuuucuuaaaagugacucauuuuuuaaaauguaaacaccugcuacaagcucauucuaaacaacaucugggaaaucacagguuuaauguucuuauaauuuuaauacaauuaaaauaaaaaccuguucaccagagaccaucuagaacccuguuuaccaccagggguacauaaacauguuuuggggagcuguggcucagcuaacccuccuagcaaaccuucagcucacagccucggaagcagaggcacagagaaguuaagcagcuugccucgcuacuaagggcagagccagcacugggcaugaccugguaccuccaaguccugagcuaugaauuuguccagcacagaggcugcugugaggucuauagccagcacagccucaaaccauggcauguccucuuuggaauccacagaacuucccuugccauagucacauguauagcccccuucccugaaaauucacugccccucaugggucucuccugucauaugccucucuccaggccaaaaugcugccaucggucucaucauuuugaguggcgauagguuagcccucuuguccacuuggccucagagcacuucucccacuccuuacaucccagccccugccccuaaugcucccuuggaccaucuuauacacacacacacacacacacacacacacacacacacaccaccuucucagauagcaacaggcuucucugccucaauauagaacaguuaaucccugugccagaggccuuagaucaaagcccuuucuauacugagagcauggcagagcagugugaaggcaggcaaaggggaaugaggaggucugaauucaucuacuccaucccugggugguuguaggcaugucaccuuggccaucuguuucuaaagcugaaagucugaggcagcacaaugguccagguagauauuaauuauugugcccacagagaauuguuugaaccuggaaggcagagguugcagugagcugagauggcaccacugcacuccagccugggcaacagaaugagacuccgccucaauaaaaaaaaaaaaaaaaagaagaagaagaagaagaaaagaaaaggccaggcaugguggcuuaugccuguaaucccaacacuuugggaggcugaggugggcagauaacuugaggucaggaguucgagaccagccuggccaacauggugaaaccccaucucuacuaaaaauacaagaauuagcugggcaugguggcaugagcuuguaaucccagcuacuugagaggcugaggaaggagaaucgcuugaaccugggagguggaaguugcagugagccgagaucacgccacugcacuccagccugggugacacagcaagacucugucucaaaaauuuuuuuaaaaaaagacaggaagaacugacaucuuaacuauauugagucuuccuguccuugcacguaauuaucgugcccacaguugggaugggaggugucuuagucugcccaggcuccuauaauagaaugccaucgacucgguggcuugaacaauagaaauuuauuucucaguuauucaggcugggaaguccaaaugcgaggugucagcauggucagguucggugagggcuugauucuugguuuauagauguucaccuucuugccauguccucacauuaaaagagagagauugucacucuuguguuccuucuuucauuuuuuugaaacagagucucacucuauugcccaggcuagaauguaguggcaccaucucaguacacugcaaccuccgccuucuggguucaagcaauucuccaccucagucuccugacuagcugggacuacuggcgcaugcagcauguccagcuaauugugucccuucuuauaagggcacuaaucacaucaugggggcuccacccuuauggccuaguuaucucccaaaggccccaccuccaaaugccaucacauuggggauuagggcuucaacauauaaauuugaggggacacaaacauucaguucauaucagaaggucacauccaagcaaacuccaucuggagccguaucaguagaagcaaacugucagaugagggagguuguagacaugcucuucucucccgaucaaaacccaucuggagaacuguccucugcccugguaucuuauauacaaaggaguaugacaaaaaaacaguagacagaggagggcaccugggaagugcauccugaagccagauccaggaggaaccacugaaugggaaggacccaaugacacugcagcagagaggggggcuucagggaagggacuagaggaggucaaaucagcauggcugguucauaucaaaagaugcugcugggacccagccucugccauuggcacugagauugagccccaacccccgagucaagcauucucagaggguguccuggaagcaggggcaguggccugauucugagcaagugcugaggauggugguaaguccagacuucugccuccauccccuaugacccucaccugaaccccugccuaugcuucuuccugaacuuugucucugaaaacguaucugucucuuugccacucccucgucucuguccucugaagaagaugguauagugugucuauuuggagaccuucaccauccauuaucuauuucauucuucauaacaauccucugaggcaaggauuaucauucccauugugggcgagaauacuggggcucaaagaagcucuucacuugccugaggcucugaguuauuaagcaucagagcugggguucucauuuuggugaguugcuuaguuaaccccucucucagccucaauuuuuuagaccguaacacagggauaagaaaaccuccuucuggcaggauguaguggcucaauccuguaaucccagcacuuugggagacugaggcugguggaucacuugaagggacacucuucgagaucaggaaguccauucuuucucacucuaucaggccaucuccuccucacaaccuccucuucuuccucuguccugugcagguagccagcuggccuggaacucagccgucucucuggugcucuucguguggcugucuucugccuucugggcagcucugccccuucuggguuggggucacuacgacuaugagccacuggggacaugcugcacccuggacuacuccaagggggacaggugaggugggaggagcagcuucgaggcuccuauccaugggaaucuuggcuuugaacuccuaugacaagggugccccagcugaaaauccaaauggggaaaugucaacguuugccagacaaucucaacuucuuaaucaugauacccaccugcagguggacagugggacuggaaaaagccuguucugaaaacuggccaggugaugggaaugcugugaaaauugggacccagaguugaacccaaaaagagacaucauacagggagccauuggcuugugucagugguaacagucaccaagccgcaccaccucuuagccaucuucagcacagucgaccaucauggcucugaccucaucaauuucuagagggagccacgcccuugguacaauagauucaaagaacauuaagguccuugcauugggagggaaugcccugagcauacgcuaugaggcaaucccuggagaaauaggacagaaugcaugaggguccccacccucauggggcucguguucugguacugccccaucaggaggcucuagggagacaagggcuuagggggauccuuuaggaacugccuugaggaauggucacaugggcuccagccccucuugcuuccaccagagccaaguugcauucaucugcuuuacccaugguguuuaaucaugaggcaucugcacuggaugacaggcuuuccaggugaugcauucuugagaacgcugggccugguccaagugucccuccauggcacuccccagccaggguccaguccuuccagcugccccucccugguggacggcuccaaggugacauagucuucccuucagaaaaugggaaucugucucccugggacucccacuauucccuucaccuccccaugaccacuaccugggaacccaagcucuucuguggugccuucaaccauuucuucagugacacaguauccagucuucuuguuaucccgucuccuuuuaaaaccuuugggccuagaaugcuccuugaauguuccuuucucuuggcccacugacauccccaccauugggugaacauguuucccaaacuaaaauuucccauucuucaugcuugggggacaaacaggaaagcagggcugagcacuugaacaagaaagaggccucuuccuccuuguagcucccuggcuccuaaagggaguucaccugggacccgggagcaaccacacugcgagcuugucugaauggggcauuuccccacaaccgaucaucuagggcagagcugguggguccuugagggcagcuggccaucccugagagcuaaccccaauccuccacccgcucucccuguagaaacuucaccagcuuccucuucaccauguccuucuucaacuucgccaugccccucuucaucacgaucacuuccuacagucucauggagcagaaacuggggaagaguggccaucuccagguaaggacccccuuccggaguguuaucugauggugcagcgcagcuccaggcucuuggugucccgaacaaagaauuggaugugacacacacaaacagcaaaacaaauauucauugcuuuugcagcaaaagcuuauucagcacaguauuacacucucagagaggggaggguggaccaaucucugcgaagugagaucagcaccaguuugguguauuuugggcucuuuuauauguuuauuuuucuucucuucccaaggcugccuaaucucuagccagcaucugccuuuugauugauagguggguugcuuauguuacuuuggcccuugugugcuugccugucaccuccaucccauaaucuuaaguacaugcaugauaugcaguccauaugcaucagcuuuaauaagcuuauuaucauacggggucauuuuaaggauacuuuuucucucuaaugcacaugcgcaucucugaggagcugccccugacagguuugguccagaccuagcuggccacaggagcuucuuacucacuuuuuaaucuuauuuguguuuugguugcucaacuucuguuucuugucuugcuucuugcucacugccucuucaccuugcuucugcuucuacucauuccgcccuuuaaccuccaauucccucugcuauucuccugccucaagagcagcaguaauuucucguuuccucucagggacaccagggaauaugaacaaugugacagacagcaaccagggguuuucugcguuuucagugaucaagagaaaauccagcuugugcacagcauaggauguuagaacuggaaaccacccucccuuugcucagaucgccaaggccuggggagcaaggaucaggacugcucagauucacccagaccccguaacucuggggaccagggcucccuacuggacacauccgugcuguuccacuuaacucuugccaaggaugugagguuuggcacaaaguuacaggcuuuuuaaaugcuacuuuuaaaccgcuuugagauguuuaauuuaaucacagucacaggguggugcccaaaagauaaaaaucaaccuauaagcacauuuguccaagaaauacaauacuucaaaauaagcccuccuggccauuuuuuaguuucugaauuacuauucccuugccacgguuuuauuuuaacuuggucaccuggaugaccucuagcaaaggagucguaacaagcaacaaagauuagaacaaauucagaucuuaauauuauuucuuugcaaccacucuaugaggaaagagguuuucuuucuuuuuuuuuuuuuuuuuuuuuuuuaggccgaguuucacucuuguugcccaggcuggagcgcaauggugugaugucggcucaccgcaaccuccgccucugggguucaagcgauucuccugccucagcuucccgaguaccugggauuauaggcaugugccaccacacccaccuaauuuuguauuuuugguagagacgggguuucuccauguuggccaggcugguuucgaacuccugaucucaggugauccgcccgccuccgccuccuaaauuguugggauauaggcgugagcugccguguccagccuuuuuuuuuuuucuuuguuucuuuuuuuuuuccuuucuuuuuuuuuuuuuuuuuuuuuuuuuuuuugagacaaggucuuacucuguugcccaggcuggagugcaguggcaaucucggcucacugcaaccuccgccucucggguucaagcgauucuccugccucagcgucccuaguagcugggauuauaggcaccugccaccacgccuggcuaauuuuuguaucuuuuguaucuguuggccaggcuggucuugaacuccugaccucaggugauccacccacuucagccucccaaagugcugggauuacagguuugagcuaucgugccggccagaaggagguuuucuuaucccugugucgcggacuaaaaaauugaggcugagauggggguuaacuaagcaacucaccaaaaaccacacaccuggauucaaaccuaggucugggacuccaccacccauguggucaaucacagugcaugaaagaaacucuuuuuuuuaagucacuucaucugccacuuuauuuauuuauuguaaauuggaaaaggacugugcaaaucuauuuuagcuggagccccgaugcucccccgaggucagaaggagagaaagggcuuuccugggaccagaauccaguccccuggcucccagcuggcugcuggcauaggcgccgcuucuaggcuguccuccgcgaugccggucccaagcccugucuggaggugcaaaguucacauuuacuggaggcucaggcagccgggagacaaggcugccaccaugaucuccucauuuuucugcguugacuuuaaaccauugucucuggugggcaucgccaaggucacacgcagggguccagggaccucaucccaagcugagcggcuucccgagaccgcguagccuccccaggggauuccacgucuuagggccucggcucccgggagggccccgaggugcugagcuccguuguucguggguuuuuuuuuccccaaauaagggacaguuaagaggaaaaaaaaagucucuuggucaacauauuuuaauaauccaagauggaagaaaauaugcccucuuccagcuuaaucacccucuuuguuaaagaaagucaggucagggagaaaacaggcaagaacuugagcgucagaauugcacguccgcguguuugugcggggcuggaacuuggcagcucccgcugaaauuaaagcgcgagucuugcgcccccucauggccccaggcggcaccccagcaucucccgcucucuggacaagccccucccccgcugauuguauuucacauugggagcccagacaggguggucucgccggguggcuguagcuguggaugacgaguugguucuaggacugaggccugagggcagcucagccuggggccccuugagcacgcagucacagagcccaggauuccucuuaaagagcacagacgcaggccaggcacaguggcucaugcuuguaaucccagcacguugggaggccgaggcaggagaaucccuugaacccaggaguucgagaccagccuaggaaacauagugagaccccuucuguauuugacaaacaaagaguacagacccaggaggaagcgcucauuauccacccagucucggccuccagccacguuggguauugucaggccauuuuacagacacagcagcugaggucaggcaaguuuaaauaaaaggcuuaaggucacacagucuuaaacaacagagaggcccaucuggucccaaguuccccugcagacucagcccccuccugaagccugguccaugcugccccgcccugcugagugcugaccugguuuucuuggccacauagggcugugggccaccuggagcaagcugacaucuccugugacaauuucuccccagguaaacaccacucugccagcaaggacgcugcugcucggcuggggccccuaugccauccuguaucuauacgcagucaucgcagacgugacuuccaucucccccaaacugcagaugguacagauacuucuaguaccuaaaacuagaccccucuccaucuuuguucucugucucaucucaucucacuuucuggauuuaugaccucugugucagucucuuccuuucuguguuucuuccuuuggauacucacaaggcauagagcauuaguuugccccccuaaucccccaccucgucucugagucauaccaggcugcugcuugacauugcccaaaccucaugugagaugacagggacagccagccagaugguguagauaaagacucugugaccagggguugagauuaguccccaggcugggagcaggugggucuggacaagaguauggcuccauggacuccgugagccaugcaucuccaccaacuagucagggaagccuccaaggcugcagaacuaaaugauuggcaguuguagguggagggugaccggggucaccaggugagaccagagagaggaucaguggcuuugaagcuucuuuucuggacuuuucugccacaacaggugcccgcccucauugccaaaauggugcccacgaucaaugccaucaacuaugcccugggcaaugagauggucugcaggggaaucuggcagugccucucaccgcagaagagggagaaggaccgaaccaagugagccugccacccuggagugagccccaggccaggaggcuguuccaggaguccugcccagcagccucaguggccaagcccagacacucacccaccuuccccaguggccccguggauccugguccuaggcuggacacaggauucagaaagacaccaggcugcacagaaagagccagauggaccugagugucggucacagcccccuacacucaaggcugagaggccucaggaaagucauuccuuuuuaaaaauaauaauaaauguaaggggguacagugcaguuuuguuacauggauagauugccuaguggugaagucugggcuuuuaguguaaccaucacccuaauaauauacguuguacccauuaaguuauuucucaucccucacccccucccaccuugucacccuucugagucuccaaugucuauuauuccacacuccauguccacguguacacauuauuuagcucccacuuacaagugagaacaugugguauuugacuuucuguuuuugaguuauuucacuuaaaauaaugaccuccaguuucauccaug

SEQ ID NO: 34828 - RNA, 14136 nt, Homo sapiens; identical to SEQ ID NO: 34827

SEQ ID NO: 34829 - RNA, 14136 nt, Homo sapiens; identical to SEQ ID NO: 34827

SEQ ID NO: 34830 - RNA, 270316 nt, Homo sapiens
uuccgaacauucuuagcaucgcucgcgccgcgccgcgccgccugagccgagccgagccucugcugccgccgccgcggccccgccgcccgccgcgggcgcccaccaagcacuuugcagacucgcuuccacccugcgggccauuccgcgcggcggggcccgggcccggggcggccgcguccaggcacaggccaugcagugacgcccccccaccccuccaccuuugcccggagcgcgggcagcagcccagcgcgccagccggccccggggcaggagcggugcuaggcaggggugggguggccgggcccagggaccgggagccggggagggagccgggcaccgagcagagggcgggggaagcggcgccgaaguuugccucggacucgccgggcgcugcgguggcucccugggccgagguaaguuggcgcgcggggcggaugcuggggugcggggggcgcacggggcagcggggggccggcggcgcgucccucgcgggccgcucuuucuuugcgggcucugcuuugugugcgacggcgggcgggcacgcggagggccgcggccgggcccccacacccgccuccccgcgcccccuccgaggugagcggccgggcgccgccgcgcgacuugccaggacgccaaguugggccgcgcgcugggagcccgcgcggcaacaggcggcccccggccggccgcgccgcgccccccgcgcgcccccucucccgccgccugcacgcgcacacacgcacacacccucgggcgccuuggacggggugcgcuggggagccagaaguucggagcgagcgcgggcgggcagagccgccgccucggagcccggagccggccugcaccccccugcuuucgccgccgccccccggcgccggguacccccgaggccggcccgggucugcgcagacuugugccgcuggcgggggguucgcuccuucuucucaaagaugaaaaagggcacggucgucuuugccgcuucuccaggacuguugcugccgcugccgccgccgcuucauugcacauucaaguggaaaauuuucaggagucagcagaaacauuguguccaaaaaagacugagucgcaguuaccaccaaacccaggaggagacucucccuggaaaacuucccuucccuuucgguaggaaauacugggggauuuguuuguugauuggaagagaaaugauccccgggggggagaaaaucuggguacacuucuagucuuuguucguaacagcaacacuuguuuucaaaaguccagagucccgcuuuaaagaaaguuuaacuucugugacuuuucuucuuuuuaaaaaaauaacuuuuguauuuuuaaaaaaucaaagcaauauuuuuaaugagucgaaaacaaugaggacucacaccuccccucucaugaaaauaaaugaaauccagaucagaauuuucuuugcuuuuaaauugccuuuuuuaaaagauuuauuuaaaguuggauagugucacuauauaaaaauauuuaugaaacaaugaaauaccagccaccagcguuucucaggaggcuuguuaacuucuuagaagcaaguggcuuccugugauuugcagaaaugaaaauugaccucagugagcccuggaaacuuagagacagaugauguuccaggagcagggaauguaaaaaggccauguuuaaaaacagugcguuggaaggagcccaggucuugggauagaaaggucuguuaagccugccacauuucaaaauaguaaaaagaaauacuaaaaacacuacacguauugcaaaggagcagaaccuuaucaguucacaacaaccacagauuucuuucuccccgcuuuccaccuugguuguuuuuggaaguucagguggucugauggcuuggggugcgcugguugccugcaaugguuaccugaguagacauaucccucccuucagggagaugugauccacuguguagucacagccgggagugggcuccuuucucugcaggcugcagugaaucuugcuggucuucuacggauaggggcuucucugaggcacagauuggggaacagucuucaggcuacgcccggugcuucacccuuucacuguuggguuugugccccgcuucuguaaacagcagggucuucggguccaagcauaucugaaugcuuacaaggacuagacuuaaauccaacuuccuuaggaaucuuuuccucuuuagaaggaaauaguagaacuaauuacaaagugacucaggaaagacaaauggauucguugaaccuuuugucaguagugagguuuugaauuguugaauuuuuggggaaaggcuuauuuuucuaaucucacuguuuccauaaauggucacagauauuuuucuuuaguguuucuuugugcaacucuauguugaacucucagguuucagguuuuaaacaguuaacaauucuuuuauuuauuguugguauaaaaaaugaacugaugauaagcuauauccauuacggguucuugcugaugguaucaaaaugccaagguagacuauuuuauuuuuacuuuaaugguaaauauuauuugaucugcaguuuuaggggaauauuagaacuuuuuuuuuuaaaaacgagcuugaaacaaaaccaguaugacacuuugcuuugacaauauggguaaagaaaauuauagggaagaaucuguaaauuccuccucugugugauccuuuauaaaguaaugaacugcggggaacaugccugagagagauuauuggaggguuggaggguuuuuuuucuuuucuuuucccaaaacaaaaaccaggacucaccaugacauauacuuaauuaaauuuaauuuaaagggggaggacaucccaauuuaguuugagccagacugauaggaauuucucacugagaggcuuuuccuugccuugugguacaaugugugcccaggccccagcagcaaacuaauuacacauaagggcggguuugggagggcagccuggggggagucggcuuccuccucccuuucccauuuccucucuccccccacuuacuuuauacagcaggaauuauauauuaguauacucacuugggagacuggaguccccuuuuauuuagaaaaaggaacaaauaagucauaaggaaaaaaauguucgaguuuuuuucccugcuugagcuucagcaguuuauaaacaauuuuguguuuuguugguucuuagaauacagagcaacaauuaugagggcauuucuuaacgggaacguuugggaagaauauacuuuuaucaucgguguuuagaucauauuuguccuuacauuuucagcagaaaaguauauaauacgaacaguuuaaagcauguagaucccaaauauuaaauagacuuuugaagaaaugagcugugacauuaacaauauuuuaagguugguugcuucagaaauggauugaucucucauacgugguggucauacaagagccugggcauuugugggauuacuuuucucucuaaucucauguguuauguguuaauugugagcauaauuaugcugccugcaaaugaaaauugugucuuaucacucaagguuggugcaaauaacuguauguaugaucugguggacuuaaaaaugaccauauucacauacagacaguagguggauaacacuuuuaagcuccauuuuaggcacuuguacccaguagagagauugugaaagggaaaauaaauaaauaugaaagcuguguuuagaggucgaaucuguuuagugguaaaacuuuagggucuguuuucuccaaagacugaagaauguggccaaaagaaguguccagauuucucuguagaacugcaagaaaaugcaagccaaccuuguuaaaugcgagcguuacagcugccccuuuggaguuuagugacuggaacugcaaacugcuaauguccaacuuuuggacucagccagaaaaauauauuguaagcuuauuccccuuugacaaaccuaggcugugcugcugcugggcugcuuggggacagauugauggcuggcacaaucuuuuauagcugcauggugcuuuuucuuauuuuauaauaaggcauagauuaccuugugguauuuaaguugcaucuagaguuguguuugaaccacaucagugauacauuuuauucuuucauauucauaaaagugauaaaaucagguaauucagguccauccuacgcacuucauauucaugguugagcuuuuugacagacaccuuauuuagaccuuguuguauugcaauuacuuuguaccucugaaaucagggaaguucuggggcuucccucuucuugggauaguuuguggagugcuaguauauuuggaucuaaauacuuggaguguuuuucuguggguuuuuauuuuuuguuucaaagcugugaacucuugaguguccucaaucuguaagauucucauuaugagcuucgugguccauauuugaauuuggaauugaaauuugaccauuuuuucaaauacauuccaguuuuguagugguacagaauaggguagcuuugaaauauguguuuuauuuuagucaaaguaaaaaugggaugcccugguggguggguuuucaggaugauguuucuuacaaggguagguuacucuuagcuuuuaaauucuccuuugguccacugauuuuuugcauaguugagaggauucucaaaaaaauaguuuccaauaguccgggagucuuggcuaacugugaaacucacucguuuccucuucuugauuggauaaugguaguaguggugguggugguggggaguagggggaagguccucguaaaaaccuaucuuuuuucuaccuuuguggcaggccaagggaaggguguguuacaugcacuacacccaccccgccuuguuuaaaacuggucuuuacuauccuaaugcaaugcuuucuauccuuuuucgugauucacauuuguuuugaaggcucuguccuaggauuucauuagcaguuuuaauuugcaggcaugggacccuggaaaaugggcuuaaaagaaaaagcuggcuuauugaugaacaaguuaagcauccgucaucucuaaugggaaauucugguugcuuuuaggcaucugacagguuuagauguauguguaaagugacugaaacacucuugacugggaauauacaacacuguuguucuuacugauacauaaacugaaaaacugcugcuaauggugggaaauguuaauuaugugagaacauauugaacuuauauucucuggcaugaacuuuuuuaaaaaaaugcaucaacugugcugcuuuuuuuuuuaauaggcacagcuuucuaauuaucauaauucaguucagcucugcucuuggaugguguucaagugcaaucucaauuuaacuugaaaggggauuuuuuuuuuuaaacuuggaauguuuaagaaaauuugaaaaguucauccaagaauguugucugcuuaggugugaguaaaucuaggggaaugaaaugagugccuuucuguaauaauucaauagauccgaauauuaagaaagagacuguuuuuuugcuuugcucuguauccaagcauuuuuguauaaccugaugcuacacacugcugaguucucuuugaaaaccaguguuuuucuaauagauaguaaacuaaauaaaugaauauuuuauuaccaucugcaaaaaugggagucuucuaagagagaaauacgcaauuguuaugaauguauuugacagaaaucauuguuaaucuuuuauaccaaccaagccuuuagaagguaauugcuuuaucuguuccuucuuuacucugugacuugauggcauuuugugaagggagucgucuuugacggcuuucaucccagugucuguaucccuuaauuuuucuuugacuuuaauagcuuuucaaagaaaaaaacuaaaugaagcccaagcgccuaauccuccaggaaucaauuuuaauuguaagaaagaacaacuuagaugggccuuccgacuuucguccagccugacuccuucugcugagaugcggagagcccgcggaaaccaaaugacuucauuugcucuggcacuuaagaaccgaauucacuuccgugguggugaaauaaaaggagccaaguguuuuaaauagccacuccccgaggcccgcccgcccgagccuguugagaaaagcgcauugucugcuugcagcucuagcugggagccugccuggcucgcccucccccacugggcagcuccauuucugaaguugacaucugguuuucucucuguucaccugaucuauccccguacacgugcucacaugcagacugcaugcaugcauucugcagguaacagggauuugugacauuaaguguguguguguuucaaaucccuacugggauagggggaggaacaaagcuaauggcacaaaauaaaauguaaacacaguagcugccccacaugccgccgcugcuggguuucugucugauggugcuuucuggguaggcgugccuauuguuauggcagcaacaggcggcagaacuuggggcaccauauggcggaugugggccucagauaagcugucugguaauuuagcuuaucaauagcauuuugauaugcuucauuuucagaucacccauuacuguggcugggggugucuugggggcuaacugauucugaaaccauugugagccgaugcuuccuuugguggaaucucuuucaauccuuucucccuggcugccuuuucaucucaaagccuuugagagacaaugcugguuagaguuagagcuccauuagcugaaggaaccaucagccccaucuugaaauccugggcacuuagaagaccuugucauguauugucauugagagaaaaacagaaaacagauacuuaauagcauuucauauugucugagccgagaaauucucuuaauucaaaguugcuuuugcuuuaaauauugaaggaguaaguuugauacuguuuuuaaauuuugaugaaagguuucuaguuuuguuaugcauucagaauaccucccucauuuccuuucaucuuuaaauuuuaccuuagccguaaaaugcaaaaauuauuaccauuuauauaauuugaaaucagggaaugugccauuuguaauuuggaggcaagaagcagcuuccuucaugcuuagaacuugugaaaguggaaaaugcuuccagaacaccacucaaguguccagugaagcugaagcaaaacuaaaaucuccccuacugauggauugguaggggaacucuugccucagcuggagccagcuuagggaaucugcacuuaguagguggcucaguggaagucugauggugugcaugaccaugugcucaucacccaugugacccucauucaccaaauacuugugucucugauauguggcaggcaugggggaagcuagggcgaggcugucugccccgcuccugucucccgcugccugcguguucucacucaccuuuccaggcccugcaccuuuucucacauuuugccuuuuggguuugucauucagggcacauagauccauuuacauggcuaacucaggaugguucugacugaaacccaggucagccucuuucuguuccugcuccaggaagcuccugccacaucagugguucccaccuuagcaugugcacugcagccuccauggagcuuuuacagccugggcaccaccuguguaggcuuaggugcguugugguaggugcagugugucuguauuucugaaaggccccaucauaacauccgcuccuggcugggaaccauugaucuagauauucuaauuuuugucugcagauagaaucagguuaaauuuggccacuucaaauucugaaugugauuuucuucccucaauauuugugaggcaguguaccuaggaacauaggcugaaucuuuauggaauucacuaagauguucuucauugguuuuaaagauaagccugcacaaaacuaaggucucaccuuucgauccaggggaagcaauaaaaugaaccagaaccaccuucucugcucggcauucauuuaccucgugggaguguagcaguuguuuccagaugugauuguagaggugugugucacgguuacuggugaggggcuugagaauggaguucugucuggcugcuuauagagguuuugcuuucugaguagcagggaugcuccuagaggucguugggugguaugccugguguugggaaaugagggguaggaaggguaauccugacggcuuucuggagaugaacuguggauaaaccacccuguuguucauuuuuuccuuccuugucucuucccuucaccuugggcacuuugaaauccagaugcuccugguuuucacggagcuacugcuugccacugagcguuuaaacauuuaugggugcuacugugugccagggauuuaguaauuaggaaaagguggcuaaugaacagcgaucaguaaaacuccccugcccggcagaguuuacagauuagcaaggaaaacaggcauguacagaggucauggcaauccagugggaaaguuguguguaugguauuucgugaguuccaagguaacacauuuuuaacaugcuugaacauuuuugaaauugggauguguuugacaaucauggcuggccagguggugguaaugacccuugauguugcaugcgcucaccaaagccuguggagugaaugcagcggagaggaaaaaaaucccagagucaguagugagcauuccuaagaauacucuuguuguuacagagggugguaguguauggacacugaucacucugagaaguuacuuuagcuuauguuacccgauuuauuuagcuuguauuuuccuuuuuauguaggcauaagauugauagagaguaaaaaguuucaauauguauaaaauaauauuucuaagugauaagcauugugacaucauuuguuucacaguaguacgucugaaauaaaauccugcugcaucuuaucggcagucaugucuuaggguuagugaaauguugaaacaacacguuugcaucucuaguccuaaggaucugggagguuauacauuguggauggguguugccuugaggguugcuuugagggagugggguuuuuuacacguuuauauuuuuuaggagcauggauuuccuuauguaacaucagaauaaaggggaaacacacucacugggguaagcccucaugauacauccgaagagcuguguugcccugugguaggaacugaggagggcuuugcggaggaagugauguuggaguugggcuuugaaggaacagggggauuuuuuccagaugccauuuuggggggugaguugggaguagguuguuagaaaauaaacaaaccuugugaaauauucuccugaguaaugaacuuaacccucgcauaucgauacgguuuguugccaguaaugggcuacuacagauuugaaacuuggcugugaggaauuaauugaaaggaguaggaggggggaacugauugacaugaacagugggcuguuuccugauuuugguuuggaaaaaggauaauguggguucaaaaucacagauuuggaauuggacacacguuggcucagcuacuugcuaguguggccuugcacaaauuacuuguucucugcaagccucgguguccccaucuauaaauuucaguugugcccacuauauaccagacacaugguguggugaaugcucaguaaauagcaacuucaaaugucauguugcauaauagaucuuuaaggauuuucugccaagucacccuggacagugacccuugaggaacacccaaggcugaggcauuuacuuagaaucugagccggauuccuggucucaggcaaacagauagaaaucuaggagaggcugaggcaagcccauaaagcccuugaccauuaaucgcuuugaaccacacgucccuuauucauaaaguggaggaaauccaucaguaaauacguaauauuugaggucauuccuuacccaguaugaauuaaauggaaaugcuucaaaaacuggauagcauggugcaacuucaucugucuaaaagaaaaccuuuuccuuagcuucuugcuugaaagccacacuccuaacauugggguuggguuguaaaaguucuuuuguaagugguugaauggaacucaucuuuucauagcaaaacaaugcuuagggucuucggccuucuuguaaaaccauugcauaauccccccuggggugcagagggcauucagcuucaggugcggagaagaaagguacuuuugcugcccucauugcaccucuuaauaccugcuuugggcuagcugcuuagcuucucugugcccgcaguuuccccaucuggaaaauggggaugauguuaucuacuuggaagaguuggaguaaaguuuagauuagguaagugcuggcucgguaggcuagagcuguagguguggcugcuguuaaaaccuaggccauuuguuucucucaguacugcaagcuccagagauaaaucuuugccccucuccuaagacucgcuuccucugggccuuaaaugucacucaaauaauaauucacacucaugugaaugaaugguugcccaucucuuuagccaguguauuugcauguuuaagaggaugguugugaauuccagugccuaacuccagguacuuccuggguagaugagcugaguuccuucuggaagcuggugauagaaccuuguguuuucgaagucagcuggcuuaagcugguccugcucugcucacauucccagcuacacuucugggugugucaaugucccuguguuuuuagaucugggccacuccuggugacuggucugagcaguuaagauugcuuugugugagccugggccagggaccaccugcauuuuauugacaucuuuuccuuuugucucuuaagcaguguauagacaugugugcuaauuaaucugguuucccaguucuuuaaaaaaauuaaaaugaagacuuauugagggaggagaguagucugguugaggagagagacuuagauucaggcaggcugacaguggaugaggggagaaaauauauuuaaaagcacuuauucacaacccugggagucuacuaaaauuacugaauuacauacuucaaaagggugaacuuuaugguaugugaaucauaucucauaaagaaauaaaacccuggaucuagucaccacacagaacagcaucuugucaugcucaccaugguauccccagcacucuggcugucauguuuuucggugaucgagugauuaaaaacugauaaucagaccuaauaagaagaguuucuaccaguugguuuuagagaggagccaggaaaaaacauauaguucguuucaaagauaaacaguaguaguauuuaaaaugaaacuuuuuuacuuuagaaauaaucaguuucaauaauguggaaugaugugcucccuaaugauaaauguuuaccaugguaacccauccuuauggauuguacuuuuaaacaauccaguaacuaagucauaaaggauaaagugggagaucaugaagaggagacaccuggaaggcaugggaggccacaaaucagucauugaaucugauuugcagauugacuuaagaaugggagaaaauggaccuagaaucagguuaauguguaccucaaguuucaggcucugcucuaccuagcuuuuuucuuaauuuuaaccuggucuuccuuguuccuguguccauccaccagauccuggcugccuuccuccugguuacuguuuguggcaguuuugccuauuuguauuuucgacagggcugcccuuuaugguuccccauggcugaguaccuguuugccugguauaauccugguuuauguugcuugucuuggcauaauccuuaaagaacccuccuuuacuaucaaaaugucccaguuuggaugauaaauuauaugccuaugguacuaauaggaaauugucagggaaacuggcagacuagacuuuucuagaauggagagaaaaucccaggcaggagggcuuuguggugucuugguauugagcucaugacaguauuacuuuugaaggauugucccaggccauuucugaggccacagcuacaauagaggggaauuucaggaaacaacuuucccuucaaaccugugcuauuucaaccaaauuguuucaaaccuuguucuuuucuguggaugcacucauaaguauuuuuuuaaaaauaauucucaucauucauaggaaugauucagcauugguucauuuccuuuuagaccaaaaaaguuuaauuuagaaagaaguuuuuuuuuuagugguauucugaaagguugguuuguacuguaugaaauugggggauuucagauuauauuuuagaaccuguggucuuggcacucuugacauucuuagguuucaaacucacuuaccuuuguucugagggagacuguguaaugauguccuaugaugcaccuaaauagauaagccagagaacauugaguggaauuuuagaaauuuuaaaagaaauuuuaguacuuuuagaacuuugccuaaaaccaaaaguaauuggaaugacacugcucaguuccuggugguucuuuugacaccacuguuuaguuauuuugugaugugccuuaggcagugacuucgggcaggaguggagguguucaguccaguguuucagcucugaccaaaacaauggcgucuagacuuuguuguugagaacucugguggagaacuguuaccuuguuggggugguucacugggagaaggcauuugaggguccuccaagugcugggucuuggucucuccacuucuagcucguguggaaggaaguccugguugggaauccucugcuauggcucuuccugugaccuuagguaaaucauuugaaaaucuuugguuuaucuuucugggaagaugaugcuguacugccucuugccccucuagcuguuuuuugugcugugcuuuugauuaaagagagaaaaugugugagcccuuaggcagaaagguccuggaaaacuuaucuuaucauaccauccauaacccucaaagacagguuuuguggaggaggagcaguacugcugaguucacuuuuaguugugcucauuccugggcuucuuggauaggaagggaaggcugacaggccagguucugucucaagcccauauaagaguugaguugcaauuguaguugaagaaggugaagcucagagaaguuuagugaccuacccaacaucacacagcugcacuuuaaaaccaguucuuuaucugugugacuccacagcugucaggcuaacaaaggacugcacaucaagucaccuauccgguuuucuuguggcauuugaagggaguuaagauagauugugacauugaaacaaagguaggcuucucauuuaguguauuugcccagaaaaaugaggacacaauacuuguguuuucuugguggcccauuuuacucccucuuacaaacauauggcuaaggucuugaaaaguugggugugucucaguugagccuuucagagauuacuuauccugccccauucaccucuccccugugguuucaguccuccaggacuguggggaccaguaccccucacccccgugacugguuauacucaccguugagagagagggggcaggacuccuccgggccaggcuaauccaaacuauucucuagguggguguaguggguagggggacugcuguaguuuggaaguuuggaacuggaccugccaguuuaucugguuuugcuuuggaaugugcuguguuggcaggcaggcagaauaaguuagcccccuccaucacccuguaggccuggauauggaaauggccucaugcuggggauaggguuuaggcagaugaccuugacuucacuuuuugagaaugggagugcuugggaaccugcugagauggggugaauuucucucuucccacccaggugaccagcuuagccugugauaggugaugggcagugaugggggcagcuggcagaagagaguuaacugugcuugcccagagcccuucauaaucaggacucugaaaaagacacugggucuuugaaaugggguuguuuacaggguugauaccccucuuugacaccuugguugguuuuuggugggaggcaguggggcugguugauacaaucuuuuccuccugucuaccuguuucuggugucucucagcuaaaaggugugugaucacugauugccaguuuuuaggacucugugcucaugacuuuccccgcuucccaacuugcuuguaccuucuuagucuucaugcauuucuuaaauucuuccuaggugguucuguuggcuguuuugguguuguccuaacugugcaguucuuacuagugcuugguguauucaguaagguagccggaaagcauggcuuggaggucagaucuugguugcagccccaguucugccuauuggcugugugauuuugaguaagugauuaacucuaucucggcuucuuguuuccuccucugcaaaauggagaaaauaauaguacuucuccacaugugaguuuaaaugaaauauagcgaaugacccacugucagccucucuguugguucccccaacccauugagaagucucuugcuuccuccacucuccaguuucucaguucaggguccugagguuuuccucccgaauaacauaggcuggucugacugggggucauuuauuugccuuuucgucuuccuccuuuggguuuaguuuuaagcuuugccccagcuuccccucuugcuggauuuccugcuuuguuguuuuucuguuuuuuuuuuuguuguuguuuauuuguuuguuuuguuuuuaaauuuuuaguuugacaggcuauuucccuuuuguuuucauauuuucuguugucucucccuccucccuggaaaacacauccacccuuccugccuccacuuuucacccuuucuccucugcucuuaucacuuuaagaucucagagacucuacccugcaguucacuacauuucaccaaaaauggucaucagaaaagcaccacuucugcucucuuuaacacuggauugaaucuguuggcuuauagaguucccagcacucuugauaguuguuacuauuuuggaauaacauaacucauucucauccgcauuaugcuuaugaacuuguggaaugacacagguuuccuucacuuaucuguuugaccuugggcaaccucuuuauccuucugaagcacaguuuccuaaccccugaaauggacauagaagugccuuccuuauggguuauagugcagguucagugagggugagcacagugcugacucgcggagaagugucucauaaauguuagcugcugcugcuaauuaugauugugacuaccaucauccagcagcugugaaguagagugccaaguaccucuucuguagcaucugucucucuuuuugaaggagggggucaggagcagaaucuuauuuuuauuuuagauuuucagugucuuugcuuugggaaaguuuaguacaguagagggcaauugaaccccugugcacccauuaucacccagcagcaaucaucaccucauggcuauucuuguaaacuccuggcuccucucccaccagauuauuuggaagcaauccuaguugucauaccguuucaucuguaaauuaguacauauuuuaaaaauaugacucuuuuuaaaaaaaaacaaccaacuauugauaccgugaucacaccagcacuguaauaacuccuuaauguuggccgggcacgguggcucacuccuguaaucccagcacuuugggaggccgaggugggcggaucaugaggucaggagaucgagaccauccuggcuaacauagugaaaccccgucucuacuaaaaaauacaaaaaauuagccaggcgugguggcggccgccuguagugccagcuacucccgaagcugaaggcaggagaauggcgugaacccaggaggcggagcuuguagugagcugagauugcgccacugcacuccaaccugggcgacagagugagacuccgucucaaaaaaaaaaaaaaaaaaaaaauaauaagcccuuaaugucaaauaucuagucacuguuuggauuuccuugauugucucauaaauguuuuuucauaguuggcuggucuagaugagggucccaaaccagaucaacagguuauauuugguugcuguguuucuuaaaacucuuuaaaucacauccccaccuuucuuguaauugauuuguuacagaagccccuguguuucucuucuagacugccucguucuggauuuugcaguuguaucuccauggugcuguguauuuuauucucuuauccucuguauuuccuauaaaugggaaauuuagauguugacauuugaucuaauucaggguuuuuaaaaacuuuuuugaugcaaauauuucauagcuaguauucuaccaggaggcacacaauguacagugucacuuuuucugugauguuagugccauugauugaugaucucugccuguaucuauuauuucauguaguuuuugcaaacuggugguucucugauacucuaguucuguuuuuggagacaggucucacucacugugucacccaagcuagagugcagugaugcgaucccggcuugccguagccuugacuucccgggcucaggugauccucugaccucagccuccuaaauagcugggacugucagugcgccaccaugccuggcuaguuuuuuaguuuuuuguagagacaggguuucaucacucaggcuggucugaaacuccugggcucaagcgaucugcucaccucggcuucccaaauugcugagauuacaggcgugagccaucucacccaacccauuccucuuuuuauggagaagguuucucuuagcaacuauaugguuaaccuagcauauaguuuguaaaggaaagauaguuuuuuuuuguuuugcauaucauuaggcaaucacugauuuuaaauuauugaaugcguuucaguccauugcaguuccuccucuuacugaugcucaaauuguuucaucuuuggccagugggaauuucuuuaguuggcuccuguggccuuuugaugugacccuauuaauagucuuuuauaguuuccuugcuguccaaccucuuguguauucugggagauagaaugaaccauuucugcagaguuuggguuccuuuuagugagaaauggaguuucuaggcuaugaugugugugcuagguucucugcuuuuuuucuccucccacuccuucaguugaauaaucugcucaccuuuggaaauggauccugccugccaugucaacucuaaucgugguaaaagcuuuccuugcacacuugcucaugccuggccucuuuggcucucauuugccacuuucaugcuugugcuugucaucuuguccuuuccucccuuaagaaaaagaccaaacugaagaauuaccauggaugguuugugguuugacuugccuccugaaggccaaagcucauguuaauguaggcuucacagaagucuuuagucauugccuucaucaugucugccugauaguuuguucuauuccuuguauacauaaccaggacaugagagauuccuuaucuuauuaccaccgugagccauucaggcugcaagcuguauuucgaugguauuguuggguacguuuguacucaucuguuucaauaaauauugauugaauuaagcuuuguacuucuucuccaaaguguuuaaaauagaauguauuuaauguccuagucauuuaaagaauuuaucacuagucuauuauuuuuauaagcuuaaauaaguuaaagauuuguaguuuuagauagauuuaugcauuggaucccuaguuguaacauagcuauuguuuuagugcugcgggccuauaguaguaggccugcaagucuaagaugaguguuuuuuauuuaacaagucugcuauuaaacuuauuuuuaguauuauaauuucugucuuugcuucuuggaaauuguuuuaugcccauguuggugcaucauagacuaugcacuuaggccaaccaccccccaguccccccagcaaagcagggcucauuuuaaagacacgcucuaaugcuuucuucagaguuuccauucagaccuacaguuuuagcuucaguaauacuuuuuuguuuuguuggugaaacaaagcuguaugcguucacagugcagccaacacagucucaugacggcacaagugaauaguccugaaauuaucaucauucuccacaccacugagaaguuaaccagcauccuggccugggaaauuuuggauacacauuuaaugccccucacccaccaccccggcuuuuuuuucuuuuuaaagccgcaagcuuaauguaaugguuccucuguauuaaaggaaaguacaguauuguagggguuuauuucccccccgcccccgcuuuccuccgugggcacugagaguagggggaagagccccguaauucacaaggcaggcuucugugccccgcgguaaacucaguuucacaaagggaauuuucauuaugguccuguggcucccuaacauaguggaggcuucaggaggcaagugguaaaagcuaccaaagaaaaagcuggacuggagccacugacgucaugucaguaaaucugcuggaggagcccagccaugcagcgccugccagccggccccugcacuuuggccuugccuggucaacuguucuuacugcuuccuccacccccaccccacagaacagccuguguuuuuuguguucuuuucccccuuuuccuucugugcaacugggcuguguugaaacccauaaaggcuuuugaaaaccaccccuacugguccugugcuuaaugucuuguguggggauaguggggagaacccaacaauccaugaaugagggaggcuuuaaaaguuuuuucuaguggggaccucuuugugaugaauaaauccacagggaacaucauggaaagcagccagaggugcgagccccuggugcuuaguacuuuuaaagaacuucgcuuuuaaguccugggcugugugcacaugugugugugcgugugugcaugcgcacaguaaaggacagagaaggccagucagcacauggguggaaauacagaauuucagccuucuagcagaggaugauuuaagagaaugaguuccaaugcgaguccuuuauuacccauuaaucauuggucugcucacucugaacucugguuugcaacuggaacaguuaaaucuuaagcuacaugcuucuguacauccuggauauuuagagucacaaccccagaugggccugaauuaaaauauugcugugcuaaaucuauuuuuacaucuaggggaaugacaucuaaaaauaaaccuuaucccaccuguuauccacuuuugggaaguugaaacgcuguuaagucgcagcccauggauuaagcuuugaugacggcuucccaugugaugccugcauuccacuuuuccugccacuggcaugauguuuucauuguuucgguaaccguuguccuccuguuuauuuugcugugaauauucauuugcaaauaagagugaagcauagguucagacugguuuugauuuuccugaaucuuagggucagaaacauauuaaaagcaguaucuuauccaugaaucaugagaugagucaguuccugaaaccacuacaagccucauaguucuuggcuacaagcaaaggcaggaaauccaggcuucaauaacuuccuuucccaguccuggcuauagccgcguuggugguuagguucugcugccugccuuuguaagcgguaggaagauguaugucugaggaacaaaggcacuugagucaauuuacugaaacuguuuauaauuuguggucuugaucugaaugucaggcugcguuggcacacccugcucugcugugcggcccggcacaacucagccaggaaaggcggcaggcugaguccggggaagugccccagcaaacacauggcaaauguuucaaggggcuuuaguguuccagugaauccuaaaacuaggggacaugcaagccgacacuaggcagaaagcucuggauuccauauguauaguugaaguaucgacucuuuguuuguucuucacuugagagaaaggagagaaaaaagagagagaggggagagagacgagagaacaaacuaacacacucgccagccugccaagcucuggccugucucuugcuuuuacuugcaguuuacuuccuuauauacaggguccucuuuuuuuuuuuuuccuuuugcaguguuucacgccagucuuccugacuucagaaucaguuuuauaacuguuuuauuaaauauuuuaaagaguaagggagaaacacgaaguugucucccaauguugggucugcugugacucguauuuauuuuucuccuuuaugagcagugcccacuuuguguacguacccaagucagagcagaguuggguugguguuucugugugaaguugggacucacuguugcuuugugcuuuacuugugaauuuaugagcuuuuucaaucuugagaaaaauuaaaauugagugugacucauuuucauuuaccaacucuuaccuucuuuuucuacgcuaauugguguuagcuagcgugggauuugagaaaaugggacugaaaugagacccuucuccccccuacuguagguuuauauggagucauuggaaguucugauagaagucuaaaaauagcauggguagacaaacccugugaaaagacacugaggaagauggaaaaaaauuugagaugaugagcaguuagauauugaugcuaccuuuuaaauugagcuuguuuccaauucauagcuggcaauagcucagaaaggucaaauucuauuucagccuuuguaaagaauaaaauaaaagcaaaugcaaaaguuugccuggcuuuuuaaucaaguguggcuaauucagcgcacagccaggcuggcgagggccacuucguucuuacuugucguuuguauuuuguguuuggguaauuuucuguucaacuucaggccucacuaaaaggcucugauaagcuguugagaaagucgggcucauuuugauuuuagaggcuugacugagagucauaauuucuggcugugguucuccagauuucaggcugguacaaaaacuccuuagucuuaggugaguuucuuuggaaaucacugugaaaauauauuacucucauuaacauguaaauagucacugucuaaacuuggaggagauuuuuccuuauguuaagagagguacaaauccaguuauuuuuauuuguccuucauugaucugacaguuaacuucuuuuucauguagauuucaggcugggauuagagacugaaucuugaauugcuuaucgucucuagaccaaguuguucggggccagggauugauuaauuaauuaaaaucaauguaaauggauuuguaagccuccuguaacagauuauccuauuagcaaccacacagagcacagcccaugaucugugaggaauguuuguugccuuaagugaaauggacccagacugauggacucuuugggguuacuuuaugaaaaacccaguggcuuuuguaaggaaggggccucacuuaaccuuuacacugaacagauauuuccuauagauggcagauuauuuuauuuucugagccugccccagaaggcuugaguucuguuuguguguugugugaguuucuacugugccugugucuccccaacccuugcauucaugccguccaagaccuugccauauuuuagccagguucugcccccuuucaggugagauuccugcuaagaacucuucucugaagaaaaaaggaggaaccagaaauacauuccuauuugauagcaacaaagugguuuuuuccuccaacccaggcaaccaacaagcaagcaagcuacaaagaagacaguugcuuguuauuugaggcucugacuguacagcugugccuccuuagagugguuaagaagacaagaugauacuuuaggaaaacuuuguggauuuaacaaaggucggaguucauucaguggcugucauguacauuguguguguuuuuuuguuuuguuuuuguuucguaauuguguuggacagguagauacuuucuauaguaggaccagcucacccaccuuuucuuggaucaaaguggggcuaucugagccaaguugaguuaaacucugucuccugccucuuuugggauugagauagcaaucccaguuugucuuugaugcucacacuguaguucagggagacccuaacuggggaguagauguuugacccauggguauagagaaguguggaauaaagccacuuugcagagagacaaggaaacacaguugugcugaggacgagacaagagaccaagggaauagucucauuuccugaugguuuucuauuuccugguuuccaucucuugugaggguuggcugcaguuucugauucaggggucuucagauggacgccuuggccuuauaaugaacucguauucccuuaccguuuuuuccuaccuuagguuagugggaguggguuucuguuaauugaaaccaaaugguguuuggccgacuaguuuguugggaaauacacccugcgugcuguccuagggaggccccguucagcaaagggagcuccauuugguuacaugugccuucugcuuggucagccaugcagggcugcuccccucagcagauagagcuguccuggacccugugcucuccuguguauuggguuugagggaacugacuccgguuccuggacugucuagcuaacuggggaacaagaagggcuacccacuuccacccugucucagacuggaacauuucaaggcuugacuuaguccuuucugcugccuggugugcccuguggauuuaggcuguguggugcuagguucaagcauggcaggugaggaauuuucccagucgugccugggggcacugaagaguucugguuggcugagcacggggaaagcaagccaggugugucauuagaccugaguguccugccuggugguaccaccccucccugcccgcccaucccugagcaauguggaaggcaugcugucaguggccuuuggcaagugcuucccugugauaaaucugaaaaauaaaaagugcacaggugaguacuuccucuguuagggaaucucgaaaaucagaggauuuuauuagcaaauggauuauauagcaaaugccuuucucaaggagaccaguaugguuggggacccaaagggguggugucagaauaaaagccugcccagaagggggugcgguggcagugucaauaagcagggaggaaauuuagaugagacuugagaauuuuagauaacagaguaaaaauuauuuuagaggauagauuuuuuuggggaggaaaaccccuacaaguacauuagcagauguacauacaugcaauauuaguuuguuggcaucuucuacaaauuugaagccauuuuuacuugaggcucaauauaacauguuuuacuuguuuuguuggugaaguuugguuuguauauuuaggaaguggaaauauggaaacucugugcuuuaaauugagagggguacagugaaagaagggggguauguagaaaguucucagaauagagggcugggcgugguggcucacgccuguaaucccagcacuugggaggccgaggcgggcggaucacuagagcucuggaguuugagaccagccugaucaacaugaugaaacuccgucucuacuaaaaauacaaaaauuagccaggcaugguggcaggcaccuauaaucccagcuagcugggagacugaggugggagaaucgcuugaacccaggagucaaagguugcagugagccaagaucacgccacugcacuccagccugggcaacagagcgaaacuccgucucaaaaaaaaaaaaaaaagggcccucagaacagggaccagagggguuuagacuuuuauaaguguguuucuucuggucaucacagaucuaauaaaaaauaacauguucauaugaugcuuuagaguugacagagcuuuuucagucggguaacucuuugaucucucacaacuugguuugugcaagugaggaagcggggaccgggaggugaggagccuugccgugaagccauggcugaaaugcuuccugccaugccugcuccuuccuugcugcgcucucucuuuuuuggugggaggauuauguguuaggacaaggcuaggggaaaggugaaguggggguggaggauggagggcagguggggucuggagaugguaaaggaauuguuuaaacuaccagagcagaugggucucucugcaguauucagagcacaggcagagcaggaagggacucagaugugguuuucagaccagugaauauuuuugucacuuaaagaggguuuuuuuuuuuuuaaauauugauuccugcuguucauccuggaucuucuaaaucuuaaucacucauggugaagcuugggugauugagugcucugaaaccuuaccagcugauccuuaggagucccauuugauucuagccccgugucucuuuaacuagaaaaguuugagaauuuaggucucagcauguccugggagcuuauuagaaaugcauaauaugagaucccaucccagaccugcugaauuagaaucugcauuuuaauaaaauuccagguaauuagggcaugcgcauuaaguuuugagaagcauugcuauaagaugcuucagggaaacuucagggaguguagcugggguaauuucacauacucuuuccagguuuguuauuugccuuuugacuuaccuuauauaacuuuuucaugcagaaauuaguuguaaguuggauuuaucaguacuuccuuuauaguuucuauguuuuuuauuugcauacuaaagacuugccuauucagaaauuacuggagaaaaguccuccaauuuaaaaaaaugaaaucaugguauauuuuauauaauuggauacgucuccaauuuguuuggacugguauaaggagcgagguaggaaucuagacccaguggcuggucacuugucucaucacuguaucuuucaccauuuauuuuuuuucauugguuucuucauggauccacacacuaaauucauacauguuuuauuauccacauguugaauuaauuacuguagcucuauaauguguauaccuaccuauuucucauuacucuucuuuuaaagauuuuuuuuucccuagcuuuucucaucgguuuauuuaaugaauuguagaaaccgcuugucugguuaaaaaaauuccagaagcuguuuuuacuggaguuguauuacauuuguagaauaguuuaccucauucuguuuuuuaaauaguuuuaccuuuucuaaauuauauacaccaauaguacuucagagcauuuuucaguuagagucaugccagccuuugcaauggaauuuugaaacuuauaucuucugugggguuauucauagagacuuuccacuuauucuguaucacugcauccuguuuauuucucucaauaaaacuaguguaucugauuuacucacuagauuauaagccucacaagggaaguuuccaugucucuuuauuuaccaguguaauugcucagugucuagaaaaccucugguacauagaugcccaauacauauuuguugaaugaaugaaauuucgguaaccagagacucuagcauugcaguugaagaucgaugacaugucgaauuguuuggauuuggaucccaguuugaauucagugcaccuuuugagauuauugugcagucuuuugggggaaguguuccuucucugccauugaauugaggauggaccugggaauguuuuggucuaugagacuugacaguuggugugaauucauugugaaaguggagacugaugacccagcacaggcguugucaacccacacauuauuugggaaauaaugcugugaaucaaaucccacaacuuugauucaacagcaucucccuuuuaggucauucugguauuaauuuuucuuuuaauuaggaaaaauaaaauauuucugcaaagaacuuuguaccuuuuuuucuauaauuagagaucccuuagauaaauuagcaucacccauuuaagcccuuuuguuuuaggcacaaauacccaaccugugugcuacuuauggacaggaauggaaucuucauucauuuuuauaacucuuaacaacuuuggacuuuuucuuccauaacuagagaucccuuagauaaauuagcaucauccauuuaaacccuuuuguuuuagguacaaauacccaaccugugugcacuuuauggacaggaauagacucuucauucauuuuuauaacucuucaccagguacucaagguuuaaauaauaagagaaaccaaaucauaaacauacaguacauucuaaaauuauaaauuaaaaaaugauguuauaccuguggggugcaguggaaacgaguuuugcguauauuuuaguuucugcuacccuuuuaaaagccacauugaucuuagaaacuuuuuuuucuaugauaggaggauuucuagaaauuaugcuucuuaacucucauuuauuuucccucaccgugguaugagaagugugggauauuugaauggaguuggucaguuauuuauaauacuguugcuuuugcuuccuaauuuauuucaguuuuauauuugguguaaaaugaaacuccccuaauauuugaggccuuuaaugcaucuggugccaagugacuugauuuuguagauuauaaguaguucagucgacugcuucuucaauaaaaauuguuuugagaacgaucacagucgcuccacugcagauuuugugguccuccccuuagcucgcugugauggucggugagagagauuauuuugggaaagacaaagcacagagucuccucugcucuagcacagucaugcuuuagaguuuagauuuugagcaaagccauagcagacccccucugggaccccuuugaauuuuguguuugauucuucauguguacaguguacaauauuuggagaguguuuguaagaccguuguguuuucuuuaauaaaacugcauuuauccuuguguggacagauuguguucuuagagucuaauuucuuagagaacacugggaacuguuuacuuagauuuuuuuuuucuuucuuuaaauaaaggcuuccucugguuaucagcuuuaaaacuauugaaagucagccaaaaaaguugguugaagggaaaaggcacuauucuggagugucuuaaauuuuagucacuauauguugggggugauuagggcuuuuacuuuuccagaaccuguagcaaacaacaaaacaaaaacuuagacgucaagccuaaauuuugccuuucuuuugaucuuggaaauuggaguuuuggaaaaccaagcaggguaggcuuaauuaaaggagaugcuguuaucuugaagucuuaccugagugaaggggaaaguugaguaaucggaagggucaugccgguggguuuucacugucuuuaguuuccaaaagaugcuaugaaauuucaguucauuguuugcgagugucuguguugggugguggggauucagagaagaaaaacugcaggcuagugggaaaagggaguuguguuaaggggaccauuccagucuaaaauggugagugauguacgggagguguggggcucaccagauaagagacuuuaagagacuuagagcugggaguccugaguuccuuuugaagcuaaaauaaauaaaaauuauauagggaauagaagcugcuggucauuaugaucuccuggacuacacugggcauaaaaaagaugacuuucuauaagaaauucuauccaaagaguggcaggauuaugcaggaaaugucauuugguuauagccgaaggcaaacugaugcagagcugccugccacagcacucgcaggcugcuugucucauccccagcccucucuggcuggcuccagggcccuuugaucugcucacagacuguguaaauggagagcugaaggagauagagccaacugauguuacuuuucuguguacucccuuuauccauggugugcccagaaauggucaguuucccucucagcacucaggggccgccccuugaaccagauccucucugcauucaacccuuggugccauggcaggcucaggugucagugguccuaggcugguaucaggccacagcggugcaggguaagaauguuggaaauugacccugcguguuacuaucugagaacaucguggacaacguuaaguggaguuugucucucuggcucacuguccagaccagucccucgacaccacucccucuuuauagcuucaugacuuccaucuguagaaugcuuuaugucuuaaauguaccguagccaaguucauggucuuauuugagccucaggacaaugccgagaguagaaggauaagaaucguuagccccauuuuagagauagaagaauugaggcucagagaaaugcaccugggugugcauuucugucuucacugagugcuuuuguggcugagcggcuccuccagcagcacugccuuucuucaggcugcaggcuuccgugaaacauuucccuuucccuuccauguucucccaaaucaguuacuuccuucccauucccuggaagcuacuuccguccuucucucgcccggauuacucuggcagccucucagguaaucuuccaaugccauugugucucagcagguuaauuaauuugcugcaucaucaucaccaucauuauccgauaaugcacuuacauagccauucuugugaacuggcacuguucuuauugcuuugugauucauuuaauuuucacaauaauucugugaaggagguaguaauaucagccucauuuaaugaggaacuggaggcacagagaaguuaaguaccuuguccaaaacugcacaguucuuaggagccacagcugggauucaagcccaggccugccggcuccagguuacuuguucugagccacuacaucuuauccuggggcucccauucucaaagccuccucccuaccugcuucaucacccaaccaaugagcgcauuccccuuagccuggugcuugagaccucccacaguguggucucaguaucaguggagcauagcaucccacagauggaaucuuugucacuuccuaaaugugcugcccuacucauaacauucucucucccaaaaaagcuucccuuagcagaggaugggggcuuugguuuuuggcucugccacugacaauacauguaacauaggaugagucaauccaccuccccuagcuggacuccccugcucgguacguggagauauuaucauaacacugguugguugugagauaugagugacacauagcaagugcucagaaauggggaugaccuuuuccauuuguuuugccugcccaagccucccuauauuuucuuaaagcaccuccuuuaggaaguugucuuggaguuccucccuccuuuaccuggagggaucuuugcuuucuuuagcccauaagugucuuacagccacuuucaccaucauccuucguuguuguucuucuuccuccuaaacucugagcccuugcgggauacaggcugugacuugcacaucuuuauauucucagugcuuuguuuauaauagacccucaggauauauccauuggaaugagugaauuuggggccacuggaauucaguuauugcaucccuuggaaagcuuggugaguggugcccagcaugaauugaccugcaggagcagccaucuauugccugugcucuugaguucugcuuuuuauuaaaauucuucccugcuauaguuggagaucccccucaccucuuuuuauaaaacacaggcucaugggguaguguaaauuugcacaaccauuuucuaagcaaauuggcuaaaacccuaaauucccuagaagcagaauggcccuggaugugcuuuuaaaaaacagcauggauuuuagaacauggaaaaaguuauguuagaagaacuagacuccuaccaagucagagauacauauauuuauuucuuuuuaugguuauguuuauuuucuuuuuauggcugaguuggcguuguguuugguuuguguugggagcuccccuccauauaccuaggcuagaggaagaugacgaauguauuagacaagccuucugccaagcacaggaagaaugcaucuuagccguucaguuugguaugugaaauuugccggaggggccacuguuuuccuucugagaaguuagacagaguugaagugucugaggccaguucaccccagucauaguaacuguacagcugagaaagucuugguucucucuuccagccuccuggccagucaaccauguucuucugucucagccacuugcagcagccuuuuugccucugugccuuugcuuccaccggcaucugccuggcgugccacuccugacguuccccaacuauuguccagcucuugcuucuuucugaagagaggaauguacaucauuuuacagaagccuucccagcuccaacagcauaagaaaaccaagccuuccuuuuauucccuuaguccuccauacugcugcucuguguuggcauuaaucacguugucgucugcguguuggauuuacccuauugucucucucugagccucuugagggcaggaacuggauuuuaucuuuguauccugcuuggcaugcagaagcucucaaagugugcuugcacaagucaaaggauugggaugggaugauaauagcuaacauuuaccaggugcugugcuguuuuauucauagaacugggucuugguucugguauugcuuauucauuuuuggcaucuucagauuagcuggaaggguauugcuacacugucaaaaauaaaauacagugaaauuuaugcuaaugaaaacauacaccguguguaugcccaacucugugcuuugcaaaguagacauucaauggcuaucucuggaaugacuggauuaaugaaugagugaguggaugauugaauggaaagagacuccauccucugggaaggaaagaagaauggaaugggcuugacagccauacuacucuuaaagcugaacuuguugcuuggcuggaaggagggaugaggcaggagcuaagcugacagaagcacucagggaauucgcauauccucuuucuugugauuucuguuuuagggaaccaacaggucuuugguaccaucucccauuuuuccagaccacaagcuuuuaucuuguucuucagaauccuagaauuuugccaccaaguuucagccuaaaggaaaauacacuuguagcaugcaaguucucaccucaaaaccugcgugaaaauagucggugucauuguagagugaugcagugcagaaaggggccugggaugcuucacccggagaaugaaagucccaaaucuggaucccauuugcucuuaccauccaccuugauaggaguguggguguggcaccugucaccauucugcuugcauuugugugaguuuaugccaggcaaacaugaguaaaaccaauuccuuccaacacuugacacauagauaagugaagaaaauuuuaucuuacauugugaacacaauggcagguaagauugcaggaaugaugguuuguguacaagcuauuaauaaaaguuguguguugcauauacaaacuuugcuuuauuguagauggccuuuuaguucggugcuauacauguaauauucaaaguguacauuauauuaccauguugucuuuuuacuuuuaugaguuauuuguaauguggauaauaauucuuaguucacaucacauuuugcugaccacucaaggaaaaguugaacuacaaauauuucaaaugaggugauaaauuacuguuggguucuuaauugucugacaaagaaacuccauuguucuaaaccuuucaaauauagugugauuacccucguuugugugucuugcucaauuuuaaaguauaaauagagggaguuccauuaagcaauacaggcuguuuucuuaccaugcuuacaagggcuguuagaguaucaaugaugaaauugaaacuuaguuugaacuugauaugcaaaacaaaauaaauuugacucguuugaaauauugcguaaauauguuccagagccuggcaccaaguaucuggggauuuuuagagcugaccucacugaacauugaauuauaagauacauuuuaacaguguuuuugaacugguugaagaaaccccucuuccauucccuucaagucaaguauuuccugauaagaaauauucuacauuaaaagagaaguuuccuguugcacuucuucagguuucuggguuaguuuaauucaauggauuccugaagcugcaagugaaagguuaaauagguaccauuugcaacuacuuaucugugaaucagaauuuuuugaauauuguguaugcagaaugaaagagaaacauacuucguuugugauuuaaacuauguucuugagaacauacuguaauuuacauaauucagauaaauuaucuguuuuguauauugugguuauauauaagguuuccucugacagagggugauuucugcugcuaaaguuguuuaaagacauugcccuugauauuucuagcuaacaguggagcucccaggugcaaccugcugugguugaauuggaaacuugucacugagcucuuuucuuaccuggcuccuucuaggacuuucaagauccucugguguggccgggccagaugggcuagcccugaugcacauguccuucuacgguucaugagcguuccaagcuugagugggagagucagcuugggcagugggggugauagucauauccucucaccaucuccauaaugggccucuucuuccaggcaagagcagguguuauccccauuuuacacugaagagaaaaccaagcugagaaagggcaugugauaggcccaagggcaucuccugaccuugacuagcacucuuuucaccaugcuguuuuacccucguaugucucaguugcugugccuaggagaagaguuccaguuuguaaaacucucuccaaauugauggccaguuggagauuuuucggaaggcuuaagggaaagaaauagcacuugugggacuuuuuuuuuuuuuuuuuuuuuuucagaagcaugaugccagcagaagacuuguuuacuuguggugcuauacuugugcggcugguguuuaucucacuuucuauagaggaacgcaguugaugucuucuuuuaaaaacacuagacccgagaccugggaucacccuuccacuccuccucaugcuguuugcuuuggcauucagccagcugccugccucuaugugucaaaaacaagaucuccccacccaaggacaugauagagcuaucugcaagccauuuuaaggcacauauucacguuuaaugguggcacuugaauuaguuuucacaaagucugugcaccagagcuuaacuaccucacucucaggccaccuucugaaacuuagugacaucauuccuaggugauucucucaaggcucugccuauuuauucuucaugccuuugcaauucuaaccuuuuaauuucugcuucuuguagcauaaacugcuagaaaguagggaagagggugucugcuagagagagagagggugauagcugauaacacaggaaaagauaaacacuauaguuggcacauuuaaaagguauauugaacugggcucuuuagcccuaauugccuuucuuuuuuuggaaggucaguacuauugucuggcacaguaggacacugggcacaguaugauugugauguuuacaaagcaucauacuugugucuagucaacucuguuuaaggaaacaggaagauuguuagaaauacuaaaaauuaaaugaaaaguugugaugcuugaagugcugauuaguauucggacuaaaguauaugaaugaauaacaauuuuuucucugcagagacugcagcaugaaaucucaugcuacauugacugguggcagugguuuuuauuucauagaacuuucuuuucuguuguugagaucugugcuguuggugcugguucugcuuuggcaguucccaaagucccuuacaggacaagaaugaugaguggggauauaaaucucaauuccagcagcugcucacucacaggugucucgguggaagaauugggucuuguugagccuguagcuucucucuauauacugcugggagaugcugccugugagugccuugcuugauauccaggugcuagggcuaaggaccucuuuguggaauagccaucuuugcuugaggucugugcaauuguguaugccugcagugcagugccugguaaggcuuucaaacugugggcaagaauguaacaaugccugucacucgugaagagacacagucggugaggugaguauggauuagugccaaggaaaguuuucugggucagagacuuuauccugcugcaggaauuaacuccauugaucaaaaacagccuuaauugggauggggcucgggggcaaauuucauaugugauuggcaggagucuaaacuguauagcuuuucuggagggcauuuuggcaguggggauuaaagugucaaaugugcauacucugugacuggacauuuucacuucacagaauuuauccuaaggaaagcauuguacaaguauacacaaaaggguguuccuccgcaccauaauguuuaguguugccaucaccuggggcuuuauuaaaaaaggaaaaguuacauaaauuccaguaaaaccauacaguggaauauuauaaagcugcugaagaagaugaagucaacuucuauguacuauuauggaaugaugguaaagaaauuauguacaaaagucacagaucagcaugaauagugugauccuauuuucaauauauauguguguauugagugcauauuauguaaagguuuauaugcauuaauuuugggaggaagaauaucaaaugcuaauagcgaucaucaaaugcuaauagugauuauguaaagacccucauuuucuacuuccuacuucucuguauuguuugaacuguuuauaaagguaaaaccauaguaauuugggcugggugcgguagcucaugccuguaaucccagcacuuugggaggccaagugggguggauaucuugaggucaguuguuuaagaugagccugaccaacauggugaaacccugucucuacuaaaaauacaaaaauugguugggcuugauggugugcaccugugguccuaacuacuugggaggcugaggugggagaauugcuugaacccaggagguggaggucgcagugagcugagauugcaccacugcacuccagccuggaugauagagcaagauucucucucaaaaaaaauaaaaaaaaaaaaccagaauaauuugauguuuacuuuuuauaguuuuguuucuuuuuuugaauuuuaauuuuuuuuuaaagauguggucuugcuauguugcucagguuacacuugaacuucugggcucaaaugauucuccugucucaacuuccugaguagcugauaguuucuuuuucuacuuauuuauuuuagagaugagggucuugcuuuaucuuccagguuggagugcaauggugugaucguagcccacuguguccuugaacucauaggcucaaguuauccucagcucccccaaguagcuagaacuacaggugcaugccacugcgccuggcugauuuuuuaauuuuuauuuguuuuguagggauagggucuugcucuguugcccgggguggucuugaacuccuggucguuaacccaaguaauccuccugccuugguuucacacagugcugggauugcaguugugaguuaccaugcccagcccugauaguuucuuuuuagaaagcugaucagcaugggccccuuuuuacgucuuuuaguucuuugacuuacuggaacuuuucugauuucauuuuuuaaaagggacucuucuaccuuuuaaaaguccuacaacaucuuuuucuuauuuaccuaaacaguaaugagaaaagaaauaaugaagucuuaccaaauuguuaaaaaaaaaaaaauggaauuguaggccaggcacuauggcucacaccuguaauccuagcacuuuggaaggcugagguaggagggucacuugagcccaggaguuugagaccagccugggcaacauagcaaguccuugucucuacaaaaaauaaaauuagccaggcgugaugcuucacaccuguagucucagcuucuugggaggcugaggcaggagaauugcuugagccugagaggucaaggcugcagugagccgugaucacaccacugcacuaaagccugggugacagagugggacccugucucaaaauuaaaaaaaacccacgaauuguauauguguucuuuaugaaaauaaugugacagauaucauugggcaucuacugugugccagggauacaaggaugaauaagauguggcuccuguuauucagaguucacagugaagucaggaguauaguuauaccaguaaaugaugguuaaacugggugauaagugcaaauagagggcgguacaguacacacagugagaauagaguggugcugguaauucauuuauuuaauaaagagggagcaucuuuauuauaauuuauuuaaucaagagcaagcacuggccagacacuguuguaggcacugggaugacacuguuguaggcacugggacagcagugaacaagcagguaagguccuguucucauggagcuucuguucagcaagagagagaaauagacaugucaugaagagcgugaccggugugaagaugaagaggaggauaauggcagguggguuguugugacacgugaguuagggagaguagcucuucaggaggaggaaugaugguauguagaggaggagagagugagugcuagcgucuccuggaaggggauggaagagauggagauggcauugcaggcagagggcccagcugguacaaaggcacagacauaggauaucugggaggcccccgccauuuuggguuuacagcaaguuggggaugguguuuuuaggacuguacugugaauaccauguuuaggagcuuggauugaucuguuggugacuggcuggccugcuggacuuuaaauugggaagagauaugauuggacuggugguuuaggaaguucccucugacucugagacuggauugaaagagaaagacgagagucaggguagucacuggggaggccacugcagcggcucgggaagaggugaucaggccguggaagagagguggaaugaagaaauuagaaugugcaggacugggugauuauaagccauagaaauccuggcuagagcaggaguuggaagagauugagguaguaaugacauaauucauauuuguucauuuaaauccagguuugucuaaugccacuuuaagauguucucuuaguagucaccagugauguccugaggucaaacccuggucuuuuagcaguucagcaucucccuguuguuugagaucuugcauacugcaaaccucccuggagccucagagacccuuuccccaggggucccuggcuggugaaggccugaagacaaggccaaguccucucuucauugcugucaacauuguuaguccuuucauguucccuccccuacaucugggaaugcagugagaugcaguuucccaucuccuuucuugucccauaagacuaguaaacaggcccuuuacccucuggggguuuuuuacugagaaucaauaaaaggaaacugcuaaagaagcaagguaacguggaaggugacugauguaauaaaggcaaaguagcaaagauagcaagguaacaaguuaacagcuguagcaaugaagcaaguguggggucccucaggagguucugcuccucuuacaaagucacuguccugauugcuggucccugacucuugguuaggcuguaucaagcuuccugaucucaucuuuuauuucucaggguugaaugugcagagccugccucucucuucucuacuccucuucuccagguccucugcaccucuuucuucaugaaagcuccucaguccaguccuaggcacucagggaguguccauuucugggcccacuuggauaauuugcaucuuuugagggacauucuccauaacaguccccaaccuuauggggcagucuuuuugaaguauuucuucauggagucacccuuguccucaaauaucucccucuucucuguccgucugcccguccauccauccauccauccaauaauuugagcuucuuauuggagcaaaucacuguucuuaguacucaggauauaaaaauaaauugccaagggacucucaguuuucuuccuaccacucugacuauggccucuggaaucuuugcuggcauugccucuuccugugagaaccacugacauuuuaugugcaccuacacagcuucaccugcuaucugugugcugcugucggugcaugaugaccgccaucccagcucugcaauuuaccuugcuguguggcuucaggcauguucccuaaacucuguugcugcccucaguugguaaaauggaaaugauaguguacuuauuugaaaaguugcuuugcagauuaaguuaaauaaugcaugugaagugcuuggcacauuggcuggaacagauuaaguacuuaaauguuauuaccaccaccgccaucacuacuguuaguauugcugcuaucacuaccauucuuucugcccuugggaaauauaucaaucacgugagaauaauagggaguaaaaugagagaccagacuuuuaucugggugagaauaaaucaaauccaguaucuuugggauugauaugcaagcauuauggggcaauuuugaauugacaauugagaggggagccugugggaagacuucauuagggauaagugagucuuaaauaguacuugggccugaauugauaaagaagaggcaucaaguuuagacccaagcuaaguuggaaaggucuuuagccuucugucuaguaggaggguucucggguuggugaccagguacuucucaggugaacacgguggggccugugcauuuguuuguuuguuuauuuauuuauuuugagauagucuuucuccauugccugggcuggagugcagugggaugaucauggcuuacugcagccucgaccuuaggggcucaagugauccuccaaccucagccucccaaguagcugggacuacaggcaugugcaaccaugccuggcuaauauuuuuauuuuuuguagagaugaggucuugucauguugcccaggauagucucaaacacuuggacucaagugguuuuccugccucagccucccaaagugcugggauuauaggcaugagccauugugccuguccuggggcugugcauuuaaugugaggcuccucaaacccgugcccacauuggggauugucucuagauuuauuuaauaugcugcauguuuauaauuaugccugaguguuuucagaugucuaaaaugcaaaucuauucaaaacauuacuaaacauuguauuaguuuguuggcucuuagucauuagauauuaaaaguaggacuucuauuacauggguggccuguagaacauuuugguguuagaagggguucccaaacuugaaaaagucaggaaccacagaauuugccugauaaaaccagaagcagauccuggcagcauucuagcuggaggguacaacccaauuaaaauggcuguguaauaaagcgaucuuauaucucauaggacaaaaaguccagagguacagugaugcuaggguuaguuagagcagcgucucagugaccucauaggaccugguuguucgccuuuuccacuccgccguccuuugcgugucagcucucuccucucauguucagcaaauggcugcagcagcucccggcaucacaucuccauacuaaugucccaauauauuuguuccuggccucacuucucucaguaaggaaagcuuuccaauuacuggccagccuucagacuuuucccucaugccucacuuugaugaauggccuaacuugcacauuccuagaugaaauagggccuagggaguggaauucccacacacaggucagggaucccaguggaagagggaacguguagauugaaucaggauucugccuucaagaaaggugggguggaguauuuggguaggcaagaauaucugggcaggcaggaacucgggaggcugccaggcaguucaucagggcgguagcugggagaagguucccaagcagucacauccagggcugcucuuuggcuaaggggcagaagccucccaagcaguggccccagggagucuccuggcacaaggagaaguggaaaggucuuagagugggaugauaggaucugcacccugucuuuguccccagcagcucugggccauuuauccucuguauagugcucuggggagagacugcaaaugcuucuuuuggcuuuucuuuuuuuugagacggggucucauucuguugcccaggcuggagugcggugguggaccacaccuggcuaauuuuuguaguuuuuauagagacaagguuucaccauguuguuuuggcuuuguuaaaugagagcccacuguguccuggccuaggcacugaagauauagugaaagacaaauaggcauggacucaucccucuuucauucauuuauuuagucauucauuccaguaguaguuuccuggggcugcuguaacaaagcaccauaggcuggggauuuaagcaacagaaguguauuugcucaugguucuggaggcuggagguccaagaucaagaugccagcagguuugauuucuuccgaggccccucuuguuggccugcaguaauggucuucuugcuguguccuuggguggucucuccucugugugugucccuagugucucuaugucccagucuccucuuguaaggacaccagucacacucgguuagggcccaccuuguuaaucaccucuuuaaaaggccaugucuccaaaugcugucacauccugagguacuugggauuagggguucaacauacgauuuuuuugagggggagacacaauucagcccauaacaauuccgcaguucucuaccaagugucaguaugugucaggcacugcccucuaggaauguagcuaugaauaaaacacaaaaaucucuacccuuauggagcauaccauggggucggggaguuuaguggucuucagucaccgcuuccaguuucuguuugggacccaucuaacuuaguaugauuuuagcacccuccucuccuccaaauuccuuauuccuguaaauuccaugcccugagaccauuccuucaccagagacaaaacccagggauggaaaagccucgugacccaguguaaccagcagaacaggcaucagggacaggagauccuuucuaguugagcaggacuccuugagggaucugagaaacagauaaagccuggggacuggggaggaggagaggguaugggucucgggugauggcugggcaaggagaggcugugggcaguuuucuuuagccaagggcugguugccuucguuucaccuggguggggggcccagguguucugcuccuggggaagcuuguuucuggaagccgcagcaggcuggcugucucucuggggagcugcacgugaugcagacggggcugcuggagacaggccuacuggcauggagaccuaccuugcaggggcuuugccagaagggguugggaucagggagucacuuccugaaugauuuggguuguagaugggcuuaucagauuaaaaaaaagaugcccaguuaaauuugaauaucagauaaucaguguaugucccaugauucaaauuucagguaagcaauauuugggaaaaauuuauacuaauaaauuaauuugaaugucauuuuucugacauucacauuuaagggggcauaccauuuuuauuucccgaaucuagcaaucucaccucuagggguucccagauuaacagguggcgauggaagaugggggaaagaccaacaagaacaaucguaauucauuuuuuuacaguaaaaaucuuggccaaggaaucauuuccuagcucacccuccccaccuuccccccaagacugagacugucauuugcccccuuugcaugaacagaccucacagagaggucauagccuggugacuuaggaugggcuuccuguccugcgcgggcucuuugucugucggcuuccggccgagggaugggagggggagcagucugaacacugguggaaacuccggccaacucucuccacugcccuccuuuucuguugcauuggaaccaccggacaagcagaaucgcugugccccaauccagccucaucugucuuagaacagguaggugucugcgagggagugcagcagagagugugacuuccuaggaguucacggggggguuccugcagcccuuggagagcacccuuuuucugcugacaucccuccccccuccauugagggaccucugucauugcugcugaaucccuggaccugaaccugugaucaagaaguaauccuuuuuauuuuccccccagacaauguuuagauuuuugaggucucauuuuuagcaguguccuggcacuugcuucuuagucaggggucagaaaacuuuuucugguauaggucagauagcaaauauuuuugacuuugcaggucaccuggucucugccaccaccucucagcucugcuguugugguuugaaagcagccauagacaacaugaaaaccaguggauguggcuauguuccaguaaaaucuuauuuauggacacaugugaacuccauguaguuuauuauuccuuuguuuuucaaccauuaaggaauguaaaaaccauucuuccuucaugggccauacaaaaacagauggcagaccagauuuggccugugagccaugguuugccagcccucuucuaagucaucagcagagaacauuacagaucagaagccuggcucugcguucccgacauaggcgcugaauggcuucccgcccugaggucacagcuucugcugcucccaggugacugacugagcugggauccgaaguagugggcuuggccucucagcugcccacaauguggguaccaacucacauaccauaguuugcuguacagagaaagguuccugcauggauuuguagaucuucagaggaugagccauaaacagucaagucuggccauggaauguaaugaauguaguuauacugaucauagacuauaauauccagagugauucggggcuaauaaguagccagcagaauugaauguggggcaguuguaugccucugguaugcuacuuucugccuacaguugugugugugcuugguauuguguguuuuaagugaaaggaucaauuggauuugaauuucugucacugguagggucuagcuacaccugaaacaugagucaggaggcagggcccuucauuccugagugucuugacugauggaagcuuuguguuuuauggauagaagaugugcuguguaagguggacaguggaauuacaccuccacagaaaucacuccuggauggagaaucaaguuugcaugugugcccuguagcauucauucuugccgcaugcugggagaugggugguuauuagguuaugucaaaguaguguuugccuuaauacacgaucuuccugcaguaacccaauaauggaaguggaagggagggaggaggggaaggugaugaccugcuuauuugaaagugggaagcaucuggaagucaaggaagcuuugugugguguuaacagggagcuaguaggggucuguaccccacugcucaccccaggccccuggcagguuugaauucacuaauucuaguccucaggugagguagcauggcuuagcggucagcaggacagcaucugggcucagacugccuggcuccuggcccacuguuuuucaccucugccuuugggcaaauuacuucaccuugccauuuacuggguuguacaguggggguauuaauagaaguaccuuccucauagggcuguuguaagagugaaaugaguuaacggauaugaagggcuuagaaccaugucuggcucauagugagcagcacgugaaucuuucuugugguugugguggugguggugaagguagaggaggaagagugguuuucuuagccucuaaccucaugcucugaggguaagcacagcucugguagucaucauucagaguccgcuuauaacccugucuccucccaccaugucauacagagacaugugaacaucuguggggacgugccccaggcauucuuugugaguagugguucacggaggaugcuuggcccagccacaaccuaagguuuucaugcuacaccugucacuugcugguugugggaccucuggcaggucccuagccucucagagcaugaaauagagauaaucaggugucccccggccccucacaggauugucuugggggcaugacaagauaaugaaagucaaagugcuuugcaaacugaaguuccccugcagaggaaaggugugauugcugcuguuggcaucaucuuccucauuauguucuugcauucccuuggucucuggguauccuuccuccagcuucuguggggcaaggguuuugaaacaauauucacagaauccugguuuuuccauaaagacauuucgauguaccguugcuuuuuuuuuugggugaaauuauugauguaauucaaguuugaaguuguguaauaauaaugugcugauuuuguauaaggguauuauuucugaauccaguuccuuccuuuucuuuuuucuuuaauuacacucuugucuuuagaguaguguucuuaagugcaguccaaggccagucuaguuguauucagauggcuuuguuaaauuggguuuucugugacccaggcuuuuuuuaaaaggaaaaauuucaucaaaucccaacaacuuucauccuaauuuuaccugcuuaaaucucuuccugcacccuaacuuggguugagugguauaaauuuuacuuucugaugcuuuauguauaucaucauaauuguuuaaggacauaauucuuaauuaaaucuaaagagcuugaaaacuuugggguuuuuuuuuuaggggggggaguccaagggucuucugaacaacgcguuuucaaaugugguugguuucugggauucccagggguugggaagcugucucuuugauggugacauuuccaggaaucaggacaggacucaaguccuggcuugggucauucccaagcccccuccuccgcagccuguguuuagcugacucugaccacagcuaaacaugagagcaguuuggggaggugauggaagguaccuggggaccuuugacucugccuaguggaugagggacugugguggcugcauccuguggaaaugauugcguccuguggaggaaugcucuugucucacagugggaguagggaaaguggcuucuauaugcucacauuaacaagggugagauucugucccaugagcuuccugagagagaucccgcuuuugcuccaccucaugccuugcugagugcaggcagcucagccacagucccuaaccacacauugcggcucucuaccucuuaagcuaugcuccuugcuuaacuccagaugacuuuccagcacauugcugacucuccccuuucucuuuccaguccuuuuuuuuggggggagggggggcggggggcugugucaaaaaggucaggcuaggggcagggauuuguuuuguauugaaaaagacaaccaaggcugagguaaaucuuggcagccuuuucagaauuuaaucugggugaagccguggguuggacaugggguagggguauuaggauauugguucaaacugcgaagaacuuggccagcuauacaaucuugagcuaauagcuaaaaaaacucugacuugaaaauuaugguuugugaaaaaacauugagggcauagccuccugaaagaggggagggcugaguaggaggaacauaguccagguggcaugaucuguaaugaaaauucaacuuugcaaaccggcguguguuuggaaaucuaauguuuuuuuuuuuuuuuuuuuuuuuuuuuuuuuuuuuuuuuuuuuuuggggggggacccagccaugcugugucuuguagaucucauagccaguaaucugcugagguggagcucuggccuuggucucuccugguagugaggggcaucucucauuauauaauguugcucugcuaauuaagucaggaauaaugucuauggcauauuuaauuuccaauuagacuacuuuauggaucaauuugaauuuaauguuaaaucuaauguggaaaucauuaaaaaguuagaucucuagagagaggaauaggcacuuacucugacuauuaaaaauaacaguuaaggucauguguuaauacauuaaguguuuuuauguggacugggaagaaauuaguagagaaugcagaacauauagauacauagauagucugcaugcuugugauuuggggaaaauucugguguucagaucaaauucuacaaugcuuauaguaacugcugcaacagauaucauuuacugcaacuuuacuguaugccaggccccuggugaguacuuuaaauguauuauuuaauuaucagaacaacucuaugaggugagcauuauuacuccccuguauaaauaaggaaacugaggcuuggaaggugaaggucucauugucagaaaauggugaaggcaggauuugaauccaagccaauuucauuucaaaaucaacucuugacuagauugaggugcuauggaaggugcccaauaauuguaaccagcagagcucuguaaguggucugaguuuaaagcccauuugcuucugaaguguuuguugcugcugauaauuugaagaauggcaucagcacugccauuauugcuuuaaggaacagauaugggccccaaggugccaagccaagacccucucccagcauucccaggcuaaagggacaguccucagaaaaugugacucucugaccaugacuugucugaggucagccccgacacuuccucugggcaacuucucagaaguuaacucauccagcaccuucagucuuguguguaccuuggauuuccuuuggaccuuguauucuuuauggguuauacuuucuuguauucuuuuauuuuucauguuugacuacccuguguuuaguuagacagaagaaugugguucugaguccagacucucacuuacugccugguguauuggacaaaccauuuaaucguugcuaguuacuagucucccaugcaguguaguugugagguuuccuugaggacgagugaguguagaagcaccuggcucagugcaggugcaggaagaaagcuucccuucuugcguucuuguucccuccccuguaggaacagcauccauuuacuaaugagaugaccagguucaggagcaccacauuuuuucuggcucuugcgagugccuacuguucauuuaugcaaccacuguguaugagggcacaguaucuccagucccuguucuagcagcugggguuacuuuguggaguaagaaggaugaucugcacacaccccuauccccagcauccuggagcugacacuauaguggggaggagagaaggggcagguuaauaagcaaacaaagaaaauaaaugcuguauauaguuggauguagauacucucugucagcucacucauucauucauucacccauuauuucaacgaacaguucuaaauacacauuauguucccagcauuaugcuaagcauggacaugugaaauuggauaacgucuguuagcccaggaauuauuucaacagaaaaaaaaagucuggaaaauauagaucacucucuuguguucuucccuuuugaacauccuaacucuuuaggguuaaauacucauuugagcaaguacaagcuucuaaauauacccacuccucaagccccccgccccacuguccagcagguuuuccuguugauaggacaguggacguaugaguuugaguguuuggcagauguuugcaugauucuuagaucagugcuucucaaacaucccugugcguaagaguugccugggaggcugguuaaauucagauucaggugccucacuccuaaauauucugauucacugggucuggguuggugccaguugucugagcuuuuagccugcagugcaggugaauugguugcagguggucugugaaccacacauggaugaaacagugucauauucacaccaggcuggaagaauguuuaaccucuucaguuuaaggaggaaacuauuucccagggaguggaggggcucugaaauucgaagcuacagugacaagaugggccaggacuuuugaacagaacagaucugggaucucauccugucuccacaucuccuaaaccuggucaucuccucaguaaauggaugcuguuccuacaggggagggaagaagaacgcaagaggggaagacuccuuccugagugcacaccaugcacugagccaggugcuucuacacucgcuguuccucaagaaaccucaugcaggcagccuugaauaggucauccgguaacaucccuuuccucaucagccugccuugcuagguggguaaugcugagagauaugguuggaaagacccaggcagaguauaggauagagacucuagggcuagguuuugguccaugcuaaaaaauaacauacaaauugguuucccaaauuccugauggauuauuugaaugugaguugagucgcugcauauauacccugugauuucucucucuuucuuuuuuuuuuuuuuucacaaaaauacacuauaaccgcaaaaaagacagucaaacaaaagagggaaaaaauucauccagaacuagcucaguacccuaacacaacuguuuucauuuuaacuuuuagcccuugucuguaugcaggcauguuucucuguaucuguaaucauauguaggcucaauuuuguauucugcucuuuucaguaaaccuuaaguaaaugcuuuccaaaugguuauguagucuucaagaugauuuuuaaugaucuuacaaucuaucaucccacaggcugaauuuacuuaaccauucaucuacuguuggacaucuagauuuuuuuuuuucuguaguucugugcuauuauaaguaauacuuugggauauggccuugugcuuauuguggauuuuuuccuuagggugaauucccaggagcaggauuucuggguuaaagggcacaauuauuuuuuuggcucucaauggauauugcuaaauugcuuuccaaaaggguuguaccaguuuaugaugccaccagcagugcgugaagguaccaauuucagcaucuuggcuugcacuagauaguauaauuuuuacaaaaguuuggcucaauggugcacaucguuuaauugauauuucuuggauuaugacaagguugaguauggcuuuacuuacuauguuuugagauuuuacuuaguauuuuuguuuucuuacagucaggaccuagcugugguugaggucagauuuucuguguagagcuuuucagacucuugaauuuuacagcgaaaaaacaaaccaaacuaacaaaaaccaaacccagaauucaucuguaaaauaaauacuuuggacauauuuugugguuggauuaacuguucgugauuuuaacuuccuuauaggucauaaguuaauagggcgguauuuggagaguagcggggcuuuuccucuucuccuuagauucuccuuuguucuuucccucuaccauccccccauuuccuguuucccuccuccccuguaagcccuguuguugucuuuuuggagauaaaacauaaaaggaucagcuuuuagucaugcuccuucaacuuauaaaauguagguugccuaaauuauguaguacagagugaggauaaagaaaaucacaguauuguaacacauugccuguaacugcuuugcaaaagcaaacgucucccacgaaaucuuagaaagguguguuugaggguguaaucuuggcuuguggugcaagggagcccaacuuguuuuucaaguuggucuugaauaaguuuguucuuucuggaaugcucgccauccucaguaugacagaguucgcuugaugacaaacucuuuuacucuccuauacauaccauggccacugaacugguuuguuuauuugccugggguaaaugauugaaacacauuccccuuugcaguggugcucagcauuugauagaugauucuuauuccccaggcuccuucauggugaugccaagcccaagucuagccuuccaguggccccugaggccacacuguccccuccgcaacaaacacugagaaagacacacacucucuugggugugcacguaguuuauugagcucgugggcucuccguaaugcugccccacuaugcgcauaguaggagaauccgauauuggcagaauaacugggucuauguacauaaaguagaaugaucgaggcucgauuucaauuuaauuuguuaaugaaacaagauggaucacauuuucccuucccgcacaccucucgggcuguuugagaugaggcacaauuaauuuauuuguacugucuguggaggcguaugccagcuaauguagugcaagagcuuuuaucuuuauguuuguaaugaagaggggcaggccgcuggcaaauugacaaggagugcugaugacucauccucugaaugcgagugcuuucuucugaaaucauaaaaugcgcgugcacacgcaagccuaguuccuguuugaaauggacagaaccccuuugggaaaguucaggugccuuugaaacacugcaggggaaagaacaggccagugaggcuguuucuccggcucccuggccugucuugagggcagaaccuccugcucagugggggcccuacucugggaugggaauucccauccucucccugcccucuccuccucgccccuccuuuccuuggaaggcuggcuccuuuguacuggucuuuugugcuccaguaggcagccuuccccaccugccaggccaggugccugguucaccuggcgaggccugugcuuccggggcugcucccuaaccuugauccugggcagugcccuggggcuuugcuuuaugaggcuguggauucuggggccugguugauuuuagccugggaguacacaugggauuccucuggccuuugcuugaguuccccaggccugggcuuggugguggcuguguugucacucuguugauaugccucagaagaaauaguuuacacaguaacuaaaguugguuuggcccuuuacaguguguaaggcuuucuggcauuaaaacaacucugaauuggauauauuguuaccccacuuuauggaugaggaaaucgaggugcacagagguuaaauggaauguccaugaucaagcagcuagccgguggaaagguaguggggacaaaaccuuggacuuuagagucuaaaaccugaccuuacaauuucuuuauaacauucauucauuaaggacaaaaugaaacuuuuucugcauaagaaauauauaaauucucuucaagagucaugugagaguuugacagcggacuagagugacuaugguuaacaacaacguauuguguauuucaaaguaacuaaaagaaaggacuugaauuguucccaacacauaauaaugauaaaugcucagugugauggauaccuuaaauucccugacuugaucauuacauauuccaugcauguaacaaaauaucacaugcaccucauaaauacguaaaguauuacguaucaguuaaaaaaaaaauuaaaaaauaugugagugaauauacagauuucuguaguucaguagaauaacaggaaauucacaggaugcuuucuggagacuuaaaagcaaaauguuugcaguggucugagaaagaaacccugaagauuguggucuaagaaguuuuccuuccugugucagaugccuggucgagcugguuguacaggaaggcuaagugcauaugucccagucaguccugucacccggguguaagcaacacaaaucacugugcaugguuuuauugaauuucagagccagaaggaaccauggagauuuuacaaaugaggaaacuauggccuagagugagagauuuuguguugggaagaauuccauucauuuacccaaccauccuuccacgcguccaacaaauauuuauugagccaguuuugggcugggagauaaggcuuaggcugugaaugaaacaggcacaguccugucuucaaggaacauaaaauagcagaugacacggcugagcaggaaugagcauggcaugguaagggcagugaugagugaagucaggguagcuugaggcacauagguggggcacauaacuauuggagugggagaagguaguuagggaagguuuccuugaaagagugguaccucuggugagacuugaaggauguugcugaaugucauucuaaaaauggagaggcuguguuggcugagaauugggacgucauaauucucaaauccaacugaaguugguaaaagguuguaugugcuuggagaccgcagauacuaggcucugagacuuaaaugcauguaagaagugguugcucuaggccugugcugugcacugggggagucaccaaccuugugcgcuauucagcacuaggaagguggcuaaucuggguugggaugugucauaaguaaacaaugaccacugaauuucaaagacuuaguauggggggaaaaaaaguaaaacacaucaugaacaauuuugggcugggcacgguggcucaugucuauaauuccagcucuuugggaggcugaggcuggccaauugcuugagcccagcaggggcaacauggcgaaaccucaucucuacaaaaaauacaaaaauuaaccaggcgugguggcaugcgccuguagucccagcuacuugggaggcugagccuggggagguugaggcuacagugagcugagauugcuccgcugcauuacagccugggugacagagugagacucuguuucaaaaaacaaauguauaauuuuguuuauauugauuauaaguuggauaauuuuuggauguguugaguuaauaaguuauugaaauuaauuucaccuguuucuuuuuaugucugagaaugagucagcugggugugguggcucacaacuguaaucccagcacuuugggagccugaggcgggcagaucacuugaggucaggaguucaagaccagccaggucaacauggugaaaccccgucucuacuaaaaauacaaaaaucagcuggacgugguggugcacgccuguagucccagcuacuugggaagcugaggcaggagaauugcuugaaccugggaggcggagguugcagugagccgagauggcaccauugcacuccagccuggcgacagaaacaaaaacaacaacaaaaaaugagucuacuagaaacuguaaaaugacaacugugguucacauuauaguucuguggguggggaugcuggauggagagacugacgcaggagaggcagcuccauuguuggagugaggggguuuuagaaugaagagcugugaaucggguccugugggcccuggggcauagucugugguaggcgcuucgcaucucugaaccuugcugcccuguuucugacauccccuuaacuaacacccaucccacaguggggacugaggauaaagucagaaugccuaggaaaagcauuuuuuaaaaauauuaaguaugaagccauugugauccaugguucucuuuguaauaaaaauuugggauuaaggccauauauaccauacucuguacuguauaccgauaguucaaaagacagacaagaaaccuggccaguuauaaaauagaaggucgaagugugggaaaugcauucagcacagaaugaauuacagagugggaguggaucugugugagaugccguagauaagaaaauuccuuuucuguugcacuuggcuugcucuacucuaggaauucccucacccuuacaugcaaguuuguauccaggcuuucauaguccuuguuccuuguuuuguuuagucuccaaaggccaacaaggaauauccauaucuuuuuuuuuuuaaaucuucaaguauuucauauuguauuccugaaacuccacacucauuaaaugcuugaaugaauugccauuauaccacuguuuccugaaaaccugggugugucaggcaucugcugggcugguaggaugaugaugggcaggacacagccccugcccucaaggugcucucaguugggaaugagacagaaugcagugugaccaagccguaguagaggugagccugaggacugugggagaccugaauaguguuccuaacugcuaaacgugauuuaaaggaugacugaguuaaagacagcaaaggagggagcuaagggacaguuguagcugccuggagugcacucuguugugauucucuuuuggucagugagacuguggaucugaguuugcauaggauccugccaguccccaggggucucuaacaccguggcaacauucgauauuaauguugcaccuguauauuaguuacacuuuucauugcugguuuauguacuucaaagguguagcacacagauagcccucccugauagagaaugaccccgguuaguuggaaggcucucagaggaccaguggggcagagacaauucggcagcacugagcaggggguaucugagggguauaagguagcugugaccuggcauagaguuggcaggcagacagucauuucagugggagauagcaucugauacucaucccuucgggcuagucuuguaauagcggcagauaaauaagcugccuccaguguguuuccagaauaucucugucugcaaaaugucuuugaggagauguuugacuugcaagccugugguugauaaaauaaauacauuuuaaaaauguaaaccucucugaaagagguuuuagucuuuucucuccccagggaaaaauaaggcccuucuuuaaccucuuuucuucccuaaguguagaauucuugccaugcuuuauaagaaaaaacauuuuuuggaauguagcaccuguagaaauauaaagggguugugcccaaaccauuggaccauggcuauugugugggugguuucuuggauguuuugugaagagguaucagcccugacaccugcaaagcuggaggagcuggacuuuagaagugcuuacauuguuuuuagcugaauucugagggcaggcagcuguaaugagugauucucucuaauauuagaggagccuugccauucagugacaucugcuagaacaggacuuggugccuggaaaaguaccucacacaauguaggaacuucauauauaguuauugaaugaguggauaacugaauaaguaagugaaugagugaaugacuagggcccuuuucugggcuuucagaucauguggacgagauuccccaggccucucucuugcugcuugaggguagucugugcaacagcagcgucagcaucaccuuguuaguguuucugaauccuggacaucuuguuaagcaugcagauucucauucaguggaucugggacagugucuaagaaucugcauuucuaagaaagucccaggcaaugccaugcuggucuauggacuacacuugaaguagcaggggucuguuaggguucagugagaucaucaguaagucuguaauaggugcucagcgugcacuagggauuguggagaaagauggaaaccuagguucucuuguuaaaacuuguaaucauggugaaaaaucaagacucauccuuauaaacuggagaaaauccauucauuauauugugugguaugauaaauggucaggagaaagcuagagagaggaaugaaggaccuuguggagauggugcuugggccaugguguagaaucaugagaugcuagcauuaaaguugugucugcuuccaacccugugugaucucuaagccucccugaugguuggcuauccgacuucugcugaaaugcccucacgauagagaaugcacugggucccuaauucucaaggcauguugcucuccucauaucuuaugagaugcccugaggaaaggguuugcccaggugaauaaugccugcauguguugcuuauuccauccacacgcugcagauucacagcgcagcauauuaaaggcuuugcaaugccuggcacuaagacagccaguuuaacuuuguauuaccuaagguaacugggucuaacauaggugaccacaacuucccuccuguuuuauuaguacuuauuaauacauguuagcaagccuguaucaggagguucaucauacugaguuaauacaggacucauuuaucacucauaaaacauuuauuaaacggccaugacguaccagucgcuguucaggguuaugcacggaggaguaaauugucucuugcuuguauagcacuuuauuguuuacaaaacacucucccaggcuuugucuugaauugucagcagaaccuugugagguuguauaaauuuuacugccauuucauaguugaggaaacugaggcuucuagagauuaaagugacuuguuuaaggguauauucuuuccaguggugccauugggauuugaaacuuuugauucccaguugaguguuuuuuuuuuuuuuuuuuuuuuuuuuccuaacgguauuccauuuggcuccaguuuggugagagaaccgagagagguaggucuuaaaaacuugauugagaauugaacuuguaugagagaaauagagguguugugguuucuagagcagcgauggcucaagcagugcugaaggaauuggaguauauagauuagagggaacuuuaaaggucuuucaggaggagcuaagccuguacuccaugacuuuauggaggcuugccuacagugcuuuucuacauagcucuuuuuuuuuuuuuuuuuuuuuuuggagauagagucuugcccuguugcacaggcuggagugcacuagugcaaucauggcucacugcaaccuccaccuuccaguuucaagugauucucaugccucagccucccaagcagcuggaacuacaggcacacaccaccaugcccggcuaauuuuaguauuuuuuaguagagaugggguuucaccauguuggccaggcuggucucgaacuccuggccucaagugauccgcccgccucggccucucaaagugcugggauuacaggcaugagcuaccaugcccggccccuuuccuacauaguucuaacgcauccuggaggcacagaucuuuugaugaggagcuuacuacagcaaaggccaguuuauuucacuuauacaccauucucuuauguugagcuuagauagggucucuuagaaucuuuauccauuaaucugaauucccuaccucugcuggaaccauacagcacaagccuaauucugcuuuucauaugcuagcccauuuagguuuuuucuuuugaaaaaucuaaaauaauuuuucuuaucagauuugcaguauauguccaaugugaaacaaugagaaaauguagagaagcaaaauacagagaagcaaaaacuaaaauuuagaacuauccguaauuucaccacucauagauuauuaguaucacacuacuacuuagucuuccaaaguauuuucaguaguuuuugauguggguguauauuguuuuuuuguauguauguuuuuuuaaaaaacuaaauuaaccauauauuuggggauaauauuuuguacuuuucugguagguggaauuuuauuaauaucuuuaauaucaauaaauacuuacugcaauuaauaacaauuuuaaaauaggauauauaauuuauucccgcuuaucagauauuuugucaguuccuucucauuuuuuggcaguuauaaaccaugcuguaauaaauauccucauagguuaauuucugccuuagacuucuuuaccuagacuauaagucgagguaaacuguuuccauuaccuauuccuagaaauaaaaaaguaaagccuaagacuccagccugaaaauagcuccauggcccucuuacucauucucuagccucacuguccccauuucucuuaggauauggcuuugugcccguuugcugucuuaaaaucugcucacuuuaaaccauuuaucucucuacagucucugggauccagauuggagauccuuuccuuacccugaaugccacauuucuaaucaggauagccugauagugcguuaacuuuuacagggccuugucacacugagucauugagcuugugggcaacccaaucccuuaagucucucauaugaucuucuccauccuauacuugugaguugauuuuuuuuuuucagcccuaagugcaugacuugacaucuauccuuauuaaauuucgaccuuauuaaagucagcuggucauuauauccuuugagauaguaucaggaauagacucuaucauccuucauagucacuaucccuuccaacucccagucacaggcaaauuccagugucaaaugauucagcaaaucccagcaaucauuucuaucucugucuuccuuacuggauuguaaauuuuuugaggccaagaccauauccuauuaauucuccuuaaaaacuaguuccuacuuccauuuugucacaugugacauagcggauacccaggaaauguugccaugugaauauauauuuuuuugauuuaacucuggggaugagggcuugguggugguggguaucacaguggugaagaauauagagaagucuaggcugggucucuugaggagcuuccagugaggaggaagagacaaaaaacuggccagaccauggguaauggauguaguaaagagaaauuuaaauacuccucugaggguacucaguugacuggaggcuugagcuaauucuucagaugcauuucgauguccuccagaaaggcagacaguggaggaauuccuuaguggacaguuggugaaugcccaaggcugugaaaagucagaguugggacuaggggaguggaaaaggagaugauguuugcugggagaguugaccagaaaccagccacccagcuuuugagaauuguguugaauagugauugcauagaauggucuuaucugcuucuuuucugcgagauauagaaaaaagauuacccucucuuuuucuuuuuacauuauugagcuugaggcuugcaaagcuaauaccuacuuaggacugauuacucuuagaucagaggaugaacugaaaccagaauucaagagcucugauuucuucucacucugugaguaccuuuaagccagauucaugguaugaaggcagcagcauagcaccuccauugacccacaugggggccugccuugggcuucaucagcccuuuggagucucagaucccucaccuguuaaaggagaguaauacuacccacuuaccuuuuuggguuguugugaaacacacauaagacaguauuaggagaaguaaggucugagggcugggcuuuggacccagcggccccuagguagaggccuguugaauuggaugacagugaacuuugcagcauuuccuaaccucagaaguucaagagcaggagccugaguguuuuaggucccugguauggcuguggauuuccaggcaugcagcagcucuggggccccugcuuccuacccgccagugguuccagcucuuugauuaacugaaagggaaauuuuucuugaggaagggaaggagguuucuuuguggcccaggucuagccauagggaauuugaacaccuagagcucugucccaguggccuugggaauuuaacagcuucuucauugguggaaccuugguuauuugugaaaagugagcuugcaggguucugagguagacacuuaauugaugucuccugccuccugccugugugcauggugguaucugucacacuuccaucagccacgagaaggugaguuuguauuucuauauagaugcaugcccuugugcaugcuuauuuaaauaacacuuguuugugugaauguauguacauauagucuagugccauauaaugauguuucggucaaugauaaucauauguacaauaguggucacuuuauaauggagcgaaaaauuccuauugucuagugacaucuaaugauccugacucuguguaggccuaggcuaauguguuugcuugugucuuugugugugcguggguuccccaccucccccgcccccucuaggaacagggucuugcucuguugcccaggauggagugugaucaugugauaauagcuuauugcagccuugaacuuguaggcucaagugacccuccugcuucagccucccaaguagcugggacuacuggcaugcaccaccaugccuaauuuuuaaauuuuuuguggagguaggaucuugccauguugcccaggcuggucuugaacuccugggcucaagagauccuuuugccuaggccuccggaguagcugggauuacauugugagccccugugcccaguuaugucuuuguuuuugaaaaguaaaaaauaagaaaagaaaaaaaauuuuaaguagaaagcuuauagaaaaagacauaaaauauuuuuguauagcuguacaguauguuuguguuuuuaagcuaaguguuauuacaaaugagucaaaaguuaaaaauuaaaaaauguguaaaguugcagugagcuaagguuauuuuauaauugaaaaaaaauuaaaaauaaauuuaguguggcauaagaauacacuguuuauaaagucuacaguagcguacaguaauauccuaggccuucacauucacucaccacucacucauugacucgcccagagcaacuuccaguucugcaagcuucauuuaugggaagugcccuaugcagguguaccauuuuaaucuuuuauaccauauuuuuacuguaccuuuucuauguguagcuauguuuagauacacaaauacuuaccauugaguuacaauugccuacaguauucaguauaguaauaugccguacagaucuguauucuagaaacaauaggcuauaacuguaccaaauagccuagauguguaguaggauauaccauguagguuuguguaacugugcucugugauguugauguacgaugacgaaauugacugacaacacauuuuguuaagcaacaugugacugcacauaaacaccugugcauucauaggcaaucacaacugcauauacugaaacacacaaacacaccgccauauauauuuuuaaagaauuugaaagaucuaagaugauauuaaauguaguuuaguuuacuuuuguguugaucaaguguuacuaagcuguaauuaauuuaguaaaggaaauuaaaauggggauguggggaaaaugugacucugccuaauugacaagaaucuggggccguccagaaaagcauuagggccaggcagaaguugaaaccuuugggaagucuggcccaggacuuuaaaaauguuuuuuccggguuagaaauacugaggguuuccauucuaaaggaugaaaaggaucuucuccuuucuccuuagcuagccaguagauucugucuuccucuuauguccuccaguuccuuuuugguucauucacucugagucucgucugaauaagcauuaggggaagggcuuccuggaggauucgagaagggcaaggaagaaguggaaaaaaagaaaucuuaucccacugcugugguucuuugucaucccuggucccuguccuuggcagaaucacacagcuacaaagugguggaauguguauuccaaccagaccucugugucaugcucccuaccaaacucccaacucuuugggcugaucucugcccgcccuccuugucgccuuuccugguucgauuuuuuuuuuuuuuuuuugggugcuuacugugugcuaugcacuguucuggauuccgggguuauagcugugaccaaggcagacguaugcuugacauauguuaaccaugaggcauguauccccuggucccaccaccacucugcuccccaugauuucuauacauauaucuuucuaucacaacaguuacuggguugcauuagaguuaucucuugguguaucugccucucucacuggacugugaaaucuuugagggaggaguuaguuacuuuucuucaucucuccaucacagaacccugccugaaguuggcugcaugcuuguuuaaggcuaauugaacaaaugcuugcaugccuuuuaugacacacaacuaaauugugagcaauccagguaccuaccacuucugugucucaguugguccgacagaacuaguacauaauaggccauguuuuauccuccagcuagacaucuagagaaguaaauaagccuucaagugcuucaucacuaugugugaauugugaagaaaaacuuuuauuaaaacguuaauaugauugugacaauuguuuacucuggcaaguaguuugccucuuggauuccucucugugaaucugcccauaauguccugaaauuccaaauggguccuuuucucuuccucucauuuacuauuucuauucaaaacuggaauauguggacauguguacagccuuuuaagaccaaaggcuuuacguuuucuagcuuuuuguuuuguuuuguuuuugucauugcccuaccuagaacaaacuucaggaaagauagguuuguacaguagugguguaucuuaagguaaaaaugaauucaauuuuuuaaagaaaaaauagggauuuaaaauguuauuugcauuuaagcuuuuagauauuuugcugaauucaaaaaauuauuguaaagugggauacaaauaaucaccuguccuccuuugaagaugcaauuuauuagugauugucuuuaaaucuaaaaaaugugcgucuaugaauauuuauuguauucuaaguuucaguugcaggcauaauccuuaaagcuugugaaugaugcuugaauauauuaaauuuaggauuuauaugaaacuuaauggccuuauggagugcaguaggcuccagcuggaaccuaagcuuuugauucuuauccauucacaaagaaauacagguaaagcagaaauuuaaaaagcagagaaugucuccuugaaauggccaaaugaaucuucucuuuuuacuuuaaaaauuuaccuguaauuuucuuauaggaucuccuuuugaaaagugccuuuuaaaauagcugggcagaauuguaauaccaucuuuuuuuauuuuguuagaaauagucuucuucuuuggaaacaaaaaugguguuagaacauuuguaucuauauguauguauuaaauauagucaauaauacuuuaugggacuugaagaaaaauuuaauucuugggcaguccagcuguaagccaggagucuacuuguucuguuggacaggugaaugaaguagaaauagaauauuaauuuacuuugagagcuaucuaaaaacgucauguuucaacucucuuguuuucagaugaggagacggaggccuagguagggggaaaaaaggaauugcucaguuacauuauuguuguaucuuaucuuaccuagcccaaguuaaaacuucucagagucagacuguguguuuauacaucccuaucuuugcaguucacauaaguccuuaauaaggaugguaugacuaaaaucaaugaaagacuaagcaaaaaaaaaaaaaaguaaucaucucagguccucagauaucuuuuaccugugauauuucuuggugaaugaguaagacucaagaccuuagguuugugcaaggacuuugcuuacugauggagaauucccagacagcucacaagcaaguguguguccucuacuuacaacugucccuugucauuucagcauuaccuguuuggagcuguuccgcauuggguuugcccuaaagcuaaauuuaagucauguuggcagucuuuugugcuuuucaguugcagcucuauauucuggcagcuuacagcuuguggggcucaagucuggaugugccuagcuuaugcaugccuuuuagugucacucuuaccauuugcuugguaauuggagggaaaaaaagaggaaacauuuugcucaguagcaaaucaaaaauucuuuucuccuaugugaaacauaaaccaagaguaaggguggagguguauauagagaagcaucguaagggugauguauuaguccauuuuuacgcugcugauaaaggcauaccugagacuggguaacuuacaaagaaaaagagguuuaauggacucacaguuccaugugguuggggaagccucacagucaugucagaagacaaagggcagcauggcggcaggcuagagagaaugagagccaagcaaaaggggaaaccccuuauauaaaaccgucggaucucaugagacauucacuaccacaagaacaguaugggggaaauugcccccaugauucacuuaucuccaucugggucccucccacaacaugugggaauuaugggagcuacgauucaagaugagauuuggguggguacacagccaaaccauaucagaugguuaaguaauuuauauggcagaaauacauagaauaagaaauacugugcauguaccagcugccuuaaagcauggaaaauggaguaggggaagaaaaucaauuacugccccguaccuucugagcugaccccuaaguauugauaaaaauuuagcaucaauaaauauuuagcagccuugaagaauguuuucuaauuuuagcccaaagaauaggugucugacaaauugaucaaauugcaauuuaaacuucuguuccuguaaagaagaaaauacuccuuugauaucaagagaauuugaagagguggcgugucucagcccuugcaucauguuugacaccugaaucuuagccccgggauaccagaaggcaggcacagaacuuuaacucuguacauguguagauucugcaaaucaccuuguccacauauaggaucucccuuuuucuaguagaggauguggcaagaaucuuccugggacucaucuguaguuggaugcuuuuccuuucaguuucagaugaaaaaaucuuugaauuuucuguauuuacuugccuugcuaaucacuccuuaagacagccuggcaugugggcucugaaaaucagagcaguauuccagccccucccuuuucaucaguuaauuaauuaauucuauauuuauuaaaggugaugugugccaagccagguccuaaagacacacuccaguaagacaagguugcugccuucauggaguuugacacuggggagauagacuuguugaugggcaguuggcagaggugcucugauauaagggcauggugcuguggaaacaggcacagggcaacucagccugacauagguauccaggaaggcuccauggaggaagugauagcucuguugaaaugagaagaugguuggaaagauacaaggggugacucuguguaugugugaagcaucuguuggaauaugagugcuccagcacugagaguuauguuuagguuacacugugaguauaauuugacuuggucugauugcuuugcuuugaggucucauucuuucuaucuaucuaucuaucuaucugucuaucuaucuaucuaucuaucagucaucuaucucugucaucuaucuacaaucuuuuuaauugugauaaaguacacauaaaaguuaccaucuucauuuuuaaguguacaguuuagugguauuaagugcauugacauuguuuugcuaucgucaccaccauccaugcacagaacucuuuuuaucugcaaaacugaaaaugucuauuaaacaagaacucuccauuccuuccuccuccuagcccuugucaaccaccauucuacuuucugugaauuugacuacucuagguaccgcauaugaguggaauccuacuguauuuguccuuuugugaccggcuuaauucacuuagcauaaucuccacaagauguauucuugucaugggugucagaauugccuuccuuuucaaggcuggauaauauucaaggucccauuuuauuaaaaccucaagcauaugugaaauauucacugaucaacacauuaacgagcucucuauucccuuuacugauaagucauucaugcauuugucccucucucccucuguuacugauuacauguuaggugccagacaucgggcuaguugcugcaaauacaaagaacaccuguaucuacuccccaucccaaauauugguccaucagggagagaagcccaaugaauuauuaaacaguauuagugaaagaguaguuguauguauaaaguacugugggacuuaacagguaacacaaacaaaagcuucaugggaaagccaaauaaggcuuuaccaaagagguagcuauugaaucggccucugaaguauuugugggaacuuuguagguggcgaggaaaggcauuucagauaagaggaacagcauaacaguggcuugggagucuugucuguacacauaggcagucuuauguggugguuaucaauuaaacucuggagucagacugucuagauuuaaauccuggcucuuccacuucucugagugaugaggcaauuuauuuucuuaccgugccuuaguuuccucaucucuaaaauaggaauaacaguaguacuuuucucauaguauuguuauggguauuaaaugagucaggacauacaaagugcuuagaacaggguucucuagaaguguuagcuacugugauugauuauugcuaguguaauguuauugcuaguguaauguuugagggaauaucaagucauuuggucuacguaaaauaggauauaauguguguaugugaaaauugucacuagacauaaaguugguguauuagucuguuuucauagugcuaugaagacauaccugaacguggguaauuuauaaagaaaagagguuugucucacaguucugcuugguuagggaggccucaggaaacuuauaaucaugguagaagacaaaacagguacaucuuacauggcggcaggagagagaagugagugccaagcaaagggggaagccccuuauaaaaccaucagaucuugugagaacucauucacuaucacaagaacagcaugaggguaacugcccccugccccgugauucaguugccucccaccaggucacucccacgacacauggggaucaugggaacuacaauucaaggugagauuuggguggggacgcagccaaaccauaucaguuggcgguugccucgguggauccugaugauaaaggauucaaguauccccauaucugugacuucuaagcuuucuucuuguauucaagggcuugaaugucugaacuuguaucugauguuuacuuaaauuuucuuuuuaaaaauauuggaauccuuucuuaaaaauugcaaaaacaauggaacauuaaaaaaaguauaagacagaaaacugcaauaucacuguccuaacuuaguaacuauuuccuuuuuauuuucauuuuguguagcuacaugcauaaaacugguuauaaucauguaauuuugcuuugcuuuuaaaaauucauauucuaugagaaauuuucccuuauguuuuaguucauuuuaauuauucuuguaaaugaaugcccagauuuccuuugcauucauguacuguuuuuuuuaagucauucucuucuucaucauauuauaguugguuuuauaaucuacaucuuucugcucauaauuuuugucuucuaaugaauuuucucuuuuugauaaauuucuaggguuaggauugcuaggucaaaggauuuaagccuuuugaggcucccaauaaagguagcuaauuggaucuucacauccacaccaccagcagcauauuuucuaugucauauucacuagagaugugauuauagucuuuaaagucuugcugauuaagagguuuaaaauaaccccuugaguuugcuugaauuugccauuuuucucccuccuagugaucaugcauauuuucccauaugcuuauucugcucuguaauugucuauucaucuccucuuucugguuguguucuugauauuuuccaauauaaaucuggauuguuuauuuaccuuauuaguucuguguuggagaaaaaugcagguucaggauauuaaagaggaggucaaaaagucuuuuuucccccugccuugcaguagcaaggcucucauccuugcaguugugguucugggaaagcagaaagaagcacaagcuuuugccgugugccagagcuccugggaucacaguggccagagucugggcucuccaacagccuuguuuuucagcugccuugcuuuucagcagaaaaaucauguggcugucuguuaccucagcuuuaauuguguuuacacuuuguuuagagggccuggccugcuccuuaugucccacaagcaccugauacagagccagcacacaguaggcaguuucuuuucacccaccauagaucagagguuggaaugcaccuuucuugacaucuucaucugucuccuguccccuuuacagcaugacuguuuuaagaggucuuguagcuauucuuugauuaccucuagugaugggaggcuuacugucucacaaauacauuuagacuuugaguucaaggugugaugaaccuggguuugaauuucaccuugaccacugacuagugacaugauucuggacaaauaauauuucuaaacuucauuuuauuuaucugaauaacagagauaguaauauuucuaccucuuguaauugugaugaggaugaagugaaauaauaaaaguaaaguucuggacucuaaagaagucaaacucauaaaaaguagaguagaauggugguuaccagagguuuugggggugagaggguggguagggaaaggggagcuugaucaaagugugcaaaguuucucuuaggaggaauaaauucuggugcauaacauggugacuguaguuaauaauaauuaugguauauuucaaaauggcaaaaagaagaauuuaaauguucuuaucacaaagaaaugauaccuauugaaggugauggauauguuaauucaucagauuggaucauuccacaauauauacauguauggaaauaucacauuguaccccaugaacauauacaacuauuauuuaucauucaaaaauaaaacuuuaaaaaaggaaagucuugacuccuacuccucacauagugucaaguaaauauuagcugugaauauuaauuuuauuuacugauacaagguguauuuccuuaaacuuuugccaucuauuagaaucucagugauuuggcaaagaagccauagcucagccuccagcucuuauaaguggccuggaauuuggaguauauucuucuguaauggagaugugggaggguauugucuuugagcugauuccagaguggcccgugguccagcgguggggcugggcagugcuguaauacguccaggcuagcaccuucuugguuuucagagucugauuauagagaccucuuguuuguccuucucuuucuuggcugguguucuugccuuggcaucccugauagaagauagacaaaaacauuuagaagaaaugaaacucugauccacauacuaguuaucuguuccccuccgcagaaaagggcuuaguuuagcaaagagagguaaagguagagaucauacuucuaaauucaaagcaauauaugucgagcuuauugacagcacucaauaaauguugcuuuuauuaauauuacagguaaaccaauacgaggguggccugggcauaggguaggcaggaccuaacucuucucuuauccccagacuuuaguauuucaguauuuuugaugagaaucugauuaaugaucugaaaguuccucaaagucuccugugauuuaagcagauagcuuuuauccuuggggaaccaauauaauuaguauuagaacuagguucaugaaucuuaagauuauggaguucaucuuuguccagcccaucucacuaugcuuuguagagaauaacuuagcagaaacagcccccugcuaggcaucuugguaauugcuuccuaauaacuguuaauuuuugguuucacaacuaaaauauuagggagucuggugaauuuaagaaauaguguugaagugauggcaauugagauuuuaaaaguugccuguaugacaaaugaaacagauuuaaggugggggagaagguuacccaugaacggggugguauugaaaauauuuaacagccaguccagaagggcauuggcacaguagaaacuacacugcaggccccuugauuugccggacaccuauccuuguugaauagugaggagaccuugggacacuacgaaggggacagagcauucacuggggcuuuggagcacugacucuuuacacgcuguuauggaaguauuucaguauuuuaaacaaccaguauaguuguaccagucggguacuggagguggugugggagagugucugaaacuggcagguguucagagguguugauagauucuucacuugucaucuuuaauucauugcugagaaaacuuuaguugcgcuaggccagauuauccccaaaggcguuuggacagugucacauuagaauuuagggcuauuuagaaagcacugagacauguccuuuuuuucagaaaauacuguguauacagugugagaggcgcacagccucugucuucaugagguccccagucuaucgguggccuugaaauuuuucugcucuuugacuguaggcuaggaaucuguccuugagaaaugauuacaaggauguuugcuacaacagugaaaaguugggcaaaaucuaaauguccaagcaugagaaaagagcuaaauaauagcauauccaccccccagaauauuauguaccucuuaaaaaucacagacacagagaaguuuucaggacucaggaacuauuucugacugugaaauguuaggugggcaauaaaaaccuaaagcuguaaggaauaauuaguguaagaaaggacaucaaaaugcauggguagcacugauuauuauuugaugguggaauauggguaaaguuaauuuucuuuguggauguuucuauauguuccacuuuuggucaucuauggguauuaacuuuuauaacuagagguguuccagaaauauuuuuaaaaacccgauuaaaaauuuaaaaauuauuguauaauuagugagugggugaacauguuggauuuaaacuuggagaagcacauuuggagguuguauuuaucucuuguaaagaaagcugcugacucggugggauaaaaauaagaggccuaggucagccuccucgcguugaggcaccuggcucccccaggcuuccagacugcacggguucugagaggcccuaaugggcuuguugaaagguucuacuuggcuucuuauuaaugucccucccugagcugugcucugcucugcuggcuaaccuugucggaagguuaccuguggcucuccagggcucggcuaauuuuaaaccuggucagggagugugguggcauugcucugcagagacaugaacagcucccugggagacacugcuggggaaagaugagucgagucuacgguuuuuucucauccuccuguaagugaccaggcacgcugaacaagcaaagagagcugggauaauaaugagagcuuuuaugguaaaaaccaggauuauuaaagaucuuuuagcagugucaaugcugguugauaauugcacggugugaugugcccugcaugaacugugucaauucuggccacacuaggaguagcaaggugaaugagauccucucuucuggaaacuagacuuuggcugcuuuuaaagacagaaugaaacuacagugaauuucacuacuuauucgguauuauuuuaaauuuucaggacucacacuccacuggugauaaguucuucuaugaaauuuuugaucaauuugauugggagagggcuguuucugaaaagcuaaaaaaaauuuaaaaacacagaaucgcugccugucugcaugucaacugcuggucuggcugccucuaaaauugucauuuuaagggguuuuuuuuuuuuuuuuuggacuguuugcaguggagucuuguucagaauacggcugugucuuauaauacgugcaacccugauauuguaaaaugaaauauaaaucaauaacugcaaaauaaggugacaauugagaaccuuuuccccaucaaaauuaauuguuaaaaaaaaaaacuuagcccauauuuuucugcuuagaauuuuuuuguccaucuaccuuucaccaccuucagguugggaaucuaaaugugccuguuagaguuggcucugucuucuccugccaaggcauucacagcuucuuuugcacguacgggauuacagugggaaacccauuccacccaguggauggccuggucuugaggcuuaccugccuggcuuaaggaagugcaucuuuucuuguagcugggccuguacccacccacucauaaaacaguugcuaggagcaaauuaaagaggcauuguguguggaguaaaccaggaugaaagaacaauggauggagaaucaauacccuccuaacucccuacagugauugaaguuaacuuuauuugaaauauccaggcugggccagagcacaucaagcuagcagcauucuugcacgagaguagcacgggaaugaacuuugauuucauuuuagggaagaagaaaaaauaaugaauaaaugcuuuuuauuagccuuuucccuccccuugaaguccuaccucuucuacauaaaccuaauuagcuucgacauguuuggauuuaguuuugagaaaauuaaagcugaguaauauuaggaauuuguucagugggaauacuuguuaaaaccuucauugacccaaaucugacuuauaaaugguauuaaauaagcaaacuaaagaaaacuucauccccgucuuguccuaaaauaauauuuuuaaaagcauauuuagaguuaaguauaauauaaauauguuacccugauuagguacuaaaugagguacugaagaagcuguaguggcgguauugaguguaguuaugaauuuaauguucuuuucuuaaaaaccaaguccucuuugacacauguucaaaggucuuccuuuuuuuucuucuccugagcugcucuuucucaccucuggggcacuucccuccuacacuuggcccgcaugcgugguuuaggcaggcccacuguuauuuuugugguaaccugacacugggcccagcgcagcccccuggcucuugugggaggugaacuggcugagagccaggcugcguucucccaggaugagcugcugcugaagcaggcugggcugagggcugugggcaggcugcagcaggggcugggaugccacagaccaggcgggcuggggguucaccagugaagaccucagacugugcggcucagcagguggcagguccugccugagguuaaagaaagguggaguugguuguugaggccacagaccagguagucaggguguuuggaaaccugaggaagguuuugaggccagugagucucuuuuaucucacucugugguucuagucuaagguaugccugaggcuguccuuguaauuccuuagacaaggaugaauuucuuaagaaucaucaaaauuguauucacauuuuaaguuaaaauaaagcaaaugguuauuuguugagcugggcuagggggcuggaguggggugcagaaaugaaugggaaauagugccuaccuuugaaaauuugcaguauagcagggaagaagguggauauauuagcaguaauuauuauuauuuuuuaauuuuuaaaauuuuuguuuuuuauuuauuuuuugagacgaugucuugcuaugucauccaggcuggagugcaguggcacaaucuuggcucacugcaacucugccucccggguucaagugauaauccugccucagccuccugaguagcugggauuauaggcacccgccaccacacccaucuaauuuuuuguauuuuuaguagagaugugguuucacuauuuuggcaaggcuggucuugaacuccugaccucaagugaucugccugccuaggucucucagagugcuaggauuacaggcgugagccaccacgccuggccuauuaguuuuguugucagcuauuugagaaccuacggugugucuggcacaguuaagacauacuacccaugcucaucucuaagcauuuagauaauauaugcauugacuguugauugagauauucuguuaauacuuucauggaucaucucauuuaaucuuuacaucagguggcuaauaauguuccaguuuucaugaaaagaaauguaggcacagguaguaaguggaggaaucaaaauucaaacucuuugggauucuaaaacucaguauucucuuuauguauauauaacugcucugccauauggauucuccagauguccaaggugaucccugcaauuuuuuuuuuuuugagacagagucuugcucuguugcccaggcuggagugcaguggcgcgauccuggcucacugcaaccuccaccuccuggguucaagugauucuccugcuucagccucccaaguagcugggacuacaggcacccgucaccacgcccggcuaauuuuuguauucuuaguagugaugagguuucaccauauuggccaggcuggucucaaacuccugaccucaggugaugcacccgccucugccucccaaagugcugggauuacaggcgugagccgcugcgccuggucuaaucccugcaauucuuagaaauaccuaccaaggacaauaucagcaaaaguuuuuugaguuccaacaaucugucagguauugggagagccccaggcaccugaaggaguggaguagguggccggcuguguccaggcaucuuggagugcgugugcagcuagaauguugggguucuggauggguggcuggaggagcaggcugagaacaggugugaaaggccaggggucucauaaugcacuucaguccugagugaguggggaucugcugaaugacuucaagugaguguaugaugaaaguccuauuugcauuuuaggaaaaccuuucugacugcgggauaguguaggagacacucgcuaaaaauaugucuccugggauucugauucaggauuucuggcauaaagcugggaaucucuauguuuaagaagccacccauaucaucucguauaaccaggcuuggggacuagguuguuggcaguggcgagaguguggggaggcgggggacagcucagcucuggcagagggcugaggcagaaauggugcgguccuuuccuugagacaggagcaaaguuagugggguagagaggagcagaggggauccaggggaggcagggggacugggggucaaauggacguucuuggugaucauuuagaucaggaggggaggaggggaaccuaggauaauggcccuccuuuuggguuaugcuccagccaguuuaccugagaaacaucaucucugagaggaggcggugggauucucccaggaccugggaauccuuuuggauuuucauggggacuuuuacagauagauccuuaaucagcaaugugauguugauggugucagggcccacugugccagaacugugugugugugaggauuugcgcugguuuguuuugccugugggggacuuuuggcuucugaagucacauccccuacguagagucaccuuuaggcaguuggauugagagggaaucugcaccuggaagucucccugagagggagggcuuuaguggccauuuguacguguaauuggaaauggauuacauuuuaauuaaucuaaggggcugagagcucaucuuguuccucuaccaggguuaacagaaucuguagaaggauguagucuuggaaggaaauauauucccccugccugacacuccguccaccuuuuucccuaaagaaauuugugugugugugcuggggacccguagaaaauguggauuuaaucaagguguggccuuugcauauuuuacugaauucagcagacucauuuugcugggguuugucagaggggagggggaggagacugcuggcuggagagggcucacagcacccugggccauggggaagugaaggcaggagaaggcgcaggccugaugucagacaugagcgcaucagacuuucuguccguaccucucuuggacugggcgucuugcccccacugaaugcccuuacagugcuuguggacggcuuagaguggucuugugcccacagcaggugcuccaguaauauuuguucauuugaaugagugguuuaauugaggggggaacaguaguuacucacuuauccugccucagccugucuucagcuaaggugccaagauucuuucucuugcugaacuugaacuggauguaaaccaaggaccagguuuacauuuugaggauugggauggggugcggguggggcuuuaauuggccccugaauuugcaucucaaugugagagaccuguuuugcaucugcuccaucaccaugucaucauuaaauggaagauuauauuugucguuuaaaggguggggacuugcuuguguuggugaucauugggacccaguugacauuugugaaccggcaguguugcgugcuuuugguuaaauucaugcauuagcucgugucggcauuaguugguguuuucacauuggccaaaugcagacgcaugucucuguauaagcauagcagccugguucccauguugggcucgagugugacccuguugucagcucacagccucucuuuagggaugaggggaguauguugagugcuugaagacagucugaugagcauucauuagaauggcugagugaucagguaccgagcagaguuaaucccauggcucuggguuguuuaaacaaacacaccuuuauaaacuuggaacacugaagggagacgucacauuguaguauuucaguuuaucuagagaacuguccuggccuuggaccauacugaaaauacuuuugauuuaaaaguucagauuccagauauauaacauucucuguucuucacccuuuaucuucccaaguagacagacagacagacagacacacacacguacaccuucaggaguugcucacacacuccugguguuucugguguuuucgugcuuuuuguaugaaacaguccaccuuucgucauggccuaugaggcccccugugauugacucagcuuacauuuucagccucugcucuagccuuucuacuuucuugcuuggcucucucuuccccacaucuccuccacuaauacuuggccugugagucuggauuagccuuucagaccagccuaaaugccaccucccugagaaacucucauugauccgagagacagaauaaacuccuccaucagcacccuauugauuccuccauugcaucaggugacauauuuauucaccuguucauauucacccauugacucauuauuuccggcaaccauucaguccuguuuuuuggggagcaguugccaugugcuaggcauucugcugaaugccaaacauagaaaaaugacugggcugggugaggugguucaugccuguagucccagcacuucgggaagcugaggcaggagaaucgcuugaggccagcaguuugaaaugagccugggcaacauagugaggccaaaaaaccgaaauaauuagcugggcaugguagcaugugccuguagucccagcuacuugggaggcugaggcaggaggauggcuugagcccuggaggcugaggcugcagugagcugugaucaugccacuguauguacuccaaccugacucaaaaaaaaaaaaaaaaaaggaaaaauuacuaaaggcaugggcccaaaccuuaaagaucucacaaauccucaaaggugagagacgcauaaacaaaucauuccuaugcggugagugaguucaguucauuuguacuggcuggcaaaggugcuaccugugggaacacagaggaguggggaaaggccaggucaggcuucccaguggaggggcuugaagucuugcagguauguguacuuauuugucucgcugcuggagagggugcuuguugaggacagggaaugugguaucuuuaucuccauauccagugcuugggacauauggcugaagggacaggggugggaggggcucucaguaaaugcuuuuaccacauuaaauugaaacagauaauuagaaaacagaaacuuucccuuucauauuuauacccuaucauguuucagaaucauuuuaaggcagcaugcaagacuguaaaauagcauaaauagaaggugggagaaagaauggagaaaaagaagaggauagaggugaagacuaaauguggacuuaggaaugaaaccaaacuugccgaccaaaaccaccucugagcacucucugaggggccugccaguguggcucagugcacuuugguggcuacugaguaaaggaaaggccaauggcuugaccacgagguaaaaaacacauuguguuuuguuugcuguagaacuuuccuuugggaucuuuguaaagaucagucugugugacgugaugagcagcgucuuccacauccuugcauucacucuagagacaaaucccauuggcuguuucuucuaauaacccuucauaugcugauggcagcacaucaaagcauaauucaaaaaaggcaaauguauucagagcuccuggaauaaucuuucucuaagguaacuggaaucagaaaggcacugaaacagggcaguuuuuuuuuuuuuuuuuuuucauuucuuucuuuuuuuuuaaaauaauuuuuauugaaguccaacuuacauacagaaaagggcacacacaucaucaauauugagucccuuguguuuuuccauuugaaugcauuggcauccagagccauugaucuauugaucugcacugacaugaccagaaccuccuaagccuccccacgcugccuuccagucaguacucccaacccuaaagggugguugcuacccugacuucuaauaacguagaugaauuucguuaguguuugaacuugguaugaacggacgcagacaguauaguauauauuucuuuguaucuuuuuuuuccucaauauugcguugguacaauucacccauguuguuacuugcaguugucauuuauuuauauucuauugcugucccauagaacuuucuguggcugugaaaugauuuuugucugugcuguaugacacaguagccauuagccacuugugaauauugagcucaugagauacaaguagugugacugaacaacugaauuuuuaaucuuauuaauuuacauuuaaauucacaaaugugucuagugccuacugcauuggacaguacagcuguauaccauucuauuuuaugaauaugcuacaguuuuuuuuuuuuuaagacagugucucacacucucucaggccagagugcgguggcgugaucacagcucacuacagcuugaccgccugggcucaggugauccuccuacuucagccucugggguagcugggacuacaggcaugcgccaccaacacccagcuaauuuuuuuuuuuuuuuuuuguagagauagggucucacuauguugcccaggcugcucucaacuccugcgcugaagcaaucugcccaucucggccucccaaagugcuggaauuacagauguguuccacagcgcccagccugauuauacuauaguuuauauguccuauuguuaauaaaaauuuggcuguuucugucuguuacaaacaaugaaaauauaaacauuccuauaccugucuuuuggugaacauaggcaugcauuucuuuagcaucucuaccugggauuuggaauugcugaaucaggagguaugcauauaaucaguuuugguauguagauauugccaaagaguuuuccagaaugauuguaccaauuugcgcucucaucaguucuuugagaauuccauuuacuccaucuccuugaaaauccuuaguauuagucucuuuacuguagcucuucuaguggcuggauagagguaucacauuguuuuaauuugcauuucuuuaauaacuaggcauguugaacaccuuuucauauguuuaugggccauuugguuauguuucauaaaauacauuagcuuuuuacuuuuuuuucuauuggguugucugauuucuuauuguuuggaguuccuguaggaugaaggauaugagucucuguugaauaaauguguugcaaguaucuacuuuguggccugcuuugauuuucuuaaugguucuuucaagaaagcgaguucugaguugugauuugguccaguuuaucauguuuuucccuccugauuagugcuuuuguguuccuuuaaaguauccucgacuacuuuauggccauguagguaaucugcuaagaauccuuauaaauucuuuacugguuuuuuuacuuucagaucuaaagucuauuucagauggauuguaaacuauugugugugguggggucaauuuuuauuuuuuucguauggcuaucaaucaaccuggcucauguaucaggaaaaaaauuucuuuacucaggguaaugcagugucacuuuuguuacaaaucaagugaacguauguguaugaguuuguuucuagauucucuaaucugauuccuuggccuauuuucauuaucuuugugccaguacuauacuauuaaugacuaagcuuugcauugagguuucauauugggcaguuuaagucguucagcuuugauuuucuuccucaagauugcacaagagcugcauuuauucaaacagguucauuuuauuuguuguuuuauguugucucacuuuuauccagcaucccaauguuauuugacacuguccuagguuguagaggucacacaggcucugccucugccucugccccggaggaguuuuaugaucauguuuugggacuuagaaauauccaugugugauuuggguaugcuuugaggaucuguaugcucagauccauuagaaauggguaaaggcagaccagaucugacacccacacaagagaaagugacagccugauuucugauagucuagagacuaucagacuucugccuguuacaaacaaugaaaauauaaacagugggaaggcaaacaaugugaugaauugugguuuugguuccuuagguugacaggaaagaguuuuuuccuuuugggcauguuagagccuagauuuuggauccugaugugagugcugaugaaauccauuuggauccauuagauccugagagcacugaaugucaggagcugugguugaaggaccagagcagggcuuggccuucgcaguuuagcucuuuaaaaugccauccugauucagguuuuccuuguugauuggcuuaugacucaaucaggagugaaguguggauuucccuauugcuucucuccccaacccccagaaugccugucucaauaauuuaggauagauggggcauggccagaaugagagaagcauccaaagucauagaagcugguggagaaggcccuggacuacuuuuguaugcaaaguagggagggccguuucugaugcagcacaauuagaauucugaaucagccaagggggccgcaucugggcagauugcugcugggaccuggagugaggccagugccaacauaucauuuaaguuggcugucaacagacuguguaacauugggugagucucaccuggccuuuaguaagcagggaugacucuccaggcauuuaccuauagacuucccucuuagggagccauuucuaaugguauaagacccauuucuaggcauuccaucagucaugcagcugaggggacuucuugaaaugguguauauacuuauauuuaucuuguauguuaaugucuuuuuacuucuacuuuugauuuuuacuuuaugcucauugucauuuaaaauaccgaguuauaauaaucggauggugaaucguaccaacuaagaaagugaugugauccauagguuaguggcuaaggaguguuguuuuccugguguuuucuuuauuuuuaguaagcauuaugguugguuagucuaccccaaguguauguugacuccacaggcuacuggaauuggggaguuagucuuaagguuuucuuugacuguuacuccugggaaaaggcuuaugaguuuuccuuuugaaauacugacagcuccuuacugcuaacaguugggacguuugcucucuuaaagcaggaaagaagcuucuguuucugggguugaaauguguuucccgagguuaaguuguccauuucccagggugggagugacuugggcuacgagucauguccucugguucacgcucacuuugggcaugcacugucuugguaucaggucuuugcuuuggaauggucagauaggauagauugccugaaacugggucuguggccuuguccuuuugaaggaguccacugauaaagaacaacaaugaucagcuugacuggugguagugacgggagaaaggaaggggcaggauuucuguucucaauggcuaacagauucauuaaggggauggggugggcuauuccccuaaaggcugguaaugcagaguggucccaucagagcugcauagcaugaaaucaaucagagcuuuucuugagcugucaccugggcaaguacuuagggcugauggagcggagaauuaaucagggauucucaggaggguaaugcuaaguccucuaaugggaugcuuagcauuggggcuuggugaagagauauuggcuuguugaugggauucuguugacacggaagugauuuuugaaaacgagaaggaguaauuauccacuccucccugcugaaauuagagggaaccuguuggcauuggcaccaaggcucacuggcugcugcugucguuguggcacauguugccucaguucucagcaucagcauucccauucccugagaauucugcccugucucugacaaugacauacuuucugugcuuccaucucuucugugguugccuacaaaauccaggcugccaaucuucacuuguauuuuucucaggccacuuguuagcaagguuggcuagugucuuaaaugguaggaaaauaauaacacaacccacuuuacauaugcaaaagcaauuaaccauuauuagugucugacauuccucucagcugcccacagcggugagucaggaucaucacuauucauuaggaauuaauuagacuguccuugaugauaucagucaucuacagagcuaagaauucagcacugccuacauccuacugucuagugaggguauaguguauuugauauucccauagaaugugcauucuguuuggaaaaugacuccuagauugaaucucuguuaaguauaggacuuuggacaacuuauuuaggucucugaaccucacaagguggggauaauacuaaagggggaagugcagcgauuaaauaagauccucuaggcagaaacugcuggcauuaugccugacaccuaguucugggagaaggcugaauuugguuuugagguaccaguucacuuuggaaguaaagcaccuuuuuuccccccagucuuuuuguuggaggggagcuuuucuccuaugagagaaauuuggacuuugacuaagauuacagugaccuucaagccaucaaauguuugguugaguuguccacuauaaauaccauuccaaccaugugauucucuuucuagaaacccugaaguggcccucacuucuacugacuucucucuccuccugggcuauuagaaaucuuuucucuuagugcucgucccguugccacugucuguaugcugcccuuugcucaccugcucacucaaguuugcuuuaccauuugucaccucuucgaauuucuuccuuggccaccuccuuggcuucuggucuuuacacccuggcugcuccgccucccauaucucuuucccuguagcugucaccuuuugguaauuuucuucuccagucaucaaaagggaaagggaaauggagaagguaaaauauauugucucaaaaguuaccauucuccucaaaauaagauuuacugaugauaaaagauuaccucuuaaaggacucaaaucuuauuugucccucuaacacagaaggacuauuaguugccaauaauugugauuaagaaauuggaucagccacccaacucuucguuauuuacacugugccuggcuuacagucugucuccuuguguccuccuaauuuggcgauuuucucugggucucuuacuacucauuggaaccuuggccagagucaggaaugugaaaguagcugaaacacuuccuuuucuuguggaaacuuuggguguuaaucucagucauguuguuaucaaagaauauuuguguuuucugguuguugguucauucuuuuuuuauuuuuuauuuauuaauuuuuuugagacagagucuuguucugucacucagacuggagugcaguggccugaucuuggcucacugcuaucucugccucccaaauucaagugauucgucugucucagccucccaaguagcugggauuacaggcgccugccaccacgccugacuaauuuuuguauuuuuaguagagacggaguuucacuguguugaucaggcuggucuugaacuccugaccucaggugauccucccaccuuggccucccaaagugcuaggcauuauaggcgugaacugccaugccuggagguucauucuuucuuucauugacuauuuauaugucagguaugguacuggcgcuagggacaguguaaauguuacauagucucugcccucagggagggacacuggggugcaaaugggaggagcaaugacaaaccaacucacuaaguuuuuguuuuguuuuuuuuuuuuuaauuuuuuuuuugugauggagucucacucuguugcccaggcuggagugcaguggcacaaucuuggcucacugugaccuccgccuccuggguuugaguaauccuccugccucagccuccugagcagcugguuauaggcaccugucaucacgcccagcuaguuuuuuuuuuuuuuuuuuuuuuugagguggaguaucacucugucgccuaggcuggagugcaguggcgcaaucucagcuuacugcaagcuccaccucccagguucacgccauucucccaccucagccuccugaguagcugggacuacaggcgccugccaccacgccuggcuaauuuuguuuuuguguuuuuaguagagacgggguuucaucacguuagccaggauggucuugaucuccugaccucgugaucugcccgccucggccucccaaagugcugggauuacaggcgugggccacccuaccuggccauuuuuuuaaauagaggcaagguuucaccauguuggccaggcuggucucaaacuccugaccucaaaugauccaccugccucagccucccaaagugcugggauuagaggccucaccucaucaaguucuguuauagguaaagucugugggaucacauggugaagaaugaauaaguuggcuuccuccaggguuaaugguggaaacugaggcauacuggagcuacaggugcugugugguccuguguuacucagggggacagagcccuaacuucaucccagcucuucuccugugaccucauagaauauugagacacuggcaaaaacaagccauaaugauuuuuuuuuuuggugaucguuguguucaauggcauuucauuaauuaugaggauuaguuaaaaucaacccuuuuacuuaagagccuuuaaauaaucugaagaugggugagaaacugacauuaugagagacccacaggaauuaagaugaagggagcagcaaauuccuguguccuaucucaucucuuguuggauagaguuggugucagagcaccugcauuggacugucuuaucccggucaucccccaggcuuuuauaauaaaauguguauugguugaauacacaugugauaucuccacuguacucauguuacucuuuuugaagccucaguagguuauagugaaggaauuacacauuuagggaaugugguuguugaggcaguuaccaggauauuuggauucauagaguuuguuuuuggaguuuauuggaguguguuugggaaaaaguucaggaauaaaggaucuuucagaaaaguguuuaugauggaaacugaggcacaugggggcuacaaaguauacauauuuuuaaaaguauuuccagcugggcgcgguggcucacgccuguaaucccagcacuuugggaguccaaggugggcggauuaugaggucaggaguucgagaccagccuggccaacauggugaaacccugucucuacuaaaaaauacaaaaauuagcugagcgugguggugaaugccuguaaucccagcuacuuggaaggcugaggcaggagaauugcuugaaccugggaggaggagguugcagugagcugagaucgugccacugcacuccagccugggcaauagagugagacuccaucucaaaagcaaaaaaaauuaucuccaacaaagaagacuuuucuauucucuuuccuugaaggcauucugugaaaacgguuacuacccugaaccacacugcccauaagaaucugaaagcuguugaacccgugaauaaauucagaauuagaugaguguuagaaauaaagguguugucaccaauuuacauuuucuaugcagucauuugaagaccuugaagaagagguccuuuguaaaucaguuucccaaaguaaaccauuagaggaagcucucucauuucuucaccauccaucagaagguacauagcauugucuagagaggauggacuuggacauaaaugaacaucuguucauaguuuuacagaugacagagcgccuucacucaugaucuuacuaaaucuuuauggcaacccaguagaauagagucccuccaucccuuaaucauuuuucuguauugggaugaaauuuaauuuguuauuugcauuuaacaaaugaaaaccugagcuucugagagaguuauuagguuggcacaaaaguaguugcgguaguuugaguuccauggcuuaagggcgaguagguuugaaacccacaucuguuggagucuucauauauuccccucccuuccucuccuaccucuugccccaguacuguguucuuuauuuacugaauuuagugaaagcugacuccuucacuuaaaggauauauauguauggggagguaaagauaucagcucugcagguacagacauugugugcauaauucacucauuuagauuuuaauauugauuauaaucaagugcuuguugcuauagauucagaaucgagguaauuugcgugacaguuggccaauuccacacauuuuuaggguucuccuacagcgugguugauacucucagagccuguagauacaaggccaguuuccaggaugagguggaguuugagcuggacuggaaggaaccugggggauggagugccaggaugguuauuuugguauccaguauggggagcauuucucagccagccccagucuuguguuaggaaauucucugcccauauguaaagucuucaucuuaugaugggguuguaaaaccagaggccuguauaacucuguggauuauguaucugguaguuucuggggcuguguccuggcccauugcuagauagguaauuccauccugcugaagucuaguugacgaaaaauggcaagagucuggauacacagggucuuuuccuuugcaguaaacgaauaaaaacgugagcauuuaaaacuggcuguacuuacuaaguggauagaucaauuaaugcuaguuaauacuacauucccccaaacaaccaggaaguugugauucauaccuauagaaauaauaagaagagguugucugcaagacucugcugccugucugcuagaacagccugccccuuguggagcaguucaaguagcagaaauuuuuuucuuauauugaguuggaauauucuuuggaacuucccaaaguggaucuacauccuucccaugugacagacagcucuucagagguuguuuagugucuuagacacuaagugugcaguuaugauucagaagaaucuucccaucuuugggcugugggcugaggcuaaaaaugauagaauucaauaggaauaaauacaaacgccugcuuuuagcucugacaccaguugcacaaaagacaguauucagggacaaccucugaggggcaggagcuuagaaguuuaauggaaaguaaguccaccucugagugccauuuauugggggccacuaaaugcauucaugagggugggcagagggaugaugguuucuagucuggaagacaauuaggauccuggaggcugcuucugucauaccuaaauggguaucuuaggagagauuugcuccccugaaggaugggguauacucucaaggaauggauguguagauguuaaccaggagauggguuuucgccugauaaauggaagcauuucaacaugucaguaugaagcgggguaguacugagaagguaaugaguucccugcuguuagugguguucaaggguagacugugaccaguugaguagauuuugaggggacuuuaagcacugaaugggggugguugguguguuuuggucuggagacucuggggcuuacaguuauaugagaacauucuuuuaaggcagucgaaggucccucagucccuucagccaucccccacuguccuagaucccauucccugcuauccugacugagcacugggcauaacuacuauuuaucuuaaaguguggcuccucggaguaaauucauacugcugugaacugcccagagcucaaggacuggccugugguuuugugcauguguguuguuuugguuuguuuuugucuuuuuuuguuguuguuugguggguaugguggagaggaagaaggugggcuagccacugcucaaagaauucauucuuauucucauaauuuaucuaauaaacuacuuuggagcgagaacagacucuagaguauaguucaguuugaauuucauaagacucuuagaucguaacgaaaaagauaauaguuugaauucaaaaggcccacaccgcaggcauagucaaguucaucuggaggucagucacaaaaugcuuucuuguggcguaauuuauaccuucacauuuggcaauuuugaaaguccuguguaaauguacauauguugguaagagguaguaaauauuuugcugacaaguucuuugaaugauggcucaguagcagcauuuaaaggcagacaaucagaggguuuuuuguguauuuuuuuuuuaaauccaggugcugccaagucuacaaagcuggaagggaagaagccaaaagugcccacuaguuauaguuauaccauuaauuauauaauauucaugugccucagaguuucugcaccuggcaucuguugauauacacaggugggggaggacaggggcacaggauacaguugggagagagcagggaggaagacagggugcuugcugucagguaacggcccuggaauauggagcagucccuggugccagguguggccaccagcaccugcuucccuccuggguguccguguuguaauacugccuggauuugauggggugagaaggggaggaacuguggccacaugaaacccucccuacucaggcccuuggccuccucuuuucgaucaauccuuucucucucauuuuugggaggccuuugaauuaaugauccuauaccuuuucaacaaaggaauauugauauguuagugugccagacagcagggaguacuggauuagaucauuuucacauugacguuaugccaguuugacauuuguuuggaaagcuuauccuuuuaugaccauagguuauauacauaauuuaaggggaauaaaucuuucagagauuuuuuuugguucugugaucuucagugcuacagaaaaagaaaugaaauacucccccacaguuuucaugugaucaggaauucagcauaggcuauaagacggagugcuccaugucaauagagaauauuuccacaggugugcuaggcacuugugguagauguugcagggaagucaggacuggggacagcuuggucccuacuucaagguuacagucuaggagcugagaguggcaaagugaccugauucuacaggguaaaagccccagagauaaaugacauagguccaggucagccagcauugcugucucaguagaaugaguaugugugauaccaaaauaaucuuccuccuucccuccuugauccugccaccaucuugcaucuugaugaucucauauugggauagugacacuaacagaguuuccgaguuaugaugccacuugccauggugaaguggacauuuuaaaaaacuuuauuuucuuauaaauuacuuguucugcuuuggagauuugaugaucauuuagcaaagugccccugguagauaguaggcacucaguaaaugguuuucguaugaaucacugcaaacuugcaacuccgagugaguaccauucuuccauauaaauuuccucucgucugugaagauuauccagcuucugcccaccauugcauuucugugugggugcuuaauaugauacuuagauaauaaagccacuuggaucucaaaauuccauauucuccaguaggaguuauccaagcaaagcuggugacugaaccaaaaucaccacuaaagaacuuaaccguguaacccaaaaccauguguauccccaaaaagacugaaauaauaaaaugaaaugaaaaaagcuggugacugaagaacuugcacuagagcuagcaagagcauuauguuugugguuaccacauccuuauacuguuuuugguuuucucuucuagguuuauuuucuugaaaaggcuccaggcuucggcuuggaaaaucccaccgccaaaauugagcccagcagcuggagcggcagugagagcccugccgaaaacauggaaaggaugagugacucugcagauaagccaauugacaaugaugcagaaggggucuggagccccgacaucgagcaaagcuuucaggaggcccuggcuaucuauccaccaugugggaggaggaaaaucaucuuaucagacgaaggcaaaauguaugguaaguggccuggaacacuccuuugaaauacuacaaccugcaguugugguaggggauagauuguagcuggucuuccagcaagagcuguucauuguaugggguugagugauauuuguagaauuuuagugggucauccaaaggacucacccuaaacuaaaaaggagagucaauaaaggaccuuugggaaaaagaaaaggaccccugggcuuuucuucuucuacauguguaguggcauuacaucagaagcuccagggguccaggcaggaacauaaauaguugcaguggcauguacagacaccagaugguggggaggaggucuucugaacacagaccagaucacaaggaaauacugccacuuaccucuagguaacugaugucacuaggaaugggggccuggugcucccgaaucccuugauugcccccagcccccuugaggaagagccagcauucuagaugcuuauaugaaaucuacucuuuuuaaaaagccagcacuuuuuuuuuuuuaaaacaacucuguacaggccagagaaaacauguaugugcaugggcuugaucagccucugaaccaccaauuugcuacuuugcugccaguuugcaguugaauggucagacaaggcauuagcacccugggucacugucaccaucuccccuucuuuggggguugccuugaaaggcauucugaaggaaacaccaagagugccaaggagagagagaccuguuaacuauuuggcucuggaugccuagggcagcagcaaggauccaccugccggucuggggcuugcuugcuggguuugggcacccccuaacuuccuuccauaaaugcuuccagcugcagaccuguacuuuuuggcugcuuaccuuuugggaagcagauggcagguguaguugcuugaacauucugcuugucuaauugagcacguugaguugacagaguucgcacuguagcugagucuaaaaagaugcaaacacaaauaaccuaaccucaaagagaacuggcucaguauuuuaccugagguuguuaacuucucaugggagugauuauuucugaacaauuggaagucuuuuuuguaauaagguguuguaccuuuaauacugcacuuccucugucaggagccguaggagacuguggcuucaacuagcacacacugcuaaggagaaagcagaugguggugcagcugccaccagcugugcccccaccccgcccuccuccucuccaacuuggaugauguaauggaaacaaggaaaauuuugcuuucugcagcauuggagucucucagccugucacacacaggggagaaggagacccaggccuucagcauuuguuuuaugcucccauaauauccuuuguagccagggaagccucuucguaucuggugaaauggacuggggaugaaauaucucagcuacuaugggaagaguguuucagggcccuagauuuucucuaugucuggaucuuuccuggucucuucaucucagccuggcuauuugcuuugugggucuuauuuucauaccugaaaaugcagcucccuuucuuaaaggcagagaaaagcauuuuaaucuuugaagcuucuuugaagaugauuuuauuauggguagugaaggguagccuugggacacuaccuuguacaacucucauuugcuuacccaaaaaugguuucaauuuaaaacaaaggcauaguauuagaaaucccaauggggcauaaccacugcacuucauuucccacaggaaauacugggaaagguccuguccuuucaggaauaagguuuuggggcugagaacauaauucaaagcacaaguuaacuuuugucaacuccaauuuuguauuguucuccauugagauuuuaguuuauagacagcagcccugguggauuuaaccaauuugccuauaauucaauuauauaaauauuuuuaugugaaaauaauuguauaagagcucuuguugguaauugggucucagaggcagcaggcuaagaagaacaaagagaagcuuuggaugugaguagcuguaucaacaaugaacuugaagauuuuacccuuggucuuggucucaguuuucuucuguguaaaauaagauaguaaaguaguugaugauguccauggguccuuuggacucuuccauuuugugaugcuaugguuuuguuucuugucacugagcaagagggucaguuuugacaaauguggugcugcuugggagccuagccugucuuggguacccaguguaacuuaaauucugagugcuuccugagugugcaugguuuugauguauggauucuuuucuccuuaacucagcagcacauuuagugaccguguugguggcuaaccugauuuaaaaugggacaguccuuuugagcaagcagcauuaggaauuuuaacucauuuggaagaacaaucuuacugguuguggguuuuucagcaaguggaguauacagccugggagaguguguauccuaauuggggcucagaagaugcguuggaugcacuguccugcagccacccccaccuccaggcagcugccuuggggaggaaacauccccccugaacucccugucucuggucgacaugaggagcuuugcuucuacugcuaccuuggaagggaaccauggugguuaaugggacuauuggugguggagacuggaccccuuaagaggaacugcccugguugacugggagcugccucugaccugccugugacuuggaggaugagagacaguugacuugggagucucccuguugaggccccagccacucgagaacugaaucauaugagcaguguggggccagagcuacuguccugggcuuuuggccuguuccccaucuuaccauacaugaauugggacacaaaccagaccaggagucaggguuucuuaaggccuuaaagagcauacuuuuuuucuaaggguucugaaaaugaaaacauuuaaagcauuuuugaauuccaugcaguaaaauaaaaacgguuuagucuuuuagugaaauaccgaguguuuuuuacuugaaaggguuaugguuauuccaauauuucagagcauuuguagagugcuuugugaugucacuaauccugagccauuggagaaacaaggucaagugauuuauuuugguaaugaaauuuuguucgugguuggcaguagggcaaaugcagucuuauaaaggagaaaaaaggacaacucuaugaugagguuuuuggccaccggaggagguggcuucauucgcuuucugcuaacuuggucuuuggggagcugagacuuuauguguuugggcuguguguggauagguggcuucugcugugggcacccuuauguguaggcagucguuuuuauggauuacuagaagggguacgagauguccuuugaccugguuccuaagggcaugugugcucagucccuggggcucucucuuucucugugcuugucuuuuucauuuuuuguuuuuacacagcuacgugugacucuuuuccugguagaucaugggagaggagauagauagcaggaggacaagaugagagggaaguucuugaucaacaaacuuauccagaauuggauuucagaggagcaggcuguaguuuaaaacaaaacaaaauagauagcaaaccacgggaacaccugaauuuguuacuuuugcaacugaaaaucccagucagauagaccccauaaucaaauagggcagggacaggaacuaaccuucacugguugcuugcuguagaggcagagaaguauauaacacuuaacagucuggacucuauaaauaauaugaauccuggcccugcacuucuagauaucagauuuuuaucgaguuaccuuacuucucugucucaauuuccucaacugaaaaggaggauuagauagaucuuacuguguaggauuauuagaagaauuaaaugaacuaauuguuaucuggaacaccaccacccccugcaauguuugaacuguaucuagcauauagugagagguauguaagugcuuaugaacugaaaacaaagaagugcucucugccaagcacuaugcuaaaggcuccacauacaauucugucuaaugcucuuaacaaugcuuugaagcugguauuaucauccucacuguauagacaggaagcugagucugagagggguaaaauggcuugcacauggccaauauaaaugguauagcuagcagguuucaaauucagggcugucugacucuacaucuuggacuuuucuacugagcuuuuguuccuuccuugguagagaccguuauacauaaauccagugaaucaguauugagccccagcgcagcuguauuccagcccugugcuagggguugucagggauacuguagugaaccagacagacauggucccugcccucauggagcuaucucaaguucauuugcaggaaacugaccugaggucaggacugugugccaaagcuuucugagaaguuugagagcccuuugaagauggucaccuuccacuuagccuuuugaagccuauucuuggcuaccaaggucgagggcaccuggccuguugcuggcaggaagaaaucaucucaaauaacauagcggagaggaucccagaucacaagccuggccucgguaguggccaggaggaugucuggaagauucuagugcccuaggauccuauaagcagucugggcagagcuguugcuuccagacaucuuccuggccacuauugacuuucuccuuuugcaagcagaugucuucaggauccuugcuuaggucagcuccaaggaaggacccuuucuuacugggauaccaggacuacuggucagccccagagaccugaauugugaggaccagcgaagaugagggggagggugucucuagucaguccucccccgcugcugaccugugcccugcccaccaggacagcauaggacuuaggauugcaucuuucuuuacuucauaggagcagaagucagaagaggaaagagggcuuuuuaaaugagguaguggcagaacugacaaggggguaucagaaugagagugcacacaaguaagugggaguauguauugauuagucaguacagcaaagagacugaaaccuguggucgcuacacuccucuggaugcagaggacuggucaaaaaauugcagaaucauccuuuuauaagauaguauguucucauaacagcucuuugaggaucagggagguaggcuuugucaguggaggccccagagcccugguguggaaauggccauagacucccagcccuggagggucuccaggccuuggcaaaguguucuucucggagcuccauaugaacaucauguggcaucuuugauuuccucuuucggaccucugauucaggguguuauuucaaguuaauugguuagaagcgugaaacaaacagcuaugugguagaacaggcuagaagcucccaaagccgggaccccaccgaucacaggauguauuucaaggccuggaauauagaaggugucaguaauguuugcugaauaaaugcuuaugggagaugaauuaugguucaaacagagaacguaggugauuaagccuguaagcccugagggccucuccugugggaggaaguggcuagaaaaaaagaaggaaaaaaagaggaagauguuuauuuaaugaucuuagauugagaaagaagaagcccuauuuuuuauguuggcaaauguuaguugaagagauagaaaagauuucugcacaaaauauggacaauagcagagcaaggguuaauucuggaaugcucagaacagaugaguaauggggaauuuuugaaauaguuugguuccugugagaauagcagggccagcgucaucagcauuuugauugggaagcuuaaugugugggggguaugcaaaaguguaugcacaaggugugagcucaugugcaauccggguacaaaguagcuaauuaaagauggcucaagaauuggucauaagggagguagaaggaaaagaacaugaaaguauuaccaaguuaugcuuuccaacagcuuuucuguggcaguggaugagcccugggauucaggaagauguggauucauaaaucauuuauugagggccugcacugugcuuugaaugugauggggacaacagacauaaaauaacuuaaaaagcugaccugugugagcaguuaacauaccaggcacuuucccauugcuauaggaugugcgaucuugauuauuccucaaaaacaacccaauaauauagguacuguaauuaugcccauuuugcugcugaggaaagugagguccagcaaggucaaguuauuugcuugaggucacauaguaaauaagcuguggagcugacauuuacaaccaagccagucaauacaaaugacuccaauauugauauggaaggaaguauauucuguacuagagauauaccugguuuaguaguggagcagcacaaagugugaucauuuaugauuggggaauugacuuguauauguuugagaaugaaagagagcaugagacagacagacuuagcuaacuuugaacuuugggaaaaagaucauguagcgguuuuuaaacuuauuuuggauuauagauuauuuuggauuuccaccccuuggagaaucuguggaaagcuauggacccuuucccccagaaaaaucacauauuuguauguaguuuuaggacuguugcauguaacuucaggcaaguucuggagcacagguucagacuugccccauuggggaaaaggagaagggaagggcauucuggcugaaggaacaugugauaaaggcauggaggccuggaagggcacagcccugaugugcuuagaaaugaaaauaucuccugggggagggguacaggagccagcauugugucguugcggguccgagugccaugccaaggugccuggcacucauccugggggcagacggaagccauuacauuuuuuucaggagagaugacaugucucagccuguguuugacaaaacuagaucugaaggcgugaagacaaguuagauggcuguuacaguaguccgguaggagagccugaggccugcacuaggaugcaggcggugcugguaggaggagggaguuucagagauaaaaccaacagaauuggcugaugggaugagauuugugaaaaagaaggaguuugauuucagguuccacuucuggcucauugggaggauggugguacuguuaagcgagauggggaguggaggcaggagaagcagguuuguagagaagagaggaaugaggaguuaaguuuugucauaugcuugauguacuggaugaccauccagauggagaugaccuguaaggaguuggaaauuccugccuagagcucagucagauugaaguugcagggguaguuuggagccucaucaucagagaagugaucugauaauggccugugaugcccaggcucacaauuuaucaagggcaaaacuggcauggauauuaaauggaaugucuguagcacugggagaguaaagugauugccuuuuucagaaaagggaagacagauuagugguucccaaggcucacuaucaacagaaacacucaaagagcuuaaaagacaaaacaacuacugacuaagaauaucugggaguauggccugggaaacuguauuucuaaaugcucccugagucauuugggugaucagccagguuugagagcugcugggcuagcugcagucuggguccaagaagacaggaccacauuuuuagagugauaaacaagugagcagagaaugaggcuaacauuugaagcagucuuuaugagguuuuggugcaggaaaugaaugacgcuaguuucauucuucaguuuauguucacuuucuaccuagagggaacauuaccaugaccaggucuucagagaguuugaccaugcauggaaggagacacgguauccugaagggcagaacaaauuaagagaagacuuuuucuaggacaggggagacacuuggccauuugguuaguuggggaaaagaauuuaugaguugaggauguauuugauggagcaaaacccagaagagacuuuaaagggaaaggagccucuuuuccucugaugcagaauggaggaggauggggggagggccgagagggggccucauugcuucucucaaaugaagguuauugugggcuuuugaaaaguagagcaagcuuaguacagauguacaguauagauguuaucauugacagacagggaugauuaaaagaacuacucagcagugaguauuagcagagaguauuacuuucuuuuuuauuugaaauuuuuguugagauacuguagauucacaugcaaugguaagaaauaauacccaaagggauccuuuaugcauguugcccauuuccccccaauaugguuacauuuugcaaaacuggaguguaauauugcaacaagcgggauauuggcauccacacaacccagugauacgacucagauuuucccaguuuuacuugaacucguuugugugugcguacuaaguuguguacacuacuuguuguguguuagucuugugcagguucaugucuccaccgccacaaucagaauacagaacagcuccaacaccacaggacccggguugcccuucucccuaacugcuggcaaccaccgaucuguccucuguuuauaaaauuuugucauuucaaacauguuauauaaauggaaucagacuacaugaaccuuuugggauuggcuuuuuuucaacucagcuuaauucccgggagauucauccagguuguguguaucaaguuuguuccuuuuuaucauugaguaguauucugugguguguauguaccacaguuuguuuaaccauucugcuguucaagggcaucugggcugauuccaguguucaggcauuucaaauccacugugaacauacacguauaggucuuuguaugaaacuaaguauucacuuacaugggauaaaugcccacgagugucauuugcuggcucauaugguauuuguacauucaguauuuuuuucuuuuaaacugcccaaguguuuuccagaguaguuguaccacuuuacauucucaccugcaaucuaguuucucugcauccucaccagcauuuggugucaucaccauuguuuauuuucauugugauagguguguaauugauaccucaugugguuuuaauuugcauuuccuuaaagacuaacgauguugaacaucuuuucaugugcuuauuugccaucuguauauccucuucagugaaaugucuguucaugucuuuuguucguuuucuaauuggaggguuuauguuguuacuguuguguuuuuggaauucuuuuuucuagauacaacucccuuuuuuggauaugugguuugcaaagauuuucuccuuaucuguagcuuaucuuuucaucuuuucucaugggcaaagcaaaagaacuuuuagcagagcaaaacuuuuaacagcgaaaguuuuaauuuugaugaggucuuauuuauuaguuuuuccuuuugugagucaugcuuuugguguugagucugagaacucauugccuagcccuagguccugaaaauuuucuccugugucuuguucuaagaguuuauaguuguauguuuuaaauguaggucugugaugcauauuacuugugagggaacccauugucaugauucugugauuuucuuuacaagaagguuauuggguuuauucauauuuugacaguuguuauggcuuggucguaggagucuaaguugggaaagugacagggugaagcuggaggggcugguaggccaugaggcaugcuguucagaggcucuggugcauguaggagaggaggcaggacaggaggcucuggucaugcaugggagaggcagcacugagauuagagauggaaagauuucaggggaugaguuucgagguguggccacaaauacggucaacugaugugaaugugggcgauggacaugggagaugaggaagcaaggcacugugaagcucauccacagugacuugauuaaucacuuagaugcugaacuucacagugguaaagugugcauuuuuaaagaagguaccgaaguaaaccaggugcugagggauuucuuugaggaguacauggccccauggauaugcauggaaagauguugauagaguguaaguggugucuaaaagcagagagcagaacagugggacaggagguauaucaaggucagaagaaaaugccaacauuucuaccuuccucuucccaaauucuucaguugguccaaaacuauaccuguuugugauguauaguuauaguuacaugggccagccauacaagcucuuugagccuuguugccaucaccaguagaauggggcugguaagucagcauguuucuuucuaccucucagcaauguugagagaaaauguaauuauguaugaagaaguucuuugaauucuuaaaauuaaugguuuaauuaauuuaaacagaaaaccaaauaucgcauguucucacuuguaagagagagcuaaauaaggagaacacauggacaccgacacauagaugagagcaauagacacggggccugauggaggguaggaggagggagaggauugggaaaaauaacgaauggguaccaggcuuaauaccugggcaacaaaauaaucuguacaacaaacucccaucacacgacuuuacccauauaacaaaccugcacauguaccccugaacuuaaaagucaaaaaaaaggaaguuauaucauauuuuaaaaaaguaaugcuuuuagaaguuaagccuguucaggacuuguuggaaaaguaggaaagaacacuauggaaccaucaaacagaguuaagcaucccuaguucaguuagagggcugugugguuaagggagaaauugagcugagcccuccuuucuuaggguuucugucaaagaacagggggacggggagcuccagggcagacuuuuagagaucagagccacaaaugauggaagggacuguugcugggcagagguucaucaggccucccucacaguggcccuccgcagcaucagagggaaguagagaguggguggacauuuguguucuuagcagcacaggccuggauucaacgauguuucucuguucucauccccaccggacccccaccucuagagcuucaguuccucacucaucugcugcuguggccuuccauuuuacgugaaagcgugucucugauuuauuauuguuguuauguauuuuaucccguuccagugauaguauguguuuaaaguggucuuuuuaaaauaaaugaucauuauugaugguaguguucuguuggucucucacuaaaggugcuauuuuagagacuguucaacuugauaaaucuaaauauagaaguguguucguugggaggauccuagaaaaaaaucuggaggaauuuacagucuacuaauagugguugccacagggagaugggauuauaggagacucgguuucuauuauguuucuguauuaaugggauuuuuucaaucgcaaacauauguuacuuuuggaaucagaagaaaaaagauaauugugucaaguuuauuuuuuccucugguucugaguaaaggauauucauuaaagaaaaauguggaaaauagcaagaguuagaaagcaaaccauauugccuggguccacuguggugugguguuuacuggcggcgggggguucacccggggaaguuacggcagggucacagugggcagggaggggugcagggguguuuggagagcaucucucccuuccacuuguggguggcugagguaucaagcucaggggacagguggucagagaguggcagugcuagggcgggggaggagaacagggcauucuuauuauagguuuuaggacauugguccgggacuucaacaggugcccuggccacuugagugugucagucagcuggcccagcucagagacgcauaauuccaacauucauguauuaugguaagauggugaugggagagagaaaggaagacguccacauccauuccuugaaugugcauaggcucacaccgcaaauagaaugaacgggauccacaucucugcugaguauuuuucguucagcuuguacaugagaguagacgugguuuauuccuagaggguugggggcuucucucugccaguaauguuuuugauggccauguuauccuuuguaauagauuccuggcaaguaaucuuguauuugugcugccuuuggacagagguggguagauuuuagagaacaaaaacacuggguacuuuacagugugcuacagauucucauuuaauuauaauuuuuaauuauaauaaaauaaacuugcaauccgaauguguuugaucggcuugauagugaccugcuaugcauacccugcagauaauucugucugccuaccuucccuuuccucauguuucaguucuagcuaaauaauaaaaucaaauuuguucuucaaagcccauuuggauauuuauuauuauuauuauuauuauuauuauuauuauuauuauuaucauuauuauuauuuuugagauggaguuuugcuuuuguugcccaggcuggagugcaauggcaccaucucacugcaaccuccaccucccggguucaagugauucuccugccucagccuccgcaguggcugggauuacaggcaugcaccaccaugcucggcuaauuuuguauuuuaguagagaugggguuucacuguguuggccaggcuggucucuaacucccgaccucaggugauccuccugccuuggacucccaaagugcuaggauuacaggcgugaaccaccgcacccagccuuauuuuuuuuuaaaguuuguucuugugucaauguacucuccucucccucuuagccuuuuagaacacagucuuaaaggugugauagcgaaaccugcugcccaggauguuuaauuuguuuaaaaaauuuuuucuuuauugcauuguaguccccccgccuuugggggaaauauuugucaccccaaaguuuuacagcuucugggguaauauuuaacauauguuaauaagcugaguuuuuuuggccauuuacaaaggucccaauugcucacuguaugccuacccucuucccugggucugccucugugcucugugacuugcccgauauuuuguugagacgggcuuuggcaacugucucuuagaugaaugguucuauuacaaacacaguagcuuccaugaccgcuuagaagagauuguuguuuaugacagcuuuuauugagagagguuuggugcaugauaauguccugauaaggacauuuguaccuauaaaguagccacagccuuaaacauauuugauugucaguaaaauauuggggaugaugacaugccagaugugagguaucggauugcauguuuauucaacuguuacugcaaucucuguacuaagaugugcccuuguauuuucugucucacagcaacacacaaaaugcaauggugauaugauccugauuaugaaagaugcuauuuagguuacuuggauuguaaaccauguguauuaggaagcauucucucaguccccauauguccuuagacagcaaccacaaacaguuguuaggugaagggaauugucaaguggguugaacauacgcauugugauagggaccuuuugaaauguaugaaucuuaguaaggccuggacugaccagggcaggugaugugacagucaaaauaauaauaaugaauauuuguucuugcaaugaauuuuugcaauaaugaauauuuaugcuugcaaugugccagguacuguucugaacacuuagcauuaacccauuuaaaccuucuaacaagucuuaugaauagcuacuauuaucuuacauuacagaugaggaaaccauggccuagagagguuuaguaaguugcccugggucagauucucauuugauuguaaucguugauuauauuuaaucaugaaaguagugguuaagagcucaggcucugggguuccuauccuggcuccaguccuggauguucuuacugcugccuggcuaggguggaagagaguuuugguuccagguaaacaauagaaaagaaagaaugggcuuuccuggugucugggauaccguucauccuguuuuuugcuuuguaaacuccuacuggucguuaaaaaacacuccauccucucugaagccuuccuuaaucuccacaggcagagcuaauuuuucccucucuuauguuuccaaagcacaugacuuuuaacuguccauuaaaggccucaucagacucuuuuuuuuuuuuuuuuuuuuuaaacuguaguaagcacugucaggcucuguuucugugggucuguacccacugagaacucuucaagggccagugcugcucagccuccaguauggucccuggcacacauuaggcccccaaaaaauguuugaauuagugaaaguuguugguaauaaaauuccaucuugugccucucaagaguuuucuuuccuacauucuuggcauuuuuaugacauuuacaacauuuuaaugaaacaacaagggcaagaauuuugauuucauaaauaagaaacugaagcacagagaccaggauguuuucuguuagauuguuuuaucuugagaaaccaccuggugaaacaaaacuuaggagaauuaagucauuugcaagaccccacuccccuguuuacacuuuuccaucauaaccauauugaucuuacaccugagauguugugaacuagaguaauuuguucacaguaguaaagcauaauccuagaaaaguuagucuuugaccauuucuuuucccugguguauacuggacauaauauguuuguaagcuuauuugagauguuucuaagugguagggguguguguguguguaaauguuacuuuuuucagaucgacuguggguuuaguuuuaguugucugaaaaucacuuccaccacugauuauucuaagaugacauuguugaucuugaaugauacaguuaccgggagcaaugaacuaaguaaacucucacuguagaguucagaaggguguugaguuagggugaguuuccaggauacaaaaucugguuagcucauuggcugauuuauaaggggcuuauuagccuaugggaguaaguucuucauugguggugguaaagggcacaggguugggaauaaggguuguugggguuuaaauccuggcuuugccacuucacuggcuguguaaccaugacuaauauugcuaaaccuccauauccucaucuggucaaugggaccaauauuggcaccccaucucacaacuucagugugaagauuaaauuagauaauacauuaaaauacuuagaauacccaguucauucuuugagagcacuauuacccugacagcuaaaucagacaaagauaucaugagaaaauaacuaauaucccuuaugaauauagauauaaaacuccuccacaaaauaugaacccauucagcaacauauaaaaagguuaauauacagugaccaagugggauuuaucccaggaaugcaaggucaguuuaacaucugaaaaucaauuaacguaacacaccauaucaauagagugaagaaaaaaccacauuuuuaucucaacagauacagaaaaaggauuucacaaaauccuucaugauguaaauaaucagcaaacuaggauuagaagagagccucucaccugcuaaagggcaucugugaaaaaucuaagcaaauguauguaauaguaaaagacugaaugcuuuccuucuaagaucaggagcgagacaaggaugucugcuuuuacuccuucccuucaauauuauacuggaguaagagcaauuguacaaggaaaugaaauaaaaauuacucagauugggaagggagaagucaaacuauacugucucuauuugaucuuguauguagcuaaaaaaguaaaacaacacuauuaaaguucauaaacaauuguagcaagguuucuggauacaagauaaauacauaaaaauauaaaacucaauuguaaauuuuuuuuuuuuuuuuuugagauggaguuucgcucuugucaccuaggcuggacugcaguggugcgaucuuggcucacuacaaccuccgccucccagguucaagcgauucuccuggcucagccucccgaguaacugggauuacaggugccugccaccauacccagcuaaguuuuguauuuuuaguagagacaugguuucaccacauuggccaggcuggucucgaacuccugaccucaggugaugcgccugccucggucucccaaagugccaggauuacaggugugagccacugugccugccacucgauuguauuucuguacuuaacagcaaacaaccugaaaaugaaauaaagcaauuuuauucaucauagugugaaaaagaacaacauacacaggaauaaaugugacaaaagagcaaaaaacauuuaccuccaaaacuacaaaauauuguuuaaauaaauuaaauaaccgaauaaauuggaagacauucuguguucauggguuggaagacuuaacauugcuaagacagcaguaccuacaaauugaucuacagauucagugaaauccuuaucagaaucccaggaucccaugacuucuuugacaaguugauucuaaaauuuauauggaaauucaagacccagaauagccaaaacaaucuugaaaaagaagaacaaaguuggaggacucacacuuugugauuucaaaacuuacuacagagcuacagucugaaucaagacagugugguacugggauaaauuagacauaucaucaauggaguagaaucacaaguccagaaauaaacccuuauauuuauugucaauugauuuucaacagauauaccaagacaauucaauaggaaauaauagacuuuucaacaaaugaugcugagacaugcgaagagugaagucggaucccuuccucacauaucauauaucauaauuaacuagaaaaugaucauagauguaaaagcuaugauuaugaaacuccagaaggaaauacaggaaugagucuuucugacuuuggauuaggcaaagccuuagaugugacaacaaaaguauaagugguaaaguaaaaauagagaaaauucaugaaaauuaaaaaacuuuccugcuucaaaggauaucaucaagaaaaugaaaaggcaauccagagaacaggagaagauauuuucaaaucauaaaucuaguaagcaacuuguaucuagaauauauaaaggacuuuugccauuaauaaaaagauaacuauccaguuaaagaauggacagaggaucugacuggaccuuuccuuaaaaaagacauacguugaaaaacacaccaaagaugcucaaaaccauuagcuagcagggaaaugcaaauuaaaacuacacugcgauaucacuuuauaucucuuaggauggcuaucauuaaaaaaaaaaaaacagacaauaacaaguguuagggaggauguagagaaaugggaacccucacaggucacugguggguuuauaaagauggcauaaccacucuggaaacagucuggaaguucuuuaaaagacucaccauagaguuauuauaggacccaaaagaaaugaaaacagauguccauacaaacacuuguacauuagggguagguguguuggcucccagcacuuugagaggccuaggugggcagaucgugugagucuaggaguuagaauccagccugggcaacauggugaaaccucgucuguacaaaaaaaaaaaaaaaaaaaagaaagaaaaaaagaaaaagaaaaaaaaaauuagccaagcgugguagugcacaccuguagccccugcuacucagcuggcugaggugggaggaucaccugagccugggagguggagguugcagugagcagagaucuccccacggcacuccagccugucucaaaaaacaaaacaaacuuguacauggauauuuauagcagcauuauuucuaauaaucagaaaguggaaacaacccaaauguuuaucagcugaugacugcguaaauaaaaugugguaauagcuauacaauggaauauuauuuggcaauaaaaaggaaugaagucuuaauauguaccacaauauggaugacacuugaaaacugugcuaaaugaaaagaagauucaugaaagaccacauauuguacgauuccauuuauacauggaaucauaugaaucauacgaaaugcccggaauaggucagucuacagaagcaggaagcagauuagugguuaccugagacuggaggauuugagagaaaauagggaguaacugcaaauggguauggaguucuuucuggggugauuaagauguucuaaaacuaguuacgguaaugcuuacacaacucugugaauguaguaaaaacuugaauuguacacuuaaaaugggugagcuguaugaaauaugaauuauaucacaauaaagguaguaucaguguauaugcucagcaucaugcuuggccuugauaaauugguaaauguuagcuaccaauguaauaguaacucucugacuucaugugcagagcacguuuauaguagcaaagauggaaagaaaggaaaaugcugagagaguagaugaacauacaaguuaacucagauaccaggugagggagaaggugacugaaucuguggcagccguaugguaggagcugagugcugcuuuuggagaaggugaaugaaguuauguggugcaagagccugauacccuaaaagugucuaguaaaccugaauguaguuacccuuaaaaugugguugaacuugggucuggggauccagaugucacuaaacaguaucuucuucacaaaagaguaaucaccgucagugugauaaaagccagaguuuuugugucuagaagucacuaaaccagguaaggguuugugugugugugugugugugugugugugugugugugcgcgcacuuucuuuuuaaaucacuguaugacaaaggccagaguuuuaguuuuugugccuuuuuuuuuuuuuuuuuuuuaaggcagugucugggggaacuuaucuucccacagucagcccauggcugaccagcuuugauuuuugcagggugucuuugggccugaauguuugagccucccuacaggagauggcuagagccuagcccucaugcucuggaaguuaguucugguaaaagcuuugcaguuggcgcuguggaugcccugugcuacuuaacagugguuccuccuuuagaacuuggaagacacgugccaauagggaggaagguucucugcuaagaugcauuuauuugugaacaccucucacaguguuuuuuucaaggauauaccuguggagggaauuucccauuucaguuuugggggaaaccuggugaguugcuucucagauguuuaggucacacacugacacucaaggucgaauggcuacugcgugguggagcugugauuccaagaaaccuuccaugucugauugcuaagacagcucacagucuuaaccacuaggcugaauuuucccucagggauggacaaaguggaagagagagaaagcugaaggcagagagaugugaaaauacaguguuuucaggaguaguaaggaggcugguaagcaugugggaugucuagaaggguggauggagugugggguggcuuguaagcugagagguuacgggagugaagugccaggcaaggauguucgaacaguaagauuagagguucucaacuuuucuguguaugcagcauauacacaggaaggggggaugggagcccuuguuuuuaggauauucaacaaguguuugaggagaauuauucuggaggcucuaucucccauaaggaggcugacacuacaacacuucugguaggagaugaggagggcuugaacuaggucagagguuaugggagugacaaggaggggauggaugggaaggacauuuuacaucaguauauuagagauuaggcauuuagauuagguguauuagagaugagagggcucuguaggguuuucugaugagggagaagaugaagauuuuucaucugcauggauggcagugccauuuauagacacaguuguacagcaggggagacaaguuguaagggccagaguugggguaaugaguuuugaguuguauggaguuugcagugcuuuggggcacuucauggggagggcgccagcaggcacugggcaauucagcauucuggauuugagaacaguuuggaaaacaucaucacaggguuuggaguugagacccuggaaguggauaagcuugucuaggagacagagggaaaggacagaaaggaagaaaggcuaggauagaauccauuggaagcauuaagagucauugucuugaguaagcaucuuccaugucauaugaaaccuuacagaugcaggagcaggggagucugaauucacguauguuuacuaagugugcugaaguauuugucuccuggugguguguugauggaagcagaugauuuucuugcaaguuccaggggugcugaugucuuggcauguuccuuucuguggcccccuagggugaguuaaugggucagcccaggauccuaguuccuccuucccuuuccuuaagucaaagcuggccuacgcuccaugugugaucuccuucuucccagccucccugggaguguugcugagcuccguuuggaguuucaguugcaaggcuuuagccacccauguuaacuguagcuccuaucgcuugagaagugcagggugaggggauccuggagaaucagcucccuuuugaaaucugcuccagcuugcucucuuggggucagcaugaguguggagaagacuggagaaaacccagagaugguaggcaugaccugccagaugcagcaagcccugcccucucucugugucagaucaaagacugacucuucagucauuugacacccuaaugugaggauguuucugagccagggcccgggcuccugguggccugugccugggagccguggggaacgugugggccugcaugugcucuggguaaguggggguaggagaguaggacaaguaacuucccagcugcucucuuagacacagagcuggagggaucuggagagaucagcccagccuccucaguuuucagauuggaagcugcugcccagagaugcccuuuucccgguuccaguucugagggcgaguuggcccagcuugguugcagcugcuccugcauggcucuuuccuccugucccacagguccuggguuccagggcacagagguuguucccaguuuggcuggugccuauaaugaccauaucauuuaauguucagacuacgacacuucagagaauaaaugggggcaauguuaacaaugacaccaggaaaacagaaauaaaccuuaggcaaaccaggauauauaaucuuccuuccugugccuucacuuuuggcucaauucuuauuccuaugccaggugauauucccucauccccuaccguccugguccuauggcccacaugacuuuagguuccgggaacuuacagaucuuggucuuuggagguuuggucuguggaucuugguaucuagagguuagaaaccucagggaucucccauguuggaggguccaggagauggaaaaccugggaauaacaucgugagcauaucucugacaauccaugacuauucagaaccuagauccaggaacuuugauuuucaguagcuaggguggguaugucauaauuuacuaacuuaguuuuuuuuuccaacauacauuugucucuugcacguagcguaagauggcaugcugguaacauacaaaucacgagagcagcauccuacucugcaaaccuguagccccagauagagcucagcaacucagccaugcaaucuucugccuuggagguggaggggagccaaggcccugggcuccugacaggugugugacggagcagggcauaguuacuugucucccagguguccacagucacagcacagggugggaggggacaugagcagcugggcuuugcugagaccaagccaaauggggauuuaggcagagaagguguucuuuauuugagaguagagcagguggagaugaaugcucugccugguagcuuucucggacugcacuggcuuguuuuucuaucuaaagcuggcagaacccagaccaccauggauccucaaugacaaaggccagaggagaggaaaugguucuucacugggucuucuggcuguguccuuggaccucugccucucccagcugaccagaguggucuggauuugcccauucucucacuggaguuaggaguaggauugccggaccuggcaaauagaaguacgggaggcccaguuaaauuggaauugcagauaaacaaaaaguuauuuuuuaguaugaguauaucccaugccgugguuauauuuuauauagcaacucuacuuaguaaggacuggccugauuuugcuuaccucuggggcaugguuucacagugccucuuucauucaguagaugcuuauugagugccaaggauaugucagaugccacucuaggcacuggggauauugcagugagcaacaacagacaagaguuggugaacucauggagcuuacauucuagugggggcgauagacaauaaggaagauauguaaguauguuaggugguggaagugauaaagaggaaaauaaagcagggaaggaagauagggaggauucaaaccugaagaagaugagggauugaggggauaagccagacagacauuugcagaagagucuucuaggcagagagcaccacagacaucaaagcucgggcaugccucauguguuugaggacuggugggccuccguggcuugaguggagucagcagggaagaggauccagcauggaggucagagcucagaucuugcaaagccucauagcccucuguaaggauaugggcuuucacucugagcgggagugugaucugauuagguuuugaaaggaucaccggcugcuggguagugaaagacugaaagcaagccugggcccaggucucucaccguauccucaggggugggccaugggauuugagaccugcaugccauuuggaauaaaagggcaugccaccuggacacagcaucaccuugcaggaucuuugauuucuuuuugccuuuuucuuccucauuuaagggauacauuccuacucaaaaaagggaaggauauguugcaguuaucuaccucuuuuuugcuaaccauuguaugaugcgccugguuuaagggacaguucccuaaugguuccuauuaagcuuuggagaaagaguagugguguggugggugucacauaccuggagcuuuagagccuucugagaagauaauucgguaaaaauacaucauuuuuugauugguguugaaggaaguuguuuuucguugcacagauuaaauuuaaauuguucaugagagcuaaagagcuugaaagcauuucuuuguuuucugaucuuuaaaaguagagaagagugagcuggcuauauaauauagaacuuucucggcuuuacuuuaccaaagcagucugauuuaaaaacuuaaagccaacauauuucacauuuauaguuuaagauuauaaaaacuaaauaugcauuuaauuucauaaauuuauguacuuaauuucauaaaauuauguuuuuuggagaaaaauacugaggcuauaaaaucuuggcuuguaaguaaauaaaauuauuuuaaaugucagccaguuuugaugaugagagcuauaauucuaaugaguggcaaauauuuucuagauaucuuugaaaugauacucugguuucucuucagacuguauaaaucuuucacuuuuuuuuuuuuuuuuugagauggaguuuugcucuugucgcucaggcuggagugcaaugacucagucucagcucacugcaaccuccgccuccagaguucgggugauuuuccugcuucagcuuccugaguagcugggaccaccacaggcacucgccaccaugcccagcuaauuuugucuuuuuuuuuuuuuuuuggacggagucucguucuguuacucaggcuggagugcaguggcgcgaccuuggcucacugcaaccuccgccuccuggguucaagcaauuccccugucucacccucucuaguagcugggacuacagagcuaccgugcccagccuaauuuuguauuuuuaguagugacgggguuucaccauguuggccaggcuggucuugaacuccugaccucaggugauccgcccgccucggccucccaaagugcuaggauuacaggcaugagccaccgugccuggccaaaucuuccaccuuuuacuaaauaucuuugacaagccuuuugacuuaguauacugguaaauuagcuuugguaauauuauuaacagauuuguaaauuuuugguauauccacaaaauucauuugaaaagaagcaaaaaugaaaccuuuaaaaaaguauaauguacacauuccaaauaugaaaauguacuacuucaccagaguugugaagcauguaagacgugguccauauuuaagaacaaagcagacuuuuuaaagggacugucuuguacaacaucacgcccuugggcacugagaauauggaauuacaggggugaucccuguaaaaaauacugaguaaaaugcaaugugugcuaaaaugcaucuauauguguauaauuuaaaaggcaggcauuucaguuuaaaguuauuuuuagacuagagauuuuagcuguuuucuuaagcagggauuaaaaaccaauuuaacuggggguuuggguuuguuuuguuuuaagagaugggguuuagagauggggccuggcuguguugcccacgcuggucucaagccccuggccucaagugaucuuccugccuuggccucccaaagugcugggauuauagaccugagccacugcaccuggcccaaaacugucuuaauguaauugagacucuuacacacauaauaaauugagauuuuugucaucucaguuuggaauuaacauuguaaaaguacaugcacuugaggguuagauguaacauuacuaccucuagcuguaugacuuugauuuuaguaagucuccucuguaaaauggggacaaugaaaccuaccccgaggacugguugugccaguuagaugagguaacuugaauugguuccugagacaguaccugacacauaagcucucagcacauagugaccagugucauucuuauuggcauugcuuuuauuauuuauuuuuauuauuuuugcuauauucauaaaauguauuugaaaagcaaaaaugaaauacuuuuuaagaaaguacagugacuugagugagaccauacaguuuauguuagcuaaugauuuccaaggccauccaaguucaaguuuugagugugcaagccagcaucuuuugaauaccuugagagagggagcagacaagaaagaguuuggcucagagaagguaggcggugggaacccagaguccuggugagugugccuuuacacccgacaucucccuccagauggcuuuucagccagguugauaauuagcaucaacagaugcaagccgagagucuccugggcugcaugucuccagcauggauauguauggagagaagcaugcagcauguggaagcccgagcucaguuggguuguacggcugggcucggcugggcucagcugggccuguggaggcauugcuccgaguugggccugccugagucucagcugguacacagacacugcccuacagcccaggaccugcccagggggcucagcguaacagacccaccuugguggggggcugcugcuuccagcugcuuugcagcuucugucaggccagggcugcuugaguccuugcucugcuauuuaaaucuaucacucguuggugacagcuuucugcuuaagcaguggcagcauguaugcuacagguuucagcucauuaccucuguagggcuguuccuggacugcuggcugggggaaaggccagccauacagacugaggcaccagccccaaacucuguauuggauguugcugagccuggguggagaguggggccgugcuaccuacagugccugcuaccuguccuucagaggaccugucugcagcagggccagagccuaagguuuuguuuucucccagccugaugggacugugauacuuggacauggacaucaaggagaugugggcuuugccacucugcuuaagugggccugggcaagucauuuuaccucuugggguucauuuucucuguuaauagguggugaacuuuucaagggugauuaacaugucaucuuuaucuccauaucccuuggacacaguagguacucaguaaaugauagcuuaaauuuguaaaaugggaaugauaggacccuuaucccuaauuuguacugggcagagacaaugaauauaauucuauuaaacuuugacaaaugggaauaaagugaaggaacccuuguauuuccccagguucaucucccauauccccaguauuaaagaaucucagaugaauggggacuuaaaaaguucauuuguguaucuuuauuuacugauucaaacuuuuacuaccuuugccaguugaucuaaauagacaucucuguuuaagcaucuucuguauaaagaagguguauaaauagucaagaagcacaugaaaagauacuuaacauuagccauuagggaaaugcaaauuaaaaccccagugaguuaccacuucauacccucaggugacuauggucagaaagacaauaacaaguguuggugaggggggugaaaaaugggaagacuuaugcauugcugaugguaauguaaaauggugcagccucuuuggaaagcagccuggcaguuccucaaaauguuaaacguagagcaauucuauuucuagguauuuacccaagagaaaugaaaacauauguccacgcaaagacuuguaugcacauauucacauuagcauuauuuuuauaugugcaucugaaugcccucaucuccguuauggauuggauguuaggacacccuauagaggagauuuccagggauagcuacucuuguguuugucuucuuauaugggguucaugcauaggaaaugccaagcuuuuggccucucucauuuauaacuuccagauaacagccuaaguuuggucuauguuuaaggaaauucaggagucuuuugcagggcuucuguagaaaccuuuaucaaguaaaaguaucugguguuucccaggcuuugcucuccugcauuccuuguagucagcagggaaggaccccuuguuaugaugugaguuacucucaacauuucaggcuuuugaagauuaauuccugaucugagggaagauucuggcagaacugggauaucucuagaaugcacugauaagggccuugucaguuucuggggugggcagguccuucuuauagacgguuuugugacuaagauaccugaucaguaggcuuuuuuuccuggcuguaacuagugauggguugcaggugggugcguguggggauggaacaucuuagaguugucuacaaaguuaggcaucagagagcauggguaucauggagagaacuuuuugauugagauuuggggccaauuuaagucaguucucuaauauuuucuugcauuugaguuauaagcuguuccuauaaguaagugauaagggaguagugggaaaaugcauccuuaauuaauaggcagaauaaagcuagguggccauaggaaggccauaaaaagcccaaggaagcagcccuauuuauuuguagaacauaggugaaauguuuauuauaugcaaaacaaguuaaaccaaaacaucuaaaugcaccauaguauaugauuacagaaaccugaaagauccaggaguaacaauaacaaaggaacaaaugaacuacacaugaacacuaaucuucccuggaacuaaggauaggugggcacuuagaagugcuucugggaugggaggucaggcugcagggugauggacauugggcaugugcuugggacacuccuugaggcacauggagacuauuugagaucaccucucugaucagaaaguuguuuggugaguaccaaaauaagacaaaaaugaguaaguguuuuuaagggagauuucccucaagcuguguuugguagauaacuaauaacucucuguucugggauauuuucucucuaggccacugucauugaccucucaaaugcuugggggugagaaggguaaagauaauauaaaaauaucaagaaaaggaaaguaaagggaaaauaguaaaaaaaaaaaaaaaaaaaguccuauauaguccuaugaagaaaguuuugaccuagauauaaaaauauaggcaagucugaaaucuuguugcuuuucucuuuaguuugccuucguugauauaagucuguuuauucaugucuguaugcuaaccgcugacacuuaaaugugaaauuguucucaggacucugcugcauuguccuacuaguagaaguccugguuuuagaacauaaggucuggauauguacagccuagcuuuuggaugagcaacucugugcaaguuccccaaccucuguucaacuucaaaauaagggcaguuauacugaacgccuguaugggugcuaugaggauuacaugagauauauaguaaagcuagccaaaaaacauugguuaugggccaggucccaaaauguuacaaaaugagcugggcauggugacucauaccuguaaucccagugguuugggcagcugagacaagaggauuguuugaugccaagaguuugagaccagccugggcaacauagcaagaccccaucucuacaaaaaauuaaaaaauuagccgggaaugauggcucaugacuguagucagcuacucagaggcugaggcaggaggauugcuugagccaggaguuuggggcuguaguaugccaugcucacaccuguauagccaccucauuccagcuugggcuguuagcgagaccuugucucuuuaaaaaaacaaaacaaaacaaaaaagauuuuugcauaucauugaaaaucuaugaagugguuuuuuuuuuuuaauuuauaaauauacguuauucaaccgguugccuauuuuugagcaauuaaaguggguuuucccuacuacaaguaacuacagugaauguccuugagugagauacauaauuauuucuuuaggaccaauuccaagaaguggaauggcacaguuaaaggauagauauuuuuuuuaagaacuaugauaauauuuccaaauaccaaugucugcucuacuaaaaaaguagugagaauggucauuuccucagucugugaucagugcuggauauuuagguuuuuaaauaucuuugcuauuuuagagguagaaaauaucuuauaguuuuuuugauuuuuauuucugguaacagcugagcuuaaauaaugguauauuuuauuauguacuguguuucuuucauacaauauuguuuaauuuuguucaguuuuuccuuuagaguauugucugucuuauuaguuuguaggacauugacuguuuucacuuuuguugcagauaccucaaguuuggcauuccauucauucaaaaaacccaccguuuuuagauaacccacugacauggugaaguaaggacauuguuaggaaaaaggcauguaggauguggaacaugaaucaaaagagaacuauccuggaugaucucuuuguuguuaagcccagugauugucugagggagugggauugguggggaucucacugagugcugacuguccagaacucacuuucucauugugaucugacuccaguuguucaaaagccguuccuuacugggagaagucagagcaugggauaucccuugagaguauaugugaaaugcauuacuuugaagaauugguuuuggaacacuaaaguggauaauggaagcagcuauuucauucuuacagcucuggaguaaaauggcgaugaucuuuggucuaccccaaaacugucuuaaauuucgcuugcuuuggcuaacucugauaggaaauagcuaugggagaguaggaagggaauggggcuuagagcccauaauucaaacccuacuaccacuucuagguaugagcuguguaacccugcacagguuacuuaucuccguuuucuagauuuuaugcgguccauuuggcauguccuaagcacccaguacauguucauuaauuauuuuuucucuucucaccaggucuggucuaugucauguucaucucuauccucauuagcgugauagucucuuugagauuauuugaugaccaaauuaauggggcuggaguguaacagcuuaagagcagguacauucugaagagugagaauaaacuuugucuguguauuauuuacuguuuaagaaaaaagaaaaaaacagcccucaugguguugauggauuuuggguaaucaagggagauuuggaauaucccucucuuuucgacaugugacagccugucuaggugagggccagggucacaaugaugguucugauuguuccucuccaggagggccccugaacuuugacaucaucuccuaacgcaguucugccggaggccuuccugucagagccuccugggccagaaugggccucuguggcgagccgggccuguaacuguucccacucauaaugagcagagcugcuccugcaacccggcaggagcacccgagugggugugcaugcacauaaugggcccagcugcuguggcugcagccugugaaugccuuccaagaggccagaugccuggacacaucucucagcagcuacuuuuccuuuaagggggaugauaacucccuggcgcuuaucccuaguaccucugacaaggaaaggaaauccauccugcccugaacagcagggugagcaccuucaccugauucagucucaugcaucucagcaagggagaugcuaguaucuaauugucuuaguuuccuagggcugccauaacacaauaguguaaacuaggugaccuaaaacaacaggcauuuauuuucucacaguucuggaggugagaagcuggagguugagggguuggcagggccauguuuucucaagucuuuaggggaggauguguucugugccuuucucuuaaaggcuacuguguugccaucaaugcuuggcuuuccuuaucucacagcuguuaauuucagucucuaacuuuguugucucaugguauucucuccuaggguugucguugcauuaucuucuuguaaggacaauugucauauugaacuaagggaucgcccuacuccaguaugaccuugacugaucauaucuucaaugacaccaucucugaauaaggucaaauuugagguguacugaggguuaacacuucaacaaaucuuuuuggggcaugcaauucaacccauaacucucauguugcauacaugggugcagguuuaaagaggaucaguaauuuggguauggucacaauuaggcaguguugggaccaggauuggaacucaggccagccuguccaaagccacuucucuuucuacuaaacuuuggugugucagaaucacuuggagggcugauaagaaagacuggggcccaggcuuuauacccuugcuccuccaccugugguccauggaccaacuggcaacaucagcaucaccugagagcuuuuuuuggaaaugcagagucucaggucccaccacauacauauuuuuaacaagauccccaggugauuugggugugcagucaguuugaugaagcaccugaaucggguauacgcugcuucucaguccugauugcauauuagauugcuugagaacaguaaaagacaaaacacaaauaacagugauggcagccuuaccccacgccauugaaucagaucucugaugaggcacugacguuuauauuuuuuaaaagcugcccagauuauucugauucacaguauaaguugaggaccacuguggggcuggagguccucauuucuggaauauccagacuucaauauugagguugagaauucuuuuugcacagguucuucuuuuuauuuccacaguagugcagaaacugggccaggaggggggcuaguguacggaauuuauuucagagaaggcagaauauuauauagcaaaggagaccacagugcauuuuuuuucugacuuuaccucuuacagauacuaaguguuggguagcaaccuauuuguccaccccaggagcuugggagaacaugaaaggugguguggagauagcauauagugggcagucagugcuuguugaauuaaauugaauaacaaaaaccauaggaaaucagcguuguuggucucacugaaacauaucauuuauagagaugcuauuguguuacuuuugggguacaaggaagaguugcagaagacugcacagaugcuuacgauguuuagcaauucuuaggcuacgugggauggcuuaugcuuguaaucccagcacuuugggaggcugaggcgggcggaucacuugaguuuaggaguuugagaccagccugggcaauguggugaaaccagucuccacaaaaaauacaaaaauuagcugggugugaugucacacaccuguagucucagcuacuugggaggcugagaugggaggaucaccugagcccaaggagguugaggcuucagugagccaugaucgcaccacugcacugcagccugggcaacagagcuagauccugacucaaaaaaaaaaaaaauuuagcaauucuuguuauaucaauaaacauggaagaguuauuggaaguuuugagaauaaagugggagcaccccuuaauaucuacagauguggccgggugcgguagcucaugcuuguaaucccagcacuuugggaggccgaggugggcggaucacgaggucaggagaucgagaacauccuggcuaacacggugaaaccccaucucuacuaaaaaauacaaaaaaauuagcugggugugguggcgggcaccuguaaucccagcuacugaggaggcugaggcaggagaauggcgugaacccgggaggcggagcuugcagugagccaagauugcgccacugcucuccagccugggaaacagcaagacuccaucucaaaacacaaaaaaccuacagauguauuuuccguuguagguuuuguggugaggggaagcacuaguaucccagauggugaccucuuaacuuuuaauucuucaacauagacuugaagaaggauggugauuguguucagaccaucuugcccuacuguucccucaaacucugucccaucaguccuucuccucuuagcugaucuuuuggacaaucacagaauguggggaaggggcucauuucagucuggggucuugauguagcaugcauuugguccucagacuagggcuuucacagacgguuggcacccuauccaaugacaauucuaguguccuuuucucauuccuggacuucuugacguuugugcuuuuguacccccuggugugccacccaccccaucccaucugaaaauccuugguacagcccuuaagucuuggaugugcaugcugucccucucuuuuuuuuuuuuuaaacuaaccuuucuuccucuuccugacuccacuaaguagugguuaucuuuaagguuuuauuuauccccucuuuuuuguagggguuuccuccacucugccaauuuuacuguccuaucugugcagaggaucaccauuucucuuccaaaugguugucccuucaucaccaaaacaucccauacauugaaaauggaauucuccaacuucucuuguuuucuggcuugcuuuuuuaugucaguguauccuaucuacuauuuuucaaagccccuugucuuugaaaccuccuauuugauuuacccuguagggacugaucagucccuuacucuuccauucuccuuugggacaucuuuuguauguucauuuuuccuuuggauaauucucauuauccaaacucuuaauugccugauaccuggaugagucucuagcuaugcuuuccaucccugcaauggaaauuaaacuuuuuauuaaagccguuuguguaacauaucaacucuaccuguauuuccacuuuuauguugcaguacugcccugguggccucagcuccagcuacacuauuguuuuuaccuuucccauaguugccuccugcacacaugcucugugguuggcccccguugcugacugcugauuggagaugacguguacccauccucuagacagucugugcuuuuccugucuuuggagcuuccaguuccacccccaucaguuuuuuucugaccacuccaucuugccuuauuucucucucuuuccuuuugacuggaagaguacucaucuuuucuaacaucuuuucauaaacuguuuugauuucacuuauauugauuuuuaacguauaaugugcugguguucuauuuccucaguuagaucagaaggccccuaaagacagggcuccauugguguuaaacugccaucuucaaggucugggacuugauuucucuuuuuuuaccuccacaacaaggcacuccucugcacccagucggaauucagugccuguggucaaguaaaugcaugaaggaaguuggaacccgugguggguauguuuauuuaaauguguaaaccaagaaugccuuaugguguguaugccagaagugaaguucucaucuguaauuaccaaugaagaaaacaccuuguauuuacgguugaguuuggcaccaaaucagcacuggucuuuccuuccaugguacaaauguuguaaaacucugaaugcugcguuuccauaaaaggagcaugcauuucuguggagguggugauugauguuggaugccuuuaggcggugccauccuacucaugagggaagcagugcuguucuaggcucaguccacgaauugguuugccuuuucuccuuucccaacucugccaccuggaaaacaaaacaaaagcaacaacaaaaccccccccaggcauucugccugcuggcacccuguuagaauaaaaagauuagaacacuugguaucuguucacucacucaggugaaguuugagauguccuacugggcuuuucuaucuguagacccaugaaaaucucauugaagagguguuguggaaacaugagaaauacauguuuaucaucauuuguuuguuuauuuaccuaccugucuaccaaauuagaaaaguuccaggcguuuaucucaguguuuuacaaauauuaacuuguuuaauuuaaauuucauaaccacccugagaauugagugguauguuuucauuaucccacuucacagauaaggaaucugggcacagagcacugaaggcgcuuguuaauagucacaugcaaucuuuuuccuauuucuuggcuuccaguaauuuuucagguaacuaaaugccugugauucccaauuaggugucgaguucuauggcuuuuauuucuauaaaucauucugguuucuuuuuauggucauggcuguacuuguguuucccucugaaauuggcagaagaugagugugugugugucagcguuuuuaacacccacuaaaaauaaaucuccuacagugcuuuacaguuuauaauugcuuuuucagauauuaucuuccuuaguccagcaaugcugguaagaagaguuauuauuuauuuccauuuaacaaaugaaguaaguggcuuagagagguuaagagacugaacauauccuuaaugugauuaguaccuuggaauuugaacccaaguccucuuaauccuuugcucuuccaagcuguuacgcugcuuguaaauugggaaacccuauagucuguuuuucuugaaguucuuuguuuuucuaaccuccgucaaaauaauguaguguuuugcuuuuuuuuaaacuuauaucccaagccuguaugguagaagaugugaaaguagggggguugagaaugcaguuuuuuugaaagagaggaguuuaucagaugccacaagaaauacuuuuuucuguuuuucuuugauagcaaaagaguaaaaauuuugcaaggcuuuucuugauauuuuuggaguccaggggaauaagugcauaaugguaauaauuaaauacaguuuccaguaagggaguuuucucagguuuagcugcacaggcuuagaaaguugggugagagaaggcuuugaggagagauuagaaguuggagagcccaucugucgugccaguauacaaaaauguccguggaugaugacugcuugcaccuccagagcuagucuccucuaggaaaaaucaacagucaccagugcaggagaaugaaugagucagagcucuggguccugagccgguuuuaccucuuagcuuugugaucuugcauaaauuauccaaaggaucuggacugcaguuuaguucaguguagcaagcuuugaucaaacagcuaugugccagguacugugguaggugcucuggagagaaauacaaauuagauaaggcuucugcucuuggauaguucucauaccagcuggggagacugacaggaaacacagcgaugguuccugcuguguuagagauacguucagagggcugauaagggagggggacgcaaagcauaucaaucagggaauucuacuaaggugcugauucaaggucagcuucccuccuccugaccgcuguacuuagcacagcacguagaggggacuguagggaaugcaaugaaagugaauggugacaaaaaaaugaaaaagagccucaaggcaggagccaugguuuucuccucuggggugggaauuuucuucaaucugggaauacugugguggggccucucaucuuccuuuccucccuucucugcccccaagcaccaugucuuuuuccuagcacaaggcuagucucauagauuucuaagaguccuauauagcugucuuuaucuuaggcacuagccuaaguaccccuugugaaugggguugguugcaucuuuguguucucagugucagcaccaugccuggcacagaauuggugguuuaaaaauucuguugaaugcauggauggauggggauugcuggaagcacagccuggaaggagcagaggaaggagagauugaaacgagaagagugagaugucccugggcaauggcugaugaaauuuaacccaggcagggaggggcuugggcugaaagccuuauuaaaaagcugccaucugcaaagcaagaauuuaacuccuugguuucacaagaaaagaguaaguguagccuagaaauuggggcuggauuugaaaauuagccccaauucugcaauuuucaccgcaauaaaagcuucuccaguuauacauggugauuggucuugaugggcuauuguggacagaggagggugcuagguugggguggacggggccacagcucagacuaaaaauccccuuuucucucuucaugagcuuggcugcagauguagaaacuagagcuaacagcaguuuuaccucaucuuaaagaaaaguaguaaauuaauggaggcuuuaauuaauugcuguggucuguugaguacuuacuauaggcuaagggcuguagggaacacuuuaauucacugaauaaugucaguaacucugugaaauagauauuagugaccuauuuugcagaugcacaaacugaagcucaaagggguuuucacagauagugcaauacuaaguuggagccuugguuugaaccugagcgugucugcuuccaaagcccaugcucuuagguggauuuucagugaugccagaagaugguuggacuuuccugaagauguuuaugugcauugucgccacagagucaaaccaagaauuguaugguuguauuucauucagaaucauaacaugcuuaauccagaugaugccucagaugaugaagguggguugcccacaggcuguauugauuggugauucuuaagaguguaaaaaaaggaaaucacuugauuuuguuguggggaggcagaauguaucacacaauagcuugguugaguuuggcuuaauguagauauguuuaauauaauuagacugagggcugaaaugggcaccuucaggucacuguggaaugagacagagcccucacuagauuuuugagucacuugaggugguuaugccaagcccuguucacauuucacacuugaguuuaaguauuugugaagggaauauagaucuuugguuugaacuagauauagcucaaagguuacccauucagaacagagcauuucagccucagggcaccuacuuagccucuaagaugagaccacaucugaaccagccaagucagccugggaugagguuggaggagaaaaauucaugugauaagucagauuacaauuaacuuuuuuguuauuacuuuuugagugaccacaaugugugugggacuucgaaauauggaauaaugauggguuuuauuauuucuuuuugagaaaaauccagucacuuuuuuuuuaacccgaggaaguugaauccugaagaaggggagauuuaucucugcccuuugaacuuaaagcccauaaaguaaaauauauaguuuaaaacaauuacauguuccccccaucucaccgccgcccgacccuucacagauaguguuugacaaaacacuauuuaggaaagugccugacuggugguggaggggccuugcuuccugugaaucugcauucccugugccacuugcuuccuucccugagagguucugguggccagguguuaugaauccaggucaagaugaagaaaacacacuuuugucauuucuucaggcauguggccgacccgaccgggucucagguauuccagauaugagcgaugugccgauugcgcaaggcuggaagcauugcucacucggagauaccgaggccugcuugccccgagcccuuuguucuccugguugaaagcaguuaauuagcaacugucuccauagcaacacccucauaguccaaaaacauugucuaguuuuucaguuuagcuuaucacacuguuuaccugaagggcuuuucacugcucugagucucauuugaguuggcggcaugccuguuggggaagugaauugucaagauagaaaaaaacaccaugguagcaagaagccgaggagacuucucucuacccagcccaacccgggcccuggauucugggaaaacagaaguugcgccugccuaacauuuucaccuguauuuuuuuuuuuuguuuugccauaaaacugcuguucucuccaccaagcccugaauugugaggauuuuuccccccuuuccccgagaggcuuucuaagcucuuuaauauucccuguuuauaguacauuuccaugauuagucaucuugaaaccccgaguguucucagccccuguacauucgaggaaauuuugcuucccugagggucuuggcauuugcaaaggcccuuggaugaaggauuaugagucugaaugugaauuagucagagcagcuuuguuuuuaggcauaaugaggaaaggcuucucuuucuugguuuaaguucauuguuugugggaagaaggcaacuucagguggcuuguugguaaaauaggaaaggaaacuguagcuuuuuuauaagccaugcaaugaagauaauuuucauagcuuucauggacugagugcagucuguguggcccuccaugccagcuguguggcccucugugccugcuguguggcucauggcgccagcuguguggcucuccgugcugggacgcuuaggagcuuuuuaucucacaucugcaaugggaagacaggaggcagaugggaaagaagacugcauuuccugaaugccuaccacauuucaguugcugagccagacuuucacaaaaugaggucuccuguauccuucacagcaaaccugcuaacgaggcccuauuaaguauuuuaaagaugggaaacugggguuccaaggagucguugccugcccaagguuguggaauucuaaucuagaccuguugguuuauaggacgccaacacuuguccugaagcagcguuguggauuuggugguggaguuaggcgguacguaucacagauugcagggcucugggagacuuuugcuaaggagguuaguuagaauuuggugguguacauguguaauuagaugccuaaguaugucucaggaaaucaugaagcuuagguccagugauaaaauaguagaauuuaauuuugaggcacgugugccagagcuuauuuacccaaacaaauguaauucucuuugaaguauuaacuuggaaagacugugcuuugugauauuuccauucuucagaccuuuuuaaggaaacuuuaugggagcaagugcuuucccagcuugcaaaauacggcuuugaaugcauucagcagaccauucuugagcauugaacuccccuuaauaugggcagagaaguauggcuuuucccuagcgguggucccugggaccuagcauggguucaccaagaacgagccaccccaggcuagcuucgcuucuuucucugaaaaccuuauuaagcagaaaacuauaguuuauacaaugcauaaaugagaccuuugaucugcuuuuuaauuuuaucuacuguguugaaaacagagacauagucugagcugaaugcaagaacuauggucugaacugccccuuaguuaauaccuaagagugacaaacauguguuguaaugggagaucaguacuaugugauuuuuguugacugugcgaucacaguaaguuugugauguggcuucugcagaagcgaguguuaccucggagugugcagauagaggaggaugcauaccauguuagaacacacuuggagccagggguucuguuuuccuuccuucgcucccugccucucuccacuauacuguaugccagguaccuuucuauguguugggaugcaaagguggacaaaagaaagccccuuuagagagaacguaaaaacuaggguuucuucagagggcagcaccccagaugauaaagagaagaaaccacaugucacacaaaaucauucaaaggaugggguggaugugggagugguaguauuugcccugacuuagaaaagacucugcagagacaugggugaagaagcagcacauuuguccaguagacucuaguuauaaucuuaaaaggcagucacauuuuggcucaauuauaaaaaagauauucuucacaguccugcaaagguggacugggcuucugcuuuaggauauagcgagaaguauugaagcagggaucaaaagaccauuugguggcuuacugugaaggucaacaauauaaugaaucuccuuuaaaauuuccagucaugaaaauuguauaagugagcaggcaugucaucugccugcaagacacaugcuaguaaugaaggaagauguauaucacaaugaacaugccugcuuuauauuguuuauuuauuucuuugggggcagcugaauaugaucaauuuagagauguuagaacauuuguaacuauaguuugugagaugggcaauuuuaacugcaggaagucuucagaaucacagcacagguucaauucacugugguuguuaugucauaauuauauauuguggaugucuaauuccuuuucaaaccuagaaguaaagaucauguaacauauccuagccaauauuaaagcaauauuauuauaaaaaugaucucugauguagaaccacuagaauuagggccuuaggucuacccauauugaguuugcccuuuuuauuugcaaaaugcuugaucccagauugcuaugagagauagacauaauagugaucuuucugcuuuugauaguuagguaucauaguuuuaagacagcccauggaguuuuagaaauugugucugugucuacagaaucaugugugugauuagauaaagauuaguagguacagaaacuagcugaagcauugauugauacaccuuguaccuuccaaagaauugaucuguuuaaaucaaguuaguuuuacagcuccguuuguugcuucucuagauugauuaggugguuuuaugauguuucuuuuauuuuuuucacuaggaauuuugcugaguauuuuuaauaccugaauugacagacugguuuaucgguguugggggucugugugagcuucucauuaguccauuuacaauggcagcacuuucauguuuaaauguagacaaaccugucccuaauauuuauggagccugaggcaaagagugucaguggaagcucauguacucuauguugaaauauuuaaaggaaaauucgaguuaauacacuguuaaauaacauuuucucaccuccuacuuugacaaauuuacuuuaauaauaacuuggaacccagguucaaauuuagaggccugcccccuucucuucccacuccagcuguauguuguaacauguucauauggaugcugcagauugcacaagcaaaccuucuucuccuuccuccugcuaacagcuguucccaggccacuccuugcagugaagcauacucacaccugugacacaaucugcccuuuugagaacagauucagggaaguggccuacacagaccuuggaaguggaaaaggguuauuggcuugagaguuccaaagucuuggguccuuggucgauggucuaaaaggugaggguguuaggugaaguguccucuugauccucaaaggcuccucacccugggaggaggaggaagauggccagaagaagaccagagcaagacccucuaaagucuagggcccaaguugggcccucuggccgaggucuaaggacuguacagaauauggauaaaagcaugacuaacuuccaacugccuuucauacuucagagcuugaaaccgaguaguuucaaccaaguaguuggguuggccuaaguagcuuugccauuuaaccucguaaaugaucuaaacaucaacauagucugagaguugaauaaaaaauaagugaaguaguuguucauugucaggucagguuugaauucucucauacuugaaaucccugcaacugugaaauugccuguaggaauugcagguugugcuaaacaaucaaacgaauugguagguuggcucccauaggcaaaaucuugaggcuguuuggggcaaaaaaaauuacaaaauauaacuaguaauaagugggaugcaauaagaaucaaaugugauccaauuuucuggggaagcaaauugcauugcacuuuguuuuauuuuaaaaaaugaugugaaaauacagagcaucacagcacagacaaauaucuuacaccaguuuucacaauaaaauccccaaaugugaaagcucucccuuuuugcaaaggcacuuuggaagcaauaauguuugugugcauaguugaguuuaucagaguauacugauuuuuuaucccaugagguuuucaaggaaagugcagcuggucaaccuuuaguguuuucuuugccacaggguauaguucuguuucuguccgcucaaauacagucuuucaggaaacgaauucucuguaggauaccuuaaaaugucuuuguguuguaacacaggguagggggcaguauguuuaauagguuaguguggauacguggguccugaaaucacaguccugcuuuuugcuccuggcucugccacuucuaguuacuuguguaaccuugagcaaguuacuuaaccuucucuaaguuucaguuuucucaucaguaaaguggguugaauaauagugccuuuguuaaaagguagguaugaggauugaaaaguauagguaaagggguuagcacauaguuaacauucaauaaaugcaaacuauuaaucacuauuagcucacuuguguaaggaaggccuauggguuuauagaaagguaacauuuugugguaagagaaccucuccaggggaaccucuguaaacuccagagggcugcacggaaaauuccacuguggaugaugggccuucucccggaguuuaccuguuaaggugaaguaggucgugcuuugaagugcuuggcaguggccagaccuggacagguacugagaguugcacugggugcugugguugcuguguccccgccuuccauccuagguagcagaugguaguccuuacucaucucugaagaguccuaaguagcccgaguccuagauguaauuuguugcuuauccgcaaagugguuuugaaggauaugguuuuucuucuuuggguaugaaacauaagaggaugaaggaaaaaugagaaguuuuguuucuaaaugaauauaguacacagccucagaaaauauggggaaaagaugagaaggaaaauuauuuuuauuucuaaaugcacuauucauuucauuuuccaaguaacuuguggcuaucauuauuuuuagugauuuaugcuuaaauagucuuccuugggaauaaucaaauacuggcuucaaauauagacagggaaauuauaggucauaguaggcucauaaaauaacgcuuagaaugaacuugggaugggacguggaacagggcagcagacuuuccaccaggcgccauuccuguguucucagcucuacccuugagccuucucuaguggggccccaaaugcaccaccaugauguaagggucugaccaacuacuuaguuucuagcagcccagagugaaggcaccucucugugccuuccucuucgcuaagccucaguuuuuuuguuuuuguuuuuuucccuugcaaaaauugagacaguaguguccaauuugcagagggucucugagaaugaaaucagaggcacguagcaacugccuggacagugccagcacuccaccugccaccccuccccacugcccucuauuuguggagagguggaugauuuugcuagucacaaagccugucuucuuugagacaguagggaaaaagcaaccacugugauucacagaauuuccugaauaggcacagcugcaauuucucugccuuuacucaucaccauaaacauacuuuaaaguugucaguuauguuuucuuucucauuuuugguguugaaaaaaauuaaccuuugaguuucaguuuccuuuucuguaaaauggggagaagaauagcucccauuccauaagguggcugugagaaugugagaauacaggugacaggcugcauaauucucgcaaaaugcuguuggagucccuagaaggggaggaggggagcugugaaauccgguuuggaauugggaauuuucauccugagcuuguguuaaggaaaggaaugaggcccaucccaaaguagaaaccaaaaacguucuuacugaauauggcacaagcacugguuuucuuuccuaaugaguguggucauuauuagaguuaagccuuucccugcauggcaagugugaacaugucugcagacccugaggacaccagagcggcaggcuuugaagggagagcaguggacacucagugacggggccacucacagucuagcucugaccccaccagauccuguagguuccugguucuuguuccuggugaauuccugacuaucaccuuuacacagugauagagccuuuauuuccacucugcauggaggcauauugcauuugaaagauugaaacccauugcuguccccauugacagggagcauguuaaggguaagaugcugcauuucacucauugcugggcccccauuucugaaucuggacuugugucuuguaggcauucaagaaguagcaguuggaagaaugucacugauggaauugaugucucuguguacacacccccagaucaaagaccaugcuucuuggucuagccauaggaacucuccacccuugagacucagccaggacguggggcccagccuuucuuuaccucccugguagugcccuuuuuagagauaggcauaaaaugacagugcugccccucaagucuaaaggagggggcaaaacguagcguccugugcuucaccacugggggcuggcugggccacuguuaaggucuguggagacuucuguuugcaggagagguugaugaaaacccuuggcuuuagcuguggccagaggauccaggcuuuaccuuguaugcuccgagcccugugccuggcaagucugccacaugguuauggaaauguuccugaggcaugaaggaggccuuucuggaccagccgauggggagugggugaggagguguggaggaggaaagaaagaaaacucuuuccccauucuuuuuuuuuuuuuuuuuuuuuuuugagauggagccucccucugucguccaggcuguagugcaguugugcaaucuuagcucacugcaagcuccaccuccuggguucaagcaguucuccugacucagccuuccgaguaguugggacuauaggcgcacaccaccacgccuggcuaauuuuuguauauuuaguagagacaggguuucaccauguuggucaggcuagucuugaacucuugaccucgugauccgcccaccucaaccucccaaagugcugggauuaaaggcuugagccacugcgcccuuccucuuuccccauucuuaaguaccuaguaacaggucugagcuguuuagagguguaagggagcuugcgaaguugggaaguguccggauguauggacgcuggagcauuuuccccaugagggucuaagccugggaaaauggccagauucuacucagagacauucucccauuuucuuaaacuaggggugugcugggagaacucugggcuccuugcccacaggacagccgagaagcuuuugucuuccccucucuugcugagacacauccucccucugaacuucccaccuuagucuucggagucguuuuagacucgagauugcuagugacuugaagguucuggucuuucugcuaugauugggaucugugcugcaccccugggucuggcaguguccccagcagugggaugcugcccagcaguaggucuuucaugcugacgagcacaguggcugaugucauugugggggaguuccuucuguggccauagaggucuuggucuuuaacgcuauaucuccuccucccuggcccugaaauaaauuccuuugggcugcuaacucuccuuccuuuaguggcugcuguuaguuaauaguccuuuuccuagacuggugagaugguugcuuucaucucagccugugaggcugggagucauuuggauggagguggccagaagcuacuugaaugcuccacggcuauagaggacauucagcauccauucuguuuuucuuaccaaaugcauagaggccagcccucucacuggcucauuguaugauucaggugggaugacgucccuugcaacucuggaaguagaccgugauugauauaagccuaaaacagcuauguccacggcgauugauugagggauggugccugaccagucacauccagugagauagaggagauaucuuucuggggcugcugggaaaguaaagcuuucuuucgcugaagcuuucagaagagaaucacacauccuguggaugguguagggugaggacaugaguucuauaugggagcaguuuucuuucauaagaaucccacacaugugcaggacugguuacugguuggaaccacuaaguaaccuauugggaggcagauugguaaugaugccaucuaagcuguuggaacaagacuucuuaguuaaauaagccacuaagcccccuccauugcuuaaaagccaguuugaucauuguuucuuagaacauagugaccugauaugcagaccuuccucuugugaauuuguugaggacuuuuccuacaaggucuucuccaaggucugugugaggguucggcauuagcaucugggaagccagggauccucaugcuaaggcagaacaaaaacaggagucagggcuggagaggggcgucuguggucucuggggcaaggcagcuugaggugggacccagaaguccagggaaucagagaggaacaguggguuggaguagaucuguggguuggaauaggucugugagaggucuuaggggaguggucuugcccacaguggaguggccccgaauccacugaggaucccgggaugggggugcaggccuucgguuaucauagacuguauauguguaucuggguggggguggggguggggguaggguggugugucuaaguucuuucaugucuggggugguguuguagaucgaacuucucccaaacaggcucagccacaccgguaggacguagucucuuccuguuuugcuuuaugauguuccugucucuuaagcugaaaagagccccugaaagccacuauuuaguugccuauacugacacacaccugcgauuggauggaucgucucacacagagaguuaugcaccauucauagcuaaccucagggccgggguggugcucagaaacacugucuuuaugauauacaugggcuuuugagcucguggcuugugguuguggacugagaaaauugcuuccuggguuuauagagaugguaggggaaaugacccucuugccaccacuuauucagugauggcuuccuggugugaugcuuggggauggaugugacugaaaggauuucaggaguuaauuggaagaguacaucauagcaugcaugauugaucccuaugugguauuaucauuauuagaaucccaaaaaggugaugguuaaaagaguacuuaacuauuugcuggucacuggagagauggaaacacugaacauguuuguccuuauccugcaagagcucagagccuaauauggacagcagaucuguaauaaauauuguaggggaugguagagggacagauucacauugacacaaauuuuuaaaaaguaaauauuuaaaaguaaacuuuuucccuccagaauauuacugguauucaucuucuuccagauagaauaucuaauauaaaaccuaugaaauuuaucaagagaaggcuuaauacaggagaugcuggaagcgcauagauuuuccucaaaucccucuugguacaugugaauccacuacauccagaaucaggccaugcaucuucaccaaaucauucccuuuggggaagucguggcucagugcucuucugguucaggaacacugagccagaguaaaucaccccuaaugguccucucugcagccagugagauuucuaauacagcaagaauucaauagaacaauaccuuucuaagguacuagcuagacuguuaagaggggcuaaugugguagcagccuccuggcacaaaggcaagggucugugguuagugacugucgugucugucugagcagggagaauguccgugagcagaauagcugguguccagaugcuccuagugaacuuuuaucagugagcagacguggccugggagggcaagccagacaguccagccggcuuggagcuggaagggaggaguucagucuuaggucaagauacugugcugagggagguggagcuguagaggcagugggcaaacugggggcucccugggagcccuggaagcagcuuccaccacuuuggauauuuggcaauuggagguggaaggaugccagggaagguguuuggguuucuuuucucugugaaguuauggcagugccaucuuccaaucagccaucaagagagccaccuuuaagagugccucaagugagccaaauuaggggaucgccgggacagaaaagcugcugaggugggaugagcacuguggaucaucuucugcccuucuggaagucuuugugggcuggacaucccaaaugugggccugggaaaauaacauuucccauacuucauguguguauguuucauuuuuuacaguggugcuuuugauaagcaguguaacaucaaagccaagaacugugcuuuccauuucuggaaauaugaggagcccagaggcuucucuuugagauaagagcugugugacugugugagcuacuuaauuucuccaaacuucagugugcaccuucuuugcagggcuguauaaggauucauugagaugcuaaccaugacacacuuggcucacaguggguacuuaguccuugucagcuuuccugcccgucugcagggguggcaguggugccaggggguggcgugcugaacugcaaguucaucugggaucuccugguuguguuuggauuuagcugggguguguccucuccuccuacaccuugagucaccagccaagguggaggagagaggaugggguguagccuguguccagcucucucuuggacaugguugggaggugcugaccacaaguccgaggcccugaaaagaagugcugcaaggaggauguuucuuuccccauuggcacagcaucaagguucucaacagcuggacacaaacaagcuguucugggagccgugucucauuccccuucaccuccugcuugcugccugcuacgcucacuggucaccagggcugacguauggggaggaauggagaguggucucacugacaguggaugucauuguuugcucucucuggaaggaggaugucugaccgaggccagagaccacgcucaggggaccuggacgcccggggaguucaagcgagccucuguccucagugauggaguccugggccacuggggcaguguuugggugcugcuuccacucuggcucuugacaacagaguuuguucccuuugaaacaaguuuguaggaaccagagugugugaggggccuuuggcagcgcugaaggaagggcagcuggaaucuuugacccccucaggcccccgcuggccuggcuagagagcucugccuggaaggggaccucuguugcugggcaagggaaggcaccuuuggcuuuaggaagccugagggucuugucccuguccugguugccagggcucugccuagugccauggaagggaagaccagauuggaagugauucagaagccgaauaaaugaagagcgugacagcacuugagagucuuugcgcaugucaucucauuuaauccccuaauagcagcaagggcgagaggcuuagacauguuaggaagcuugucacaccguaagcaagacagccaggaauucugaucucaaguccagccaccccugaccaucgcagagcucuguguguguguguguguguguguguguguguguguguguguguguguguguguguguguguguccccguccgucccgagcugugugugugugucugugugugugugcacgcgucccggagcgcacgcacccaucagugaaugcugccuccacgugggcaaggcauaugcguuuuucuuucauuauucucagaaacaggcauccagugcagaacgggccuguaaugguugcugacuaagugcuuaauggagauguuucugcugauaagccucaguugaaaagggaaagacgcaggcaagcuggccaacaucaaagccgggcuuuguuuauagauaaggguagguuucauucuguggguuccagagccccuguccccaaaucucagagggggugaguuuuaaacagaaacuguguuuaucucccgcagugggcuggaagacaggccugcugggacucagaagcuucccucccucccauccucccuuccuuccuuuuucccuuucuucuucccucccucccuucccagauagcuagccacugcccucauuuauaacauaacauaaauaaugcucucucugccccagcuguuuccguuugguuuuuguucuucacauauuuuauucguacuugauuguggguuauuuaaaguaauuuggaaaauaugaauauuaaguagaggaaucuggagaagaggucacagaacuguaauggacccaagcugcaaaaaugcaaaacacaguguguaaccauauguguguggaccuucccucuuaguuaaaacuggccaugacaugaugguaugccccucuuaacagguguuucaacuagauguaaccaaguaauaaguagcuucaaugauugggugaugacgauuggacuaaauuguaaucugggcagaaguauagaaauucaacaguuuuaagggcauuugugauauauguguauguguuacuuauguguucuucaggacacagauggggccaaaggacaaauuuucuguguuuucagcacuggggugcaugagggagcaggugucggccacaccaacacauauaaguuguugccugcggguacagaucaaugaauucuuuccuguuacuucauggcucagaggaaagaaggaagagccagcaaguuaagaucauguauaugacguagagcuaauccuuuuaaauuacauguuacagcacuucagguuuugauaugcccaggacugagguccuuuuagguuuucagaagacugagaauucuuaggaaccuagacagggccucuguuaaggcugagcaagcugcggucugccuuccugucucuucuguugggcagucacgggggugcugaugccagguggcuugugagccuucccacuuugcacugugccugcacucggguggcuuuuuaucaauccgauacuguugcacucacgucccacuuugaggcuggaugaagucaagcugcccgccuugcugccacccucucucauuccagugucucugaccacacucucacuaggcccucuggaaauccccuguaggauuuuggaggagcauucugagaacgguucucuuguauacgcucuuguugucaggacacuugagccaaaguuguuggucauuugccccaggagccccuuuucuucugcacgcucuuuuuccaggggauuucaggguagguucaacacuuuaaguuaccccgcccccuuuuugguauuuguaguggcuuacacgccccagguaacugaaaacuuuuguuggcuuauuaggggcauuuccacauuggagcuguaauccguggagaucaggaagacguuuucuuugggugacuuuuuucuccuggugaugcagugggccagugcaaggaggagggugaguuuaguugcuauacacaagccagguacaagacuuccagagugagagggauaauuuacacccuguggcuauuuauuuagcacaucuuuugugugacucuccagugcuagggacagggaucucaagaugaguaagaccugguuccugcucuuaagaugcucaugguuuaguggaggggacaaagugggacacaggugaugauggcauuacaaugagaauguagagaaccuacaacugcugcaccccucccuguucuucaagaugccuucucuggccaucagggcagcaugugcagaggcccgcugguuuggaauaguguuucuuuccaugugugaugcagcguucccucaaagccgaggcgagguuuaugcacacugcccaauugaaaugugucucauguucacucgcugcuggaucagcagaaccucgcgcagggcacuccuugggcucacgcuagcuacuuugccuuuguuucuucaggccuugcgcugcuuggauugaauuggauucugccacgcugauauuauuaucucacgccuuuaaagccagaauuuguaauaaacuacuaauguucuuggaauaaaggcacuucagagcaugcguagcuugaaauaauucuucuaacaccuagaaauuagccaauuuuacuuuugaaggagaugagaauaaacauuuaguggucagccagacggagaauaaauggccagcauuugagauuuuccugcuccuguuuauggagagagacuggcauguaccuaauucccaacuuguugaucuguuguacccuauuuuaauuauuuugccagauguaaacauuuucccuuuuuugugaacggaguguuuacaccaucuaucacauuuaauguauucggugccugugagugccgaccucuucaaaauuugucgacuucaucauccgugugcuguccagaaaugagaucuugaugccccccaaaugaauuaugaaaagcuuuucauaguaauauaauugauccacuguuggccacacuuauaaaaaaaucaauguuaacguguuaauauuucaugaguacccacguugccagcuccuugcaaugggaccaaacuauaaagaaugagaauuguuucacaguagcccagcacauggacagagugccaagaaagggaguucaggguugacuugaaaguuugaagcgcaacagggccauugaaacacaguccucugacucaugucagauuguuauaauuauuuaaugcccacaaugcagcuuuguccccacggauuuauacuggagagguuucuuacccacacauugugguuauuagcugcaaagaaagcggcguuuguuuauaaugacaugggguauaucuggauggcaaagaaaacacugcagauucugucuucuuaggaaggaggcaggaauuuggcagauaaccuauaggaaauugggagacaugcugucauuacuuuucauauaugugggugguugcagccaauaaccauuagacaccuuuuaguuuucaccuuugucccaaacucuugagagaauggaauugcaugcuuacuuuucaucuauaugacguuauacagcugguaugcccagaguguaucucaacuuaaucuuuuuaaaugugucucccaaaaucccuuucucaagguucuacauccugccuccaugaaauuuggugucaccaacauugucuuacagaaccacuguuacuauuuuuauaaagaguuuauaaauauguuuugaaaaguucucauguggcuagaucucaucaagggauuuuuuuucagacuugaaaaauaaaguuaaagaaguaaggcuuuggggccucccuggggacaugucugguuuggagaucagugguggugcuaauggcccugaguccggcauccggcuccuugggagaagaaaggucauuaagucagagaggaccagucaaguccagcuccuccaaacugcuuuucugugugucuuccuuggauguccucccuucuuccccuacauggaacucucaguugccuuugcugucagaggagguucaauaucaauggguuucucaagcuuagagggcaacagggagacauugaaccacaguagugugaaauuguccgcagguacuuacaagcuggggugugcagaugcaauuuauaauugcaccggaaauacuuguaaccuuuaucaugcuuagugguggaaauaagaaaaucuaugugagucagcuuaguacuaacuugggaccaauaugaagcaacugaauccucuuagguuuugcaagagagcuacaaauagaaagcagacacaaaacauaggcuagaguaacaguaaauguaucuggagccucaaaucaggacucauauauucaauuccuuauuuuuuguuuucugguucaacaggaagucugggagaucuauaggaauuugaauuaccuuuaaugguuuauggggaccagagaaccuaaacuuuagaauugggauuguccuggaaaaucuggaacacauauugacccagauccagacaguggguuauggaauaugaugcagaugaugagccaauuaagagaaagguuugcauuuaagcaucuuccucuuguacuggugacugagugacuccaagguggcaccauuaucaccggugcuugugcagaggugauuuuuuuuuuuuuuuuuacacuuugcugucugaaaugcuuuaaaugauucuuuuaauuaaaaaaauuaguuaccuauauaaauauucacuugguaaccccuucauuuaaacaguccauuuaugccuuaugcacuuguauguguguguguguuguguuucacgguaacaaaguuuuuuguuuuuuguuuugagauggagucucgcucugucacccaggcuggaguguaguggcgcgaucucggcucacugcaagcuccgucuccagguucacgccauucuccugccucagccucccaaguagcugggacuacaggcgcccgccaccaagcccggcuaauuuuuuuuuguauuuuuaguagagacgggguuucaccauguuagccaggauggucuugaucuccugaccuuuugauccgcccgccucggucucccaaagugcugggauuacaggcgugaaccaccaagcccggccgguaacaaagucuuaaaagcggucuuauucuguaauacguuggccaguuuuaaaccauuugcaguaaugcauuuaaaagauguuauuucauagauaacaaaauagcuucuugauuuucaugauaaacauagacuuggagccuuuuucuuuuuccccgauugugagucagcucuuggagggcauggacaguuucucacaccuccugggauuagagguggagaaacagaaugggcugggugggcagagacugggugguuggagcucagggccuggggcagggaguuguggggagggagggugggaaggugaaggggaggugguggcaggucauggggguccacugugugccauacuguggaauauaaaccucuccaucagugcagagccacacagcaaagguuuuaaguggauaaguauguauggggagugggacgugaucugguuugaauaauguauacucaggacucuugccauacaguaauuuuuuucaacccgcuagacacuguugcuguggggaaguggagagugguuucauccauauggcagcaucauggcuguguagcccuaaagccauaggcaccucccaccccacccacccacaguggcauccacaguuuuagucucuaauagcacuuugucuccugagaagaaaagcaaaguuguuuuuccuuucuucuucucucauccccaaagcguucuccuucucacccaaaccaugaucucagaucuuaggaguuacaggucagacaugucacggagccuguuugagaucaguugucuacguuggugaugaaauuauaacacccuaaaagaagacuuuggaguaggaacuugccagggucaucagacaugguuggguugagagaggaaaugcgauuauacaaaaaacguagaauacaaaguagugcuuauucugugaucauggcuacuguuucaggggacaggacuagaagggaacccggacaaagaaaaacccuuggccugugcaggcugugggguugugagugcuguuuccccaaauuaaaauaucuuuauuauugucaugauuuuguugugccauugagguacauuaacuuaaauaaaucaaagcgaacaauuuuaagaugacgaguaagucuggagaaaaaccuaggaccccagaaagaaggcauauuguacaucccagucugcuguaacuuccggagcugcugcugaugacaaagggcuuuaaggcaagggaaguguuugcagcacuuugggggcucuaugccugucugcaugcuuguuuaguuuuugccauggccuguucaccagccugucugcccugaaacugggaaagguggauccagcugcuguccaggccuucaagaagcagagccccauucaauuguccacuucucuguugcugcccagagccagauccugugugggauacuuggcuuuucaagggccuguguaugguguguuguugaguagaaaugucugagaugcuccuuuaguagcaccugauucuuuuggaucagugauuugccauuucuuauaugaaaacgagaaguucagaguuuugaauucuggccccaguuccaucacuuucuugcccugugacccuguucuccucccaaaaccuuucugagucuucaucauuaauaauguuuaauuggaucacaugaaaugauacaggugaaagcauuuagaaauggaaagcacugugggggaauauuuuuguucauaauuguaucauaauguggacauggagaguuaaccuuugucagcgcuuaguuucucagccuuuuuaucuauuaaaugggaguacaaaugauaccuucauuggggguucccugagcaugcagucggaaacuaugaccucuucuggaggaccaugacuuuuauuuuuugacucuauaguguaggaacaucuuaauuaaagauuauggaaaaaaaugaaaaauggguuuauaaaaaaaugcccagauccaauuucauguauuuguaaacuauugaucaacaaccuguguggaaccuauggccggauaugaauuauccaguauuagcauugauaugaaugcuuuuaucaauagagcauugauaaggcauuucauggaacacacaugucagcucguucucucacuuuaccuaccuccuccgcugucugccuccccucugccuuagaucuucucccuccccuuuucucuuuccucuuuuccuauacucucucuccuuuuucucuuuuccuuuuuuuuuuuuuuuuuuuugagacagagucucucucugucacccaggcuggagugcaguggcgcgaucuccgcucacugcaagcuccgccucccagguucacaccauucuccugccucagccuccugaguagcugggacuacaggcacccaccaccaugcccggcuaauuuuuuguauuuuuaguagagacaggguuucaccauguuggccaggauggucucgaucuccugacccauuauccgcccgccucggccucccgaaguguugggauuacaggcgugagccaccggcaguugugcugcaacuguagagaaacuagaggucuaauuucucaaauacugguccucugugaauugaaauauagauccucccucacagauauagauucggugacugaaauaauuauuuugaaggaaccauugcauacgugacauacuuacugucagauaaagucuuuggagggagaugggauagugugugguguccacccugucacuucugccagggcgagggcucacauaauuuauucuaagcuucccauccucagcuucugcgcaggaguacaauggaagaugggggguggaggccuugccuguggagccuugacugggagaaggacaaagaaggcauguagcuggagagguccagugcuuuuuccagggcuggaggcugggagguguccucaugcacuccuauaagcuaagcagaagccagagagcuuucccuagucaugcagcucacaggauagugugcaguagagcucugcuaaaggaccuucaguuuuaagagcgccuucacuccguaguaucacagauaaaauuagcauccauauuaguaagcccaacccagagaaccaugcaauuaucucaugauuuuauuuaaugacugugcucuuuucacagcuuaucaggguaaucuuuggagcauguccugauuacauguuguacagaccauaaaauaagugaacuuaaaaagcaauucaaagcuagcucuaauuuaauuuauaauuuuuacaucucaagacaacauuuuuaguagauaauuguccaguauuugguuuuguuuuuuuguuuuuuacauaugucaauuuuuacuugucuugcaguuuccauucccccagcacaucucaucuuugcucauagcagcgaagaagagagagcaucuguccugguucuccuucaccuugcuaaucaggcuaucccccucagcucuucagggaauguauaaugacaaauuagaccuuguaggacuugugcauggagcuucagggucuuuucuaaauggcaaaccaaaguggccaacacuugcuagcugugugaucuugaguaaguuacuugacuucugagcucugauuucuugccuuuaaaauguucccacuucauagguagugguugauucacaagguugccaugaaucaacaacguaccucagugagguaccuaccugugagaagugccuagucccugaaggcguuuggaagucauuucccagggcaggucagauacugaggcuucccaggcugcuguacaggugggcaugcuggggaccuucucagacacccuggccucuuuuucuuuccaucuggcacaagagaugcuuuuucuaguugggacaugcaggaggaaagagagagcaggugcuuccuugaugugaauaauuuauuuuuccuucagaucauucugauaaugcaccaaccuuuggaugggaaaaggugcaaagcugggauaugcacuaguguuacaucacuggaguuauguuggggauauguccagugucagauuuuuuuguccaaaaucccauuagcagaggaaaggaagaagauacauuuccuuggcaacuauuaugucccaggcacagagauuacagaggcaggagugacaguuguugagggauacaguggguaugagagggagggauguaaacugaagaguucccaucauaaaaugugguagaauguucacaaaggcucaccuacccuaccccagggagacauuuauucuaauuuugggggagacuaagugauuggggcuauucacuucuccgagacaccagaaaaugagaacgucuguaaaauuaagaauaugaacucuaguucugucugcauuuccaacuucuucauuguuuccuuucucacaagauuuuaaaucccuugaggaagucauuuuucaaacaguauuuucugugaaauccccaauuguaaugucuacuuuauuuacuccuccacucauccuuccuuaucagguuuauugcauaguauaauggaauauaugaaauuaaaaauaacuacacuggacacugggcucugcauacaguaaauauucagccguugucugcagacuugccuaaguguguacgcaguaguuauucuaggcaggugcugugcuccaggcuggaaguuguguauaggauagagagagagggugccucagagcuggcaguuuccuccagcagucaaauucugaacacccagcuaugccucuugcuggggaaucuaaacuuucaccuuucagagaaaacaaggucuuuggaaccaguguguucuuucaaacaauguuggauacugcccgauuguuuccauccgggaaccaaguuuucaaaaagaaguccggcugcuuuguuaagauaagagacuguugugugaaaauugcugagugagagcucccacuggaggcuccuugucuuccaggccauuaccaguuuacuccuagcugggugaugggggugaggguuggggccagauugcuagagccccauuccugccaguuccucccaguccugaacucuggggugaguagaagguagagaggguugauggggccgggcuccuggccuggcagaaccgugcugaccuggagccuguucggaagcuggcagugauugcagucucucccggacuguugcugcccuuguuugcccucccuucuguuuccuucucucuacuucgagcauucauuacaugagauggugcuguuuuuucauauauuuguuaugaguaauuuuaucuuucaucuauuagaugacauuuuugauucuguucuuaauuuaaaacacacacucauuuuuuaaaguuucuaaguacguuuuuuauuuguaugugaucaugguucaucaguauaagaaaauauuuagccaguucuguuucguaaagucuucaagaaagauaauagcuuggguggacugcuucuucaugcacuuuauuaauguggcuuccuguuaagaucugaagccaggcagagauguccacuuuugcuacuuauauuuaaaauuguacugcagguucagaaaucaaaggcauccggauugggaagaaagaaagaaaacucucuuuauuuucagaugaauugagccuguacuagaaaaccuaaaggaacacaugcccaaucccgauucccccaaaguacgaaccgacuaaugaguucagcaaccuuacaggauaaaagauuaguauacaaaaaucaauuguauuuuuacauacuagcaccaagcaaucugaaacccacauuaugaacacaauucugaggaauaaauuuaauaaaaucagugcaagacuaguuuauugcuaaaugagaguuaucccauguucauggauuggaagacucaauauuguuaaaucuuccuaaaaugauuuguagauucagugcaauccuuauacaauuuuaguaugcaucuuuuuaaaaaaaauugucaagcuguuucuaacaguauagaaauguagaugaccuagaauaaacaaaacaauucggaaagggaagaaaaaaagauuaggggucuuauauuucuuaguuucaaaacuuacuacaaagcuauacuauucaaaucaguguguuacugguguaaggauagacagugguguaagcauagauaaugguacagaauugagagucuagaaauaaaccauuacauuauugucaauugauuucucuacagagguaccaaagcaauucaaaagcaauucaauucaauagucuuuucaaugaauagugcuaggacaauuggauauccacaugcaaaaaagguaaauuuaaauucuuaccgcacacgguacauagaauuuaacucaaaauggauccuaggcuaaaguguagaagguuaagcuaaaucuuuuagcacaacauaauaaaaagucuucaugaccuugaguuaggcaaagaguucuuagauauuaaacuggaagcacagcaugucaaauuacuuuucgagaagguuugcuagcucauucagugggugaaaaugggugaaaagugagcacauuauuuaacuauauucucuuguuccuaguuagguugaacauauuuuuacuuaccacucaaaaauauuaccacuuucugggcucuuguaggucucugucacaucuucgaacucaccaaaccuuucaggagaaaauaguuccuuggagaaguacauaaaguugugggacuuuguaccuuggauuacacuuucccugucaacucuggguccuccauaguggggaauccauagugguuuuuguccugcaaauaaaacagugugacuaaguaauuuuccagaaaugaacagcagagugggaaauagacauaagugagaguaauauaacaaucacggugugauaaauuagcaugggauuugaaaucaaccuguuuggguucaaaucaugguucaccucuuaccgguuuugcaaaccuugggucaguuacuuaacuccaucaaauccuucacuucaucugcaaaauagagauaagaaaauuccuuuucucuuaguguugcuuugagcaucaaaugaaaaaauguguguaaauguuuagugcuuuguaccuagcauauaggaacccauuauuaaguaauauuacaguuuggauuucagaccugugagcuuagggcucagacucuagagguuccugaacuagguuuuccuaggcauugcauguagagucuuaucuuaaaaaaguuuuaauugaaagauuggcagcaaauucuucuugucacuucagacaugauuuccuuuggggcucuuguacucccaugguuugaauucauagaguaacucaagggcaauagggaauuccucucaacucucugucuccaagaauaccucugggugcuggagagaugccacuuaucaauucuguuguuauuguuuuuagggcuguaagccuucuggauagaacucaguggauuuuccugaguagugaagaauuaagugagaugagggaaaagcauugagaguaauuaucagcaguggacuaugccugaguuuuuguuagcccugaacuuacauauccugacuuuacuaguccaugaguucuucauagucaggaacuguaccuuuuaauucucugcaucuccuaggggcuuucucagugcuaagcaaauaguaaauauucaugagauacugggauugugcccagcauuuucugaguuuucaaauagaugaaguuauagaaucauauucauaucaaaggaaguuccuguguauaaucucauuucauucugucaacaacccuaggcuugggguggguguguugguguggaugagaacacuuaguaucccuauuuuacaaguaggaaaaguaagacccagauaaguuaaugacuugcuaaaaaugauacagcucuugagagacagcagacauuugaaucccaucuacugauucuagguccuauggucauuccuuugcuuuauguugccuguuuugcagacugucaaacgcaucagacacuuccagugguuuuucaguggguuuuuguccuagugacaguccacacauccugcucuccuauuaucacauuugcaggaggaagugagacaucuuuugacacuggugauaugggagaaggagaaaaauccuagaaucaaagauacuuacuccuugcuucccucuacucauacucucuggaaagaaacguuuagggacuucuuguguugugccuguugugccaggacagcucaaauggaugcuuuugucacagccccuccaccuuuagcagaaguuguuguauuccuagccaaugcaaaaauaaacaagugagggaaaaugacauuuccugguaauggaaaguagcaguuggugagacuuuagacaagaagcggguguuccagccaaugagcagugaccacaguggagcuaguugucgguuuacuuggcugaagaauauguuugccugcauccugauugucaauaaagacguuuaaaaaccccagcuugacucuggcgggcugagggugcugccgugccacugcugcaggauggagcucucuuccugguggagacuugauucacaaggacgcuaauuauucauucuuccuccgugcagcccgcugaaacaauugcugugcuuguucggugcacaguguggcgucggacagucaggccuuuuuauguaacugauggcgcuguauguucauauuguucuuuauguacuuauuuuauagcuuaugcagcagacauucgagucaauuagcuucuugucuugcaaacugggcacugcuguucuagaaccaaguuagaaggguguguugagggcgacccgggcagaccucucuccuuucuuuuugugcuguguggguugguuucaaguuacagcauuuuuauuggcucuuguuugcugaaccuugguuucaaaagcugauguuugaguugaauuucuuaaagauacagcuuuuguuuucacaaaacugaagucaggcaauaugcauagcccuugggaguguggguuuuuuuuuuuuuuaacugagugauuuuuuuuuuuuuuaaaugguaccuauuaaccaaaaaaucuaagcgaaugguuuccuaacucacuuuuccuuaacuggcgucagcauggaguccuuguuucuuauugauuugcauuuuuuuuuuuuucuguauagccuuacuccugacucuuuuguccugaauuuuuuuuuuuuuuaccccguauuucuugaaaccugccuguuuuggggacaaguuggaguuuaaauaaauuaguuaaauucuguuguguauauuucugcagaugauaauguuuaugaagcauagauucacuguuuugugaggauuuuuaaauaucggaaagaaaauuuccugcuuccucuuuccaucuccuuuucugugguuuuagcccccucgcccuuaagagccaucgguuuguuauugcugauugagguaguggugguggaagcagaggcucugauccagagaaacuccccaagacggaagugcagcaggcaggauuuuuauccagcggauuuugacccaguagacccuaaagaaggugcaugacagagacucauauuuaccauaccauugaauucucagagcuuuccgugguggcuggcccaaggcaauuguucaaaacauacgugagagaaugaaugaacaaaugaccuugccuaccaaacgucucccucccucuguguaagcaucccuuaaacucucccaacccagguggccuugacauaucccaugcucacccaggacccugaaguaugccucggagcaacugguuucuccugaccaguuagugucaacugagacuaaugcagaaaacauugcuuacccuaauguuugccuuuagaaguaaaauccaaacugaaggaaaggaccuugaauuuguuuuuuauucuugcugacuuggaacauugauaaugcucauacugauccucuggcuaaacauuuuucuuccuuuauccauguauuuauugagcucuccacuguuagcaugaaagguggagaagcaggaauacauggugugugcuucugcuagccuuuuacuguccaguuguagagaguaggcccagugaacucagucagguguuuauaagauugagcaauugagcaguugcuguauccugaagacuguaucuggugcuuuacucuuguauaauucuugagacaggaauaccuggguguuggcaucaaggggcuguugaggccaucuuuauuucuccauaacacccagcacaagacauuuacauguauggguuggguaggguaggaguucauagcuguccauagagcagggcagggacauuucugagaaggucagagagguuugaugaggugauuuuccugagcugggccuugggaguggagagauagagggagaacaggugcauggacacagaggccagaagggcaucagacaaaggaccccuggggcugugggaaagcccccgagccauugggaaauagaggagcuuagccuugcuaagaggagagaauucagagagccaugaggugauugagguuucaaagaccaaauaaacaaaggaagacagcaucuuggggagugggcaagaccaugccucaccuggcaggugaggucagaggauaccugaccuacgaagauccacaaaggcuggcaguggggggcaucccaguggacaguguugugaugagcaaggggcccagaaguaggaagacuuaaggaguccuaggccuuaaggaagacucaacccaaaccuggcuaccucuuuaggcagcuugagucuuggccucuccuaccagcuccugaaggguagcuucauguuacaucuggcugcagagacccuccuuuuuagaagcaggcagggaguggugcccaggcucucaggaccuccucuugucugggagacugcagccuccccacacgacacagcccagccccuuuguucuugagugccugcugcucacguggucuuaauaaacaaaaucuagaacgugcucauccuuuaaaaaaaucuguuagccugguuaacguguauauaauauguauaaauauauguauauacacuaauuauauauaaauuauauuuugugucaguuauauuugcaaucacacacacacacaugcacgcacacgcacaugcacaugcacaugcacauucacauuguaauuccuauuuaaagggaaaaacgagccaguuuuuuaaagggaaaaaacaagcaaaagguguagggagagggagacacccaucucugcccccauccgcugauucucuucccuuuucuauccucccucuggcuggguuuacggacaggcccuucuuccuccugcccuucaucugccgcaggaccucagugcuggugauggugagcccaugacccuccuucucucuuguucucugcucuuguggaggcuaguuccagccguucaguuccacugaagcaacugcuuuggcagacgaagcucucucugccugaaauuucuuacuuucuuccuucuuugguucccauuucaccacuccaugguuccuccuccaggaagccuuccuugucugguuuucuuccuucuaacucuccccagcccugucuaaaucuuacccuucuucagagcccaucucaaauuuuguuucuuccaugaauucuuuccuauagagcuuguccuucuccugcccccucugccagcugagggcuuucuucuuucccugaauucccccagugcccugagcugaucuuagaucugccuuguuugccauuaauugaggaguacauauuccccccaaacuccuugagggcagaugcucugccuuauugucuuugugucuuaaaaaucuugcucuuguauagucaagaaauuauuguuugaaaugguuuuuaaaaauaggguucuagagguguuuuuguuguuguuguuguguuuuuuguuuguuuguuuuaccaaaggaaaauauuccaccuggcugauauagugagaccuuaucucuacaaacaauuuuaaaaauuagccaaguguggugacgugugccuguagucccagcuacucaggaggcugaggugggaggauuacuugagccuggguggcagagguugcaacaagccgagaucaucaugcugcuguacucuagccuggugacagagugagacgcugucucaaaaaaaaaaaaaaaauguagagucucaguuugccuauaauauuuauauugcacaauaauacauuuacuuauuuuuuacuuauugaaauaugccacuuguuuuuaaauagcauguaagaugcagauauuugcacuuuuaauugauaugccaggcaggagauuuacugcucucaacagguauuaagagguaggaaagcugccccccggcaaguuucuuagcacuguggaacugauccuagugccauggugaguaaguggcagaccucagauucacaccacgucucugacucccaauaaaccacacuguccccccacccccaacccucauggugauuaaaaugauuacuauguacacacaaaauauauuagguuacagguuuuuuguuuacaauucuaagcuucuaagcucuguucauuuguaucuucauaauuugggggccuaugaaggauuguuuaucccuaaauugaaagcaagcaaacuaacaaaaaaugagaucaaacauugucagagacgguuguucaguuaauccaagcauucaacaaggguuauaaauacggcauagaagacuagggggaaaaauccaaguuuuugauaaauuguccucaaagcuaaacuguuucuuagcaaagugagaaaaggcauaauguucccaagaccaaauuuaaucuauacauucuugguaagaccuuauuuuucuccucuuuccauuaaguuuaagguuuccuucugcuucuugcacuaaucauuaauaacuauacuguugucacagcucaaaacuuuccuauugacacuucagucauuuuuaaagaucuugaauguucaaccucuaugaagcuaaccuuuugcacucuauuaaaauuuaagaaccauuugauucucagugaaugccccagcuacuggaucaugaaagcauuaccuugugccaagggcaugaugcagaacacucauuccuuuuuaacaaauaagaagaaguuugacuuuucauuuacacauccugccaauugcuaacaaguuuccaucucguucaaacaccagauugauccuaagaaauugaaaauauugauuuaacccucugucugauuuguacugcaggcaccugcuagugcagucuuagcacauuacaauugcuuggcuguaauuccucaggggaccacuaauaacuaccacaucugucuuuucaucuuccgaaauuaugcuagcaguuguccaagucaauugugauucauuugauacugcucuccuucaagacauauugcaaccaaauagacuugcucaccaguaauauaucugaugacauaguuaguucuuguuaauugacagaaugauucaggcuuuuauggauggcauuaauuggucccuuguguccaugcaauaauugaccagacagagaaggcagcauuuucuuucaccaagucaggagaguuuugaggugagauaaauguaguaaggaugacaaaaugucuauauuuuuaaucaagacuuuaucaaugaguugaaaaaagaagauuuggggggaauucagaucaucuuaauuaugaacauugcauugcagccugcagagaugugcugaaaugcaggucugccuucucuuuggccuccuugugcugaauauuuuaaugcaggguacaacaugaaucuaauauaugcaaagcagaagagugcuguaccugaacuaagauaaugaaaaaggagaacuauaaguagcuuuguuuuucuuuugacauucaucauuagugacccaauagacugggcauguaaaaucugaaaauguggaauuugcauuaccuccugcuugcugagagagccagaacguuaguuacauuuacuccuguugccaugcuacuaaaaaaaaaagcguugguuccuuuuuuccuacaggauaaaguuuucauauauaacaauuuucacaaacugccuccaccauuuauucuuccuucccauuuggucacacagaauuaauauuuccaaguuaugguaccauuuugucccuuuuuuguacuuaguaugcucuuucuuuaauuagucauuuuauagauucccacucauucuucaagaaucccauaggugccucccgaauuucucaaaccaaauuagcugcccccuccuuguguuuacucauuugguugcuuauuuccccaacuagaccuugagcuugccuugggcgugggcugugucuguuugcuugacacaggcaguuauguaaggacuuaauaaauguuuauggaauugaguugcaauuguugcauuuugaggaaugagaauuuaagauuugaauccgagagagaugacuuggaucaaacuagaugucaagcaaccuguacuuccaaugugaauaaguggcugacgaccagcccuggggaauaauuauaauuugguguaaaacaaaccauuugagguguggaagaugaauuagucaguugacguuuguagaggggagggugagauaugaguuauguggaauagauuuucugguguuugauuuacuuagacuauucuuuuuaaaucauuugucacauaggauagacaguggcuguaacagauauccauggaaacuuuggacuugugaacaucugacaugaccuccuuuuaagggcagugcaaucugacagaccugggcugaaaucccagugcuaccauuuauuagauuuguguuuugagugagcuccuuaauuggucugaggcuguuuccucaucuguaaaaugaaaauaaugacagccucuguugacuuuuaugauaguggagagagauguaugggaaguguguugcacaacgccuggugguauacaguagacacuugauaaaugguaccuguuaccaauuaaagauauuuuuuguuuguuuguuuguguguuguuuucuuguagggauggggucucacaguguugcccaggcuggucuugaacuccugggcuccagcgaucauccugccucagccucccaaaguauugggauuacagagguucacaccucugugcccacucuuuuuuuuuuuuuuucuuaauuuuaaguuuguuuguagaggugggaucuugcuguguugcccaggcuggucucaaauucuuggccucaagcuauccuccugccuuggccucccaaagugcugagauuacagagcaauuauagauaaguuuugacucuguuucuuccugagaguucugaaaggcagaggguaaauacaauuguguauauagagaaaaugcuuuagaguuuugugauuuuuuuauauugccucuaguugcacaaggcugaccaugucucugugacaauauauaucacuuucaugggguucagagcuucuuguuauagcucaggaaguuacagagggagauugggagcuaaugcaccaaaaccggcagugaguauguguaauggggucaaaccuuguugguuuuuuuuagcuacaaagcagcagaucggccacugugauagaauuugauuuuuacugguuugggauagauuccuggugaugcugauaguuuauuacccaauguaggucuagaauuuauacuugcagagcauuuucauauuugugggagaauaaauuuauuuggcucugagguugguugguugguugguuugagaaggaguguugcuccgucacccaggcuggagugcaguggcgcagucucggucacugcagcuucagccucccaaguagguggaauuauaggcucgugccagcacacccggcuaauuuuuuuuuuuuuuuuguauuuuuaguagaguagggguuucgcaauguugaccaggcuggucucaacuccuggccucaugugauccgcccgccuuggccucccaaaguguugggauuauaggcgugagccaccguacccgguggcucugagguuuuuaaaugguaacacuuaaguaaacaaacucuaguuucuuucuaacauauggcuggccuagaagaauguguuauuuuuucauaaucuacagguagagaaauagaagaagagaacuucuauucaaagaggcaaacucagggauucugaaugccuuaaugcugcuauuuggaguuuuauuugaaagcauuaauauuuucuuuuuggggguggauggagaaaggagaggucuuagucaacggguacaaaguuucaguuaggaggaauaaguucuagugaucucuugcacagcauagugacuauaguuaauaauaauguggcguauauuucaaaauugccaaaagacuagguuuuaaauguucucgucacaaagaaaugauaagaauaugagguggcagauguguuaauuagccugauuuaaugauucugcaauguauacauauaugauaacaucauaugauaucacaaauuuaucugucaguuagaagcaaaauuaaaaaaagaucuuuuaggccgggugugguggcucacgccuguaaucccagcgcuucaggaggccgagguggguggaucaugaggucaggagaugaagaccaucccggcuaacacggugaaacccugucucuacuaaaaauacaaaaaauuagccgggcgugguggcgggcgccuguagucccagcuacucgggaggcugaggcaggagaauggcgugaaccgggcaggcggagcuugcagugagucaagauugcaccacugccgucuagccugggugacagagcgagacuccgucucaaaaaaaaaaaaaaaaauuguugcuuuucccgcgaugaugaauaaaggggucacuuaguguaguguggaugaguucaacuagacugcuuccuccuaaccccaaacuggaaucguuauguugcgagcaugagacuuuagcuuggaggagagagcggguuugguaauuuuggaaccugguaaacuuuaggggccuuaguaaauuucaaauauaugcuacaggauugcuaauuauagucaacuugcuguauauuaaagcuccagaauguauuuauuuuugugccaccuuucaguuucugauuucagucccuggaaaaccacccauucuugugcugacuauuccaccaacuaguuuaucugccuuagagguuauuuugguaaacuuucacugcaucacggacuuagcaggguaaaagucggagaguaaugguacauuugucauaacaagaaaaagcggaucuauuuuucuuuggcaaagaucaccuuuggaaaguguuguauuaugaaaugcagaguuaaauacaacuaacucagcuuugauguguccuuuguuaacguucagccucuaagcgcaaguugauuaaugaugcacaucccacagugacuuuuucucaagcccagcaaacucauauauacccuaguguauaaaagcaaacaacuuaauuaacuuacucuucauccauaauuaucuugaaauuaacuacuuauaauguccaaaaguuuaugcugcaagcauauuuaaaaaucuguugagaguaaaagggacgguauaauugguuacccucuuccuuucuugcccacuuagcuauuaauaugaaaaguagcuacuccccucauacucuuuggcugugugcuuaaaauuauuauuauuuuaauuucugcaaacaagaaaagggcuuucuguuauuuuuucauugagccccugcccugggccaggcaucggguccucaguaacggacagggcaguuuuggcuacuguucucaaugagauuagagucucuuuggaagcuacagauagguuauacuagucugguagggcugccauaauagaauacuggguggauuaaacaacagaaauuaauuuucucccaguucugcagccuggaagcccaagagaucaagguauuaacagguuuaguuacuccugguaccucucuccuuggcuuguagauggccgucuucucauuguguccucacacggccuuuccuuuguguucacgcaucucuggucucucuuucucuccuucuucuuccuucuuccuucuuucucccuucucccuucucccuucucccuucuccuucuccuucuucuucuccuccuccuucuucuuccuccucuuccucuucuucuuccuucucuuccucuucuuccuucuuucuuccuucuucuuuuuuuuuuuuuugagacugaguuuugcccuuguugcccaggcuagagugcaauggcgcgaucucaucucagugaaaccucugccuccagaguucaagcgauucuccugccucagccucccaagcagcuggugccugccaccacgcccgcuaauuuuuuuguauuuuuuuaguagagacugguuuucaccauguuggccaggcuggucucgaacuccugaccucagaugaucugcccuccugggacucccaaagugcugggauuacaggugugagccaccgugcccagccuaaucuaugggauuuugaagacaauacugucacuuaaugacuuacaacacauccucaugagaccuaauaacagaaguucuggguucuguguuaauacgggacuuccuuuugugaaacuuguaauacacucaggagaaaugugugacaaauaggauucuacuuuuuaggggcauuuggagcacuguauuguccuuggguaauaaugcuuaauguggacgaugcuacauggccuccaagaauaucccuaggcccuugauccuuuaagggagaaaaccaaccuuuacuuuucgauuguguaauugugaucagaauagccucugagauauaaauuccaaauauaucugaauugguuuucuuuaauuaagaauacuuuuggauucaaaucauacuggcagcaaauuaaagacauguuucauguguuuacuaaauguuaaugaugggauuacuuugaagauaaauuuuaacauuuuaaguaaaacguucauguaaaacaaaaguuuauuauagauugguuuuaaaaugagcacugcuucagagucaggauauucuuaguaaacccacaaguguuguggccuugugcacgucuuuugguuucuuuuugcuuucauuuugucaucagcaaaauugaaauuguuagaugaaauugucucuaaaguguuuucuagagccaaacauuucugauucucuaauauuaaagucucuaagagaguuucucuaagcccaggcaguacaguuaaaaauauuuucguuguuugcuuguugguuauagagugauaauauuuugcaauuaggaagcuuggaugagaaaccacacacgugacauaaaaugguuucucaacagaaaaucugugccgcucaaacuggggaaacagacuuauaaauuccuuuugacaaaagacacgucaccacacaagcaaguuaggacagaacucugagcauuguuuuucauagacuugggacaauucccaaauauucuuuuuucucaaaacaauauuuuucauuccaauuuacuuauuaaaaaaaaaaacugggagccgggcaugguggcuuacgccuauaaucuuagcacuuugggaggcagaggccaguggaucaccugaggucaggaguuugagaccagccuggcuaacauagugaaacaccgucucuacuaaaaauacaaaaauuagccgggugugguaaugcacgccuguagucccagcugcucgggaggcugagacaggagaauugcuugaaccugggaaguggaggcugcagugagucaagagcgugacacuguacuccagccucggugacagagugagauucugucucaaaacaaaacaaacaaacaaaaaacaaagcucuuuuugaagaucacgagcuucagaaagaaauacugcauccacucuguccacauguuucuggccuguccauucaguuaacaguuauuaugucccaggugcuaggcuguguccuggggacugagguaacagaaauuacaggauaaagcuccugccguguaguaguacuuuagggaguaguagagauguugguugggaaagaagugaugccagaauguggcggggguuaucagagcagguucagaacguaaggagcacgaccagggaaucacuaacuucgcguaauggaaggguuuguuucaguuggauauuaaaagaugaauagaaauuugcaggcagcaacaagaguuggcauucuagguguaguaggggacuauaugauagaaagcccacauugaagguaaugugguaagacucauuaaucuaagaaagauccuucugguuguagccuuaaggaagggugagagugggaacagauggaaaguaaggaaaacaguucggaggcagcuuuaagagaccagaaacgggccuggcgcggugguucacgccuguaauccaagcacuuugggaggccgaggcgggugaaucaugaggucaggagaucaagaccauccuggcuaacauggugaaaucccgucucuacuaaaaauacaaaaaauuagccaggugugguggcgggcgccuguagucccagcuacuugggaggcugaggcagaagaauggcgugaacccgggaggcggagcuugcagugagccuggaucgcgccacugcacuccagccugggcgacagagcgagacucugccucaaaaaaaaaaaaaaaagaaaaaaaaaagaccagaaacgaaaucgggccaaggcaagaaggguggaagguggaugagucugagagauggauguuuucacuauggaaugguuguguaaggauggggagucagaagaagccaugagaagcuugugagaguuaagaggccauauucaguguugugcugguaaauauaaccuccuauaauuaaauuguaaagaggucaguccaaauucauguacugggguugaucguuucugcguaauagucuuucacuuaacuuuuacucauuuucacuuucacgaaauaaauggccgugucuuagccugggggccuaggucugggguucggcugugugcucuuccugcaguuuggaagugccgucuauguuaauagauauucccaacucugcagaucuucucucgaggcugaaggggccccauuccuaucagaagccucucauuuuucucugagguagaaaaacuaaggcauagacuucauagggaaguuuauaugcaaaugguggcuuucugcacgggccccugugaguggagugggaugagauacccaguggcuuucagaguucugguggauauuugauugcucuccauugguaguaacuuuauugcuuuuauagggagaguuguacuggaaauuugcccucccuguccuucagcugguuuguucccaagccagaccugucugaaaauugaaauggaauacuuuuucucaucucaaguuaucaguuguagcugucaggaauuuguuacugucugcuaaagccuuuuaacaugaaaauacgcuaagggcagugcaugugugagucaugugggaaguuacauuauuuuauggaugcagagagggacacagacccagauuuauucauaggugaaaggggaaaaggaacagaauuuaaaagggaaauccugaaaaauauguagccucuguggcucugccucuuuuccuaccugcgucucuuauacaccauggauagaauguaagcucaguggguacagaagagcugucuuuuuucccuccuuuggucuucuuagcuguccccaccaggccaugccuauaaucggugcuuagcaagcuacuggcuuaagagagucucugucugcugugagugcagcuccugagaugguggggauggaugcugguuaggaaguguguucgcugccuuagcauaaagaauaaguacaguuuuucucgauuauuuuucuccaagggaaacucaauggggaaugucgguuucaugcuguucuuggagggguugguuuagaauucucucuggcuuuucugagaaucccuccacauucccccuccaggcugcugucaugguagcugcccuucuuucagcuacuugcauuuuuugggagauaugccaucuuccuucaguuugcacccugguagcuuagcuccuucaguguuuagagggaaaugggagauggagaaucgaagcacacuagugcuuucugguguucucugcauguguuuggaaggaauguaaaaguagcuagggcuuaucgugguaucauagcauuauaggguaugagaccuuuggggaaacugaggcucacaaaggcugauaacuuuaccuagagucagugacugcuaauggcagacuccuagcgucuguacuuuuccacacuuacccguucauaugaaauagucugggaaggucucuuuuaaaauguaucgugaccucuccuauaaaccucaagguuacauauguuaaagaaauguagucggcuuuccucaugugccgaauucugaaucaagcuuacccaaacccccaaaucauuuccacagagcagaggaaaaaaacaaaacaaaacaaaacaaaacaggcaaaugugaaucaugggaaccuauuauaaugauauauagcuugucauaacacauuauaauauuacagcaaauguauuuaacucacugaacguucucagggggcucuuagcucccuuuaaaaguguucuccaaaucucugcagcaagauggagcugccuaguccaccucacuuuugaccaaaccaccguuacgagaauaccuauugaaaacccuuacacuguugcuguuucccugggcuuaaaaguauguuugguuuugucaguaccuggaaacaggaaguugagauuugaggagaaaucuuuggcaguugugcacuaagcuugcgggaguuaggagucuguugccacggaaaccacacugcugccucauuuauuaauggaggcuuggugaacuuccggagauacucuuagccuguccuguaaauucauucuagagaaaugcagggugacuuuuaagagauuucucugucguuucucaagcauucucuccugggucuucaugagcuccagaaaauugcuuguaugcagguucagaaccacugauuuuuaucuggcaagcaugucugaaggccguuuccuuuuuuucaugcuuaaaucguguuuaugccugccugccuuguccaauaagugaauuuuuuuuuauuaugcugccuuuaagaauuacauggauuucaaaugaaggaagaaggaauacaaaaaugaacuaaguaaauauauugaaaaccuucugacacuaacuuuaagagaguuauaagcaucaaagccuuuucuaacuuuuaaaauucuaaacuuaaaaaaucuaaaaugaaugguuuauuucuucuaauuccagugagauacuuuaagaacauuugucugagacauuuucaaauuuuguucuaauuucacuaaacuaacucuauucugcuaggcagaguaacagcauuggaaguugcuuccaggaaaaaaaaaauuuuuuuucuagcuaauuguuuaucugggaggaugcaaauggugguuuuaaguccuuuaagucauccaucaugccuggcagccucuauugucucauuguuggauuugagccaagucaggcccuuucuuggucuugggagggugcacauagaucuugcucugccaaaucuguguucacaaggaguccgagcccagcucuaaggguagguaauguugucagaucuauagauccccucagauuggaaaagaucaugcauccucguuccuuaugucacacuaaaguagaaaguagcacucuauucaaaguagaagugacaggacuuguucccucaguucuuccagugucuacgaauuacuguuaguuuuuaaacgcauuuuuguggauguaauaaaauacuguuuauagucagcuacgaaguaaguaauuacaaugcgggaaaugaaauucaauauagcuuuguugugguuuuuugaauuuuaauuaaaccagucuuagaguaaauuauaaaugcugcugcuuuuguugugacaagugacauugacaaaauauuaaucuaauggauuguuauucacaaaagcuaaaucuuuucaaaucugcaggguuugguuguuuauuuuguuuuacuuuucaguuuguguuuuaaaaagucuagagaaaagaauaaaguuuuaaaaccacaugaaauaacuccauguauggaauauuucauuguugaugucuugccagccauaauugcaugcaucucauuuauggcgcugaaaacuuguucuuuuuaaaaaucagauguuucuguggucacuuuuuuguuauuaaaacuggagccggguuaaauaaccaaccauugaccacgaagccuaauauuaaaggaauaaucagcccauguuccuauuagaucauuuccguuuucuuuuacuuuauaaauuaccuuguugcuuaaaaaugacauuuuguugguugugaaguccucuuauagcuaaauuauucaaguuauuuucuuuggagauucuuuuaacuugaauuuauauaaacuguaaagaauguacauuaaauauucagaaacuuuucuuuaugccaguuucuuauuuucacccaucaugacuuaaagcuuuuuuuuguuuuagcauuuuaauguuuaaauaaauguaaauaauuuaguuacaaggucuuuaugguagugccgccauuguuuuuaagaagacaaauuuuaauccaagguuaaaaacuucacauuugcuuaucucuuuuuccucuuaagaacuaagaguccagagauuagaguaaaaucaccuuuuccucauaguuuuuucuuucaacguguuagaaauuccuguuugaaaaggaaagccaguuccucccccuuuuuauguuugaggggaugaugguaaaaucacauuauucagucaguuuccacaugugauuuguugccuauauuuuuuaauccagggauuaaauuguugccaccaccagcaucaaaucauuggggggcagggguggggaaggugcgagacaguugguuauagacauccaaauaugacgacagaaaaaucuccacagcaauauggcaguggagcauuugcugacuucagagugccagaucaaccccaauauuuuuuucagggaugcuaaaccucuuguaacugcuaaauuggauuuguuacugaaugaaguaucagcugcuguuggacaagaccauaaaagccagccggcuggcccuuuguaggcagggcuuacccaacgauugauauguuuuagcacuuuugggauuauugugauuaagaggaaaccauucugaaugagugagcaaaggggguaaggacacacagcccacagcuggugagcagcauguguuggcuccaaggaagucaccauuauggcuuucuccugguuccugcccugauugacguguaugaaaucuuuuuuuuuuuuuuuuuuuuuuuuggagacagggucucgccugucgcccaggcuaaagugcaguggcgcaaucuuggcucacugcaaccucugccuccuggauucaagcaauucucugccucagccuccugaguagcugggacuacaggcacccacuaccaugcccggcuaauuuuuguauuuuuaguagacacgggguuucaccaucuuggccaggcuguuguugaacuccugaccucaagugauccacccucggccucugaaauugcugggauuacaggcaugagccacugugccgggccuagaauuuuuauaugaggaagugguguccuuauuuucuccaguugcagcucucucugcagggaaagagacauuuggaauguuguggacuugagaacucugaaugcuuucaaagcacuaucgugugugugugcgcacacgcacacacaguagcuagaaguguuagucuagcacaggaguuaauugaguuaauguguagggaauucaguaauaacaacagagcguccucuuucauuucccagauccaaagcucugugacaugcauuaacaauauaccuccauguaguuugugucucagucuguguacacgugugugauggcuaaaugggaacugcacagccaguggauuugugaacuugagcacuugcaccuggcuaaggguuuauuaaguguggaaaccguacuguuguuguaaaacaguuuucaucucaagaaccaccugccccuuuuagcgguggccuuuugcacgugucuugcacuagccaagacaagucuauccaagagggagcuuguggaguagguugguguuugaaucuuucccaguacucccaaaugcacauagaauuggucgccucucugggugucccagggggcugugccccgcucauguucagaguuugcucagcauaccacacaggaaagaggccggcuugccagguccugcggagcgccuuuccaagccugugaaaggcacgaaucauccagcagccgagcaugcuuacagcuggcccuuugcuagcuuugaucugcgaaucaggccacaccaugaaugcacuuauugucauguuauguguacacagugugugaauuauugaaaauagggaggccugagccucaucugguagagauuacagugcaggcaugcugggcgaaggucuguaauugaaaauccccagaugcuguuuauuuggccuuugucacaugaccugcugcaggaagauugucugaacaaaauguugccugcauggagaguggagcccgcccucccccaccccccagagccuccacaggcucagucugugcacagcuuaaacaccugcccaaaggauuuuuaaaggcuuaaaauagauucacucauagcauuuaaauagagggcaucuugcuuguugguuuaaacugcuuaagcgguuguugacuuguggaaccuucuauccacacaaggguuugcuggauaauuucacucugagauaucuuuacaaagcaacauucagggcccgagccacauaaguaguuugggcucugccuuuuuuuuuuuagaagucaaacuucuguguggugaaugagcuugcagauaaagcuguguugacuguauauauuccuucugucuguagaaaauauuguggguacugagaauaaggcccugaguuagcaugucugacuuccguuuguccaguucauucuuaccuauucugccuauaaacaaguugagguguuucuuagaaaauuuguuuuucucaauuaaaugcugaauguuaugcucucugucagugguggauugaaguaggauacuaaaucugaaauugaugaagaucacaagaauuaaaaacagggaagauugagcuaauuuugaaguaagaagggcuuuaagcuuuccagguucauucuguuagggaacaaaacagccacauguccucuuucauugccagucugucucagcugugcuuguggcuuccucuuugauuucuuggagcuuaagaagaggaaagauucauggguauuucugcauuccauaagcauccaacacgacugugagcuccuugaaggcaggagcccuguugcauucuucuuugcauccccagugccugccaacacagugcuuucucugucuuccugcggcuucccccucccuuucugccugcccauucaaagaagacagucacugcgucccaugagccaugaugucauauauucagauauuuuuucuuucagggagagacucaagucaacaguagcaauaucauuaaguagcacauucuucaugcagggccagagguugggaggauggaguaguugggaguaggauguggguccugccuucacaaagcucacaaucugccaaggaaaaagcaaaaacaggcagaaugugguguagcaagcuugugcuagcagugugcacaaaguauggugagcaggaggggcagacccagcccacugcuggggagugaguggaggaagugccagcugcagaggccuggcagcucaggaaucauucauuguucaguagauuugguggggugggggugggggugguggccauuucacacaaaggaaauagcacccaacaugacaggaauaaggauuuuuagagacagaaguguguguagagaguggcaggagaaaagacaaaaacugauuugcccauguaacguuuuaauuuuuuacggauagaauguguucauguguuaccuagaucauuagaaauuuauuuuauuuuauuuuaguuuuuagagacgggucuugcucuguuggccagguuguucuugaacuccuggccucaagcaguccuccugucuuggccucccaaggugcuaggauuauaggcgucagccacugugcccagccuagaaauuuaaaaggagaagaaaaaccaagcagcuguccugaaucuaagcucaacugaggaaggugauuuucuugguuugcuuggucaucaucuccagugggaacccuauaucauaggccacugcuuucucugucgugacuagcugguaugggguuaccucuggcugcuucuaguuuugagauaggucugauguggcuagggcaguggggucagugagccagagcauggcaacccuaggaggaaacaucucugggcaccugucucaggcccuuccugaguacaucuauccaucuaaucguuccgucuuugauuaccauuguuuggcuucuagccucauuucucuuccuagaccauaaacuccuugagggcagagaguguguauuauuccagcguguuucucuucuagagccuagccuaauuccuuuuguacagaaaauauucuauaaauuuuauugaaugggagaggaaagugccuuggggccagauuauguaggccuuggaugcuuagagaguugaggcuuuauucuucuguauuguggaugagaaauuagagaacuuuaaagugauguguguacaauucaguccauuucauggcuggauucugccgccaucuaagauuuuguucucauuaaacacuuaacaguuggucuaauguuaaggauuaaggaacuuggaagacaaagcuggguucaaaucccgacuccacugcuuaauuaguuugggaacuugggcaaguuucuuaacuucuuugaacugcaguuucagcauguauaaaaugcugagcuagguagaauuaggugaaugugaagguuaaauuugugguguauaagcacagugcuuuggccaggugcaguggcuuaugccuguaaucccaguacuuugugaggcugaagcaggaggauugcuugaggccaguaguucaaaaccagcaugggcaacacagugagaccccaucucuacaaaaaauuaaaaaaaaaaauagcugcguauaguggcacacgucuguaguccuagcuacucaggagacugaggugggaggauugcuugaaaccaggaggucuagguggcacugagucaugaucacaccacuguacuccagccugggcaacagagugagacgcugccucaccaaaaaaauaaaauaaaaaaaagcacagugcuuugcauagugcuggugcauaguagauacacagugcaugucauugcccaacuuucuugcuuuuuuuuucuuucuuuuuauuuugagauggaaucucgcucuguugcccaggcuggagugcaguggcacugucugggcucacugcaaccuccgccucucggauucaagcgauucuccugccucagccucccgaguagcugggauuagaagcacaugccaccguguccagcuaauuuuuuuguauuuuuaguagagaugggauuuugccauguuggccaggcuggucucaaacuccugaccucaagugauccaccuggaccucccaaaagugcugggauuacaggcuugagccaccguucccugcaaaagcccaacuuucuauagccucccaccaucucuaaacuccgcaauaguguuucauuuagcuuauucccugaauuucaauuucuucaguuugaguucauuuuaaaaauguuauuccuucucaucaugcuuuucauauuuuuauuagauuacugagugccuagacauuuagauacuccuucagcauguuuucuaagcagcaagucaucccugagcaugccauuuugacuuaaugcuugcauaacuuaccuuuguguagcuauuguuguaguagcuucagaaguugauagaauucuucuggugauaguuguuuuuacaacaagaacuaaauacuggacguccagugagggacaugcuguuuaaugcaacaccuccagccuauucauagacuuaauuauacagucugucacaaauuuuaagaauuuuggcuauacuuaccuucuggcaaaaaccucauuccugcuauuuauucaguggagaaucuauuucaaauuaaaagauuugugcccucuuaauguuaagauagugcccucuuaauguuaagauaucacaauaagugcucuguuuacuuggaaacaauuuuuaggaccaugucauuuugaaaauugaagaagauacaaagauuggaaaagauguucaauuucaacaacauuagcaauagaagcaucauggguuuauaccagaugccauguaguacgguguccugaacagaaaaccuuuuucaacccuuuuaggacccuauauaucaguucaagcaacgaagacauauaaaccuggugcagugacauuacauuacaguuaaagaacugggccagguguggugacacaugccuauaaucccagcacuuucggaggccgaggcguguguaucaccugaggucaggaguucgagcccagcaugaccagcguggggaaacucugucucuacuaaauaacaaacaauuagccuggcgugguggcucaugccuguaaucccagcuacucaggaggcugaggcaggagaacagcuugaacccgggaggcggaggcugcagugagccaaggucgugccauugcucuccagccugggcaacaggagugaaacuccaucucaaaaagaguugaaggaccauuuuagagccccagaaggugccagagccuucccauuuucuguuacuaaugcauacagcagcccucuagaguaggaacuguuauuuccauuuuacagguaaggaaauagaggucuagagaaguugagcaaguuucccaaguucacacagcucauaaguccaguuuccucagaagaaucuaggcagucauaccuuugagucaaaaaaccagaaaucggcagcauugcaucauuaaagauucuucauuauaaacuagcgguguuuagcacuucaaauguguggauuucacacuucucuaaggccaaauaauuaauaaauagagugcuuuuagcaaaccuuuucauuaauaagacuuucuuggguuaauguuaagauuagcuuuuuuuggaccaggucucuauggcuguggcuuggggaaguggcagggacauggguauagggcaugaagaagcaaugagcaugcauuggucauaagagacgagaacaaaggucugaaaaauugugccacuucucacugaaauaguugcaacuuuaaaaggauuuacagauuucaggugauauuggcagugcugucuaauuuucauaaucuuuuucuagaucuuuucuucggauuuucuuuauacaaaagaggugagcuccuucauucauuuauuaaaaccauuuauugagcgagacacggaaagaaaaaaacuauuucaugaucucacuuauacguggaaucuuaaaaaaaagucauacauauacagaguagagaaaaaacaacaacagaggauacuaagaaccagaggaggagagaggaaacggauauguaggucaaaagauacaaaguagcagauaugcgucuagaggucuaauguacaacauaaggacuauaguuagaauuaugcuagacacuuuuaggaggauuuuaacuauugucgucacacacaaaaaauuacuaugcgaugauagcuauguuaaucuguuucacuaugguagccauuuuauuaucuauauguaucucaauaucacuuuguaaacuucaaauauaugcaguaaaauuuauuuuuuaaaaaaauggcugggcgcaguggcucacaccuguaaucccagcacuuugggaggcugagguggacagaucaccugaggucaggaguucgagaccagccuggccaacauugugaaacccccuugugucucuacuaaaaauacaaaaaguuagccagacaugguggcgggcaacuguaaucccagcuacuugggaaguugaggcaggagaaucacuugaacccaggaggcagaggugagcugagaucauuccacugcacuccagacugggcaacagagcaagacuccaucuccaaaaaaaggaaaaaaaaaaaacuauuuauugagcacguacuuaauagcuaccagaucuggggucacagagaaccagacaggugcuuuaccauggagcagucacuauucuaggagguggaugaauagucuguagauaaguaauggcagugcagcaguagcaggggugcaugcucaguacuugagguuacaaagcaggaaaugacuaacucaguuuggauggcucccacagacauuggggaggaaguguuccagguaggguauacaggaaugaauaggacuuugcagguaaaagagaagagaaagaacauguaaggauaggugguuccacaaaggcauggagguaucuuuggaaaagaaugacaguggucuggggaacucuaugaagagccacauucuagaauagaggagcccuauacaggagugggcucuuagcuuuagguaccagacuaaggaguuuguguuuugcuuguaguggaugagaaccuguugguauaggaaggcaacauaacuagauguggaggugaaagaaaagacaaaugccugcaagaugaguggcaggacauggugggcgccugagagccuguggguagcagucuauuuaggucacaguugggggcagcaaguucaggcuccauuaaaucucaucuuuuuuuccuuuuuuuuuuuuuuucgagacagagucucacucuguugcccaggcuggagugcagcggcgcgaucuuggcucacugcaaccuccgcccccuugguucaagcaauucccuugccucagccucccuaguagcugggauuacaggugugugccaccacgucaggcuaauuuuuguauuuuuaguagagacgggguuucaccauguuggccaggcuggucucaaacuccugaccucaagugacccacccgccuuggccucccaaagugcugggauuacaggcaugagccaccaugccuggccuccauuaaaucucaucuacacuuuaaguguaugggauaccaagaugugaaagacauggacuguaccuugaagaggcuuguagucuguuacacagggaacucagcagagucugauugugggcgguucccugacacaugaaguaaagaacuaugagaccaggacagaauggugaagcucaugcugcuugccuaguuaagagucaagccaucauuccccucauauacuaagugacuuguuuuuaauucauaguacuuuuuguuucacuuuauaauauuguggucuuucccaguugcuggucuggugaagugggcucugggcaccuggcugucuggcuuaccccucuucauacacuccaugucuagcacauguuucaggcacguuucaggugagguuucuuggaggggacaucugagcuggaccuggaaagauuuuccuugguggucuuaaggguuauugcagcuauaauaccuuagcauggcaggguggguucagggaacuggaagcuugguagguauuuugauggugguaaaaugaauuguggugguggucguggugguggugugucaugaaaaauaguuaggggccagaugguggggacaacacugaacaccauacuaaagcaguuuauuccuuuagaugugggcaguaggagccuuggaaggucuuauaacugagaacuguguuuuagguagcuguguagaggauggauuagaaagaaaaaugaucagaggcauaguuacagugguaaggcuagucaaacuacucauuagaggauuaagaaagugauuauguggcguaucuuuauugccucauagagaaugagccacuaagaaaacuucauucauauuucuuuuucaucuagaaauaguuagaacagaaauaacuucuaucuaacauagcaguguuguauucacuaugcagccuuaaacauuuuuacuugcucaucucuuucugaccccuguaacccaaggcaaauguguaguuuguaagcgguuccucuaagaugcgggagaacacaguguucuauggaguugucacaugauaauguuaucagcugccguugacugauacaaacuccugagaaggugggacuugaguuaucgccagacacucacuggcagggauaugagauagaaguucugaguaaccaggaguuaacacagccuuucucuguauguucuuucucugaaagcuguuuuuuuuaauaagccccugggugaaugcagacacauauuaucuccagggauugcuauuguuuaccuccugaaggccgucaguccuuuggugaacuucuaguuugggaacaaguaguaccagccccugacaacccugaaugggcggccuggcuguuucuggugauuuuccacauuggugcugauuucuggucaaugauuuauauugaggauuaacugagaacuuccucguuggauaugcugugggacugguucagaggcuguuuuucaugagccuguccuuacaccuaaucuuagccugugccccuucucccucccuggcucuccaucccucucacucugucauuuacuccaucagucuguagccacugaggaccugcuguguucucagcacuggaugcacagugaugagcaaaacccaguuuaugcucugggcuccuguggacuucucugucugguaguagagggguaggcacauguucaucuuauagucucauucagauaaauggaacacaguagcugugcugugugcugugaccgagaggcguagguuccugugagagcacauguuagggugaucugaccaguucucauggguuggaguucuuccaaacaagacauaagcaccuccaaggcagagauggcguguuuucuuuuucuuucuuuuuuuagacagggucucacucuguuguccaggcuggaguacaguggugugaucuuggcucacugcaugcuugaacuccuggguucaagcaauccuccugcuucagccuccugaguaccugggaccacaggcaggugcuaccaagccuggcugauuuuuuuuuuuuuuuuuuuuuaagagauagggucucacucucagccaggcuggucucaaacuccugggcucaaguuauccuccugccucagccucccaaagugcuuggauuacaggcgugagccacugcacccagcuugagauggcaucuuuuuacccccauaauuuuagcauguuucuuguguuccauccacacacaguccaugugugaccaguggaugacuggccagcuuccguaggccuccuuucuuuuccacuauugcugggacaaguugcuauggcauccguguagaagaaaugguuaauuaguaacuccucacagguuaguuaauaaauguucuuuacugcuuccucuggcaguguccacagauacauaccuccuagaucuucaggaagauggauggggagauaaaacacccccauucuguagaccucucccaagacagugacaugugguuuccucaguguccccuucaucuauacuuuuugguuguuggcuugcuugcuuucuuuuuuuuucuuuuuucuuucuuucuuuuuucuuuuuuguugagacggagucucgcucugucaucaggcuagagugcuguggcgugaucucagcucacugcaaccucugacucccugguucaagcgacucuccugccucagccccccgaguagcugggauuacaggcaugugccaccacgcccagcuuauuuuuguauuuuuaguagagaugggguuucaccauauuggccaggauggucuugaucuccugacugcgugauccaccugccuuggccucccaaagugcugggauuacaggcaugagccauugcgccugaccagguuguuggcuuucauauccuaaaauauuuuuuuccuuuugaugaaccccagcugaugaaaacagacuucaugggcuaagcacaguaguucacgccuguaaucccagcacuuugggaggccaaggcaggaggaucacuugaggcuaggaguucgagacuagccugggcagcauagugagaccucugucucuacaaaaaaaaaauuuaagaauuagccaggugugguguaccugccuguggucccagcuacuugggaggcugaggugggaggaucacuugagcccgggagaucaaggcuacagugagccaugaucaugccacugcacuccagccugggcaacagagcuagaccuugucuuaaaaaaaaaaaaaaaggaguggugggggcauaugacuagaaggcaguuuagcacugucuuguagaaucuugccugagaaauuucuuuguaaaccacucuccccaugcuuugugcugaugccggcauggggucuccuguggaagacaucuuucuuugcuucuuuccacuggguuaucuucuuccuuuuuuuuuuuuuuuaacuuuauguucaugaucuggugccaaauugggacuacagggauguaggagccucuuuucugaccugaagaaugacucgguccauaaauguugagccaccugagaaagggaggcggagaagagauccaugucauugguucuuguugccaaggacuuuaugacuugguugcaaucaugacaugugcugaaaugauaucacauaaggcagaaaaaaauacaaguuaccagcaaagaagcccaggucaaaggcugugaauguuuagggaaaggggaggccuccaccagcugguagguucaugaaggaugaggccuugggaagguaggcagauuccagacaugcagaaaugggcaaggacaguacaggccaugacagcaguugugcacccagguacaaaguucaagguguucacaggaaacauucgauaaucuaguaguacuacugggcugagcgggguggggggauauguagaagacccuuguuugauguagcuuuggucuagcagucaagggaaaugaguuuucuuucugauuuuccuuguuuuaauauggaagaacgggguggagaauccucacacauccuucccagugaagggaaagggccagcagauguuuccuuagagaagccaagcuagagcuuccuaggcccagggcaguccaguccuucaugggugugaguuugccuuaggacuggccacggccagggaagagaagcauugcauuuguugcuucuuucuugguggcucccugacuccauucaauuacaaaguggcucuuacacuguuaaagcuugagugucucugggcuacaauuucuagccacagaccuucauuugcugugccucaaacaugaccuugaggccacaucacauuauauauacagcccacaacaacguuaaccagucuucuaucugguaaggcaagcgcagugcaaacuccaugccuuucuucugggaucucucucuguauugccccuuuagcaggaaauuccauggcaauccaagaugcaagagaagccaaugaugggcucauuucgaacuguguuauauuauuuaggaaaaagaaaauaaaaugaaauaaaaacuagauuacagugccuggugaggaucacaguguaaaagugacaggucagguuguguuuguccuugcugcuuaugugcagccggugggaaagacaagggcagcuacaacuacagcaucugaggcuuaaagaggugacauguugugcauuucuaaaauaauuuuuauguuguagagaagcuuuauaucucucucugacucacuggacaggcgugguguaaggcagaaaggaagacgguccccaggugacugcaggauuguuuuaggaaaauaauaaguaacuuaaaguuagcuuuauugaaagucauuuuuguagcaucagguuuacugaaucaagcaucucucucucucugucucuguguguguguguguguguguguguguguguguguuagaagaucauggcugcaacaggacuaugcugcauagcuuggagacccacuuucaguuacaucagugauggugcugcuuaucuucuggcccuuaggaaaugcugcgucuuaguaacaugaucaaaauccagggcuguggaaucugugagcucaccccuuuggagggcagggcuguagaaauauacauaggggccagugcgguggcucaugccuguaauuucagcauuuuaggaggccgaggugggcggauugcuugagcgcaggaguuugagaccagccugggcaacaugaugaaauccugucuuuacaaaaaaauacaaaaguuggucugguaugguggagcaggccuguagucccaugagcuaccacagucccgugcuacuuggagagcuaaggcagaaggaucacuugaaccugagagguugaggcugcagugagccgagaucgugccacugcacuccagccagggugauaaaugugagacccugucuaaaagaaauaaaggaaauagagauaggacuuaggaugucguaucagggccgcugacaagacucuccucagaaccuaguugauacaccaugcauauacaaucccaaacagccaaaaagaucuuccaaaauuguuuggaauggcauacuucuguaaauggguaaguauaauuaaauucuggaaagauuuagaauuaaacauauaaaauuuuaguagaauuagagccauaguguuaauguuuuugauuuaaaggauuuauguauauuugauauuucaaguaauuaaaagaaauaauuuggccuagguaacagaucagccuguauuuccaaauuaaaauguacaaugaaguagcucauuuagacauuugauuugggggaagguugaaauuguacuaguuuuauaagcaacauuuuagugcauuuaagauaauuuauuagguuucuaagacuuguuuaagggaagauuuuauaauuuaaaaagcagguaguucuaauauuuaaaagaaauaauuacuuauucauggcuugaaacauagaugaaagaaagaacauggguuuuugaaaagugagcuugcucaucugaaaagcaaggacaugagagugaagaugagcuuucaaugaaauaaugacuacagcguaaugcccaggccacaguacucaguaaggaccuguugaagucauaauuuuuagaagucacugaacaacaggauacguucugagaaauacgucaucaggugauuuuagucauuguuagaaaaucgucaaguguacuuacacaaaccuagauggaauagccaacuacacaccuaggcugcaaaccugucugguguuaacuguacugaauacuguaggccauuguaacacaaugguaagacuuggguaucuaaacauaaucuaaacauagaaaagacaguaaaaacaugccauuauaauuuuaugggaccaccaucauguaugcagcucauuguugaccaaaaugucaucauguggugcaugauuguacuucagucaaagugugaguugacacuguuuaacuccaaggggugccauuuguauaggcugugguacacagucaaauagggcugucuuggauauugauuuuauucauucaacuccaagugcugcaagaaauuaaaaguuagucagguuaugugucacaucuaucaagguauucugucuguuuucccagaaaauaaacaaguuugaggguaggagacauuuuugucaucuggacaagguucggacaaaauuguauguaauacagagcccuggaucuauuucgccuuggccgcucaaauagcccugaacaggaugcacagugaggccccagguuggaggaugcuuggcuugucugcagacauugucauuuagcucuggcuucucguaauuagguacuccuagcugggcucuguugucagcgagccuucaagacaaauugcaaaaucuguacaaccaucugagagauggagaaguagauccaaugauacuacaggggauauugguaguucucaaaaguuugaaagagaaugcuuagaaaagcaauccucaaaacugaauuuagagguucuuguccugugguaaaaggguucacaggaucugagaagaucuugcaggcaggaaugauagacugaaucuaaggggaugaaauggaguagaaaaaauguaagguucuguuuugaggucugaaaaucucagcuaugcauuaaaaagacuggaaacagggguagggacauaucagaagacgagcccguaugaaaaagaccuaggaguuuaaguuggcauauauugauaauuuauugugcuccuuaaaaauuuaaugcaguguuuggcugcauuaacagagguagaguauuuaggaugagagagguaauaaacugacucugaugcuauagcaggagcacugccacaguucuggacuccaagcuuugaaaggaagacagacaaaggauggucacaggauggugugugggaguguuccaaagcuugucagauaacaaaguaacacaggagguuuagcuuguguacaacuccaagaggaccccagagcugcuguuaauaucugaaaggcaguuaaauaaauaagggacuggacuucuuguuaagaggaacaggaaggaucuggggaugaaaguuaaagcagacccccaaaaggagggucuucuuauucuuaaauauguucuaagauagaaugggcuacuuccucaauuuuagaagugcugacuaaggcuuaugaggacuuucaggaaugcgaauggaugaccuagggguacuuucuagcccccagauuucaugauuccuuugccuuccagugaugaccauguccugcacagucccagcacuggcaggugguggacagagccaugacucuaggacauucuaggcagugaugagagagucuucgcaauucucagacaagauuucccuaaggacauuuugauguucgucuucaucaguguuuccaguucuuuacucugcuagggaagaucugggggauauggucacuuccuuucagcagaggcuguguuauuuccucauucauucuuuucucugugcccagcagugugcuaggugcuagggggacauugaggaagaagacagaguucuuccccucuucaaguaugcaguauaucugggaggaaguaagacaacaaacacaaauuuuacaacuaacuauaaaguuauaaauacaguuacaguuuggguacauccuaggaagaaguacaguuuuugccaccauggggguguagaacaaggcaaccaaaccuaguugggcaauuagagaagacuuccccaagggagugacauccaagugaggccuugaaggagaaauagaaucuagcacaauggucucaggcuggugaagcacaugagugaaugccacagcagcaagcuucagacuuguucuugaccaaaggaauuuuucacaaggauagagcugagcugauacaaagccagccaacaguagugcuaugaaauggugguuuuccauuuacuguagaaaguauguagaaauaauuucaguuccugguauuagagcaaguugaagucguaaauaggaccugcuuagaagaacccaugucuuguaugagugguuuuuauuucacgugguauuuugguaauacauucucugcuuagcuucuggggauauuuuuuccuaucaugguuuucugaagucagguugucugagacuucucaguuuccuggugggauagggcuagaagguuuuuguuuauacuuuugggcauuguucuuuccccagaagguuauauaacuuggaggagauugagucauuuuuuucacugacuaccuuuagggggugucugccuucguacuguuagcuucuugucauuguccggcuuccguggccacagcagcucguucguucucuuguggcugugauuuuagcuggaguaaacuaugaguagaaacuugaauaagaaggaaagugaauaugaaugugaauaugaaaaaccaaagacuagaagagaacuggguuuguuuagucccagacuaauccuugucuguauuuguugcuuauaugagugacccaccacccacagcauacaaacagacaaaaaggcacaucuuaaaaagauaaauuucagcugggugcgguggcucaugccuguaaucccagcacuuaaggaggccaaggcggguggaucaccugaggucggggguucgagaccagccugaccaacauggagaaacccugucucuacuaaaaauacaaaauuagcugggcgugauggcgcacgccuguaaucccagcuacuugggaugcugaggcaggagaaucacuugaaccugggaggcagagguugccaugagccaagaucgugccauugcacuccagccugggcaacaagagugaaacucugucuuuuuuuuuuuuuuuuuuuuuuaaaaaaaaggauaaauuucuauucuuagaugcuggucuaaguucaaauuuaaaugccuuucaucuuaauuuuuccuaguaaacauuuuugcagacaauugugcuguuuuauuuuucuaguauuaguaaacacauaguuguaauuuuaaaauucuugauucugaauuuuguuuuuugcuuucaagggcuuuguugguuugguguuuugguaacccaccucaugguaaauucuucuuucuuucagguaggaaugaauugauagccagauacaucaaacucaggacaggcaagacgaggaccagaaaacagguaaaauaacccaccuggaaauugugcaugucagcgaauggcccaaaaaggcauuuuggcugcaguggcuggcuaugcuuuggcuccuaggagcccccaauuugaguucccuguaaggacgucaguguuggagguauuuuaaauuggcucaguuuucacuguucaucauuucagugacccuuuauuauguggucuuacaaguuccuuuuauacucacaugggaaaaugucacugcuaaggacgguguaugaaccgcuccuguacuguauuucaaagcugacauuucuuucccaaaaugugcaccugugaacacugcaaaaacugcaagugcaaaugcacuugcaggucaugaaauuuugagguuuugugcauuguaaaauccuggagcgauuauauauuagucauaauuucaaugaaaaaguaacgccagcagccuugaguauuggccugaauguaaugcuaaaugaugugcguccagggaacuguugcuuuuuaagcgauggcuuuuugucaguagcugcugugacugaaaugaaguuacaacuucaauaccucugugcagagcaguaucaggaauucucugcccuuuggcagagcucugccuuuccucguucuuucagauguaaaacagcccaaaucucugacaugagccaguuuagaacuggaacgaaugagaaauuaguguuuaacuaaaaacaaaaaaaagaaaggaggaaaaaaaaaacccuaaaaaccucaugggugaguuguucacagaaaagaauuauuuuuuaaugucgauuuaugcugaaugauacagcaugaaccuuaaaaacuguaaucagaccaaaaggcuaacuaaaccguggucucauuaagauugagcagcagauuucaguucucuucccagugaggaauuguuuucaugaguguuuauaacggggagaggcuuuucccaggaaugcuacuugugccacagccugggagccuggcugcugagucagcacaaagagagguggccuccugccagcacgcagaggcagcgcauugucuguuugggggaugcuaguggcccucgucaagucagagaaucacagaagaacaaaauucgggugaaaacaaguaacagcaggagccagauggagggcugaagaggaugggggaguuucugcuucucuguacuuaagaaaaguaccaaagcaaauuggaaaaaaaaauaauugaauaauugaagcucaaagacaaaguuaaagauaaaaggaccguuuauuauaaauccuguuuuagagccgcuggagaguuggaaaugggguaaucaccacacagucugagucgcugaacuuuuaaauggaaaguucuacauuucggaaaccaguggaucuaaucaucuacauucugacagugcgggaccugggcugucugcuggucugugagcucuggucauuugcccggugaccccuucacugagggacucuucuaaauuuaaccaagucccacugaaagagaugcagauuucaguggaaucauuguguuucagaagcugggcucggcuacauuuccacgccccggcauccuggggauguuuuuaggcagcaguuggugauaccucuccaaugugaauuuguuguucagcaaauccaugugguuuucaacccagauuuuuaacaggauggcuggcuggcuguauucacacauuucgcuuuguaauaauaugcaaauccacuuggcgcccagucaauacccaaaagaguggaaggauuaaagauuuuuauaagggcaaaaaaaaaaaaaaauagcucugcuaacugggucuuuccauuucucuuugagaucuaauuuacaugucaguauuauuuuaacguuugcuacagaauccagagcucuuaaugagaucagaauacaaccaacagcuucagcuuuuugauucugcagaaugugcuaauuuauggauagucucuucuaaauugagaaaaagggauuuucccuccugauacugagaagcuauaaauauuuucauuuaccuuuacucccaccuuuuuaauuuuagaaugaaaacagccccucucaucccucccaaaauuaguuuuucccagugcccaugauuucucuugggugggaagacuaagaugagucuuaacuuucauccugaaucaagucacugcagugaugacccaguaugaaaagcuuagagcagcgcugggggcuugugucuggcugggacuguguauuccuaacugcagagcuuuguugagaugcaaauaaccaccccccaaccccaccccaaaacccucccaaagaguagcgauuuuauauuugauuuccuuuuuuguuuuguuuuguuuuguuuuguuuuguuuuguuuuguuuccccucauaaacccgaacaauguaggugucuagucauauacaggucuuagcaagaaagaaaguucgagaaauucaagccgccauuaagguacgucuggcuugcccacuuguagggggcuuuucaucuccaugguuacaggcuuuuccuuuguuuuccucccuuccccuacccugcaggugucuagucacauucagguucuugccagaaggaaaucucgugauuuucauuccaagcuaaagguaugcgcuuuucugcuuuuuggcuugugguugcuaugcaucucacuuccuguuuuccauggugacuggugaaugccuggugcugggauucucguaaccuaguuuccuugcaugugagagcuguuuacauuucuuuguguuuaaucucucuguuucuguacuagccucacauuaaacucaaugugugugagcgcguguguguguuugcgugugugugugcguguguauguguguguuccuaauaacaaugcaaaugcagcagagagcuggucuugauaacuuuucagcacagaaacaugauuuuuuuuuuuuaaccuucagauguccaccaagcagccaugggcuaggaaagcuuaaaaaaagaaaaguccagagaugcaaaauugaguagaaauuauuuagaaagaaucauuuccaaaguggucaugaaauuaccuuuuuaaaaaauuuagaaauuauuuuaacucaugcuuuugauguauuuuuaagaagacuuauaaaaaauacgucuuuuucaugcaugucucuucccucagaguauuuucagccagauuucuuccacauugcuuacuacuguuuuuuaagugaauggcgcucuuauuaaaagagaaaucugagcaguggccuuuaaaaaaaaaagauagaucuuagagaugggaaaacucuugaucaaacccauuugcaguuucauuuguacuugaguuugcuuaaauuuuuuuuuacuuguaccucauuuuucagucucaaaauauauuuuauaggaaaaaugggggcauugauaauuuuucauauacaacuucuuucugcuuuuucccuuuauaaaauuuauaauaaaacauaccugacuuuuauuuuucuguaaugcccuauuuuagaaaugcaaagagauuauaguuugcaaggaggagcuuucguuuauaauaaaaauugauuuuggcacauauugauggcuuucccaugugccuuuuucgguucuguucugauauuuuucuauacaguaauuaaauuugugguuuuguucugaacuaaaaaacaguguagucucacaacacuugaguggugagcacugggacucuucccaaaguccuucgacuuuuuuuuaugcaaacaaggcuggcuguggaauaggacaagugauuaggaaggagcauuuggugugcccucugcagugggcagcaugcuggcucgcucgcacguguggcugaugguggcuggcuuuuagcugcacuggcugagcaguuggaagacuaagauaacuuuguagauccugcuuuuuaaccaaaggugcaauacucucuauauggauguaacuaccccaguuuuugcucaaguucugacucuguuucuaguuucucugagcuaaugaauuaaugauguacaaagaaguuuacagauaacaauguuguuuccaucugugaugauaugaauugcucuauuucugcacugucugugugguuccuguggacucaccagggcacacagccuuagacugaaagcccuauaagugaggaauaaagcucuucuguucagaagggauucccaugugauauaggaagcacucuuuuucucacuuggugaauuuuagaguuuucuuccauagaaacaauuuuucuguugcuuuauacauguacauauguaaaaauacacagcgguauuuauguuuguuucuaaaaaaaaauuaacaauaauaaaaaagaaacauuccccugacuuucagcccugggccacucucuuuuggggcaggcacaaggaagagacagaaacagaagcaguaggauagcaacuggcucagcauuuaagcuccaagaaccaccuccgucuucuuguaguuucuuccguucuuuccuaccauauuguucuuggaaaaauggaguccuuuguuuuuccaucugcuaauaccaacugaguguuccaggcauggugcuugcucacugugaugggcaguuaacagccaauauccuguucagggagcuggccauguaaaugggaauguaaacuagaggagcacuuuggguaauagcgggagcagccaaaaugaaauguggggugcaucccggggaugagcuucguggagaguauacuguuaaguuuggcaauugaaagaggaaaggcagccuaaugcgugcucccucauuuaagcucacuaugaagugacuuacaguauucugcuuuuggggcaugauacugaggaaacuggggcugagagaguauaauugacuagucacaaagccuuccuaguaaguggugaagccaggauuugaacucagaucuuuuugcacccuaaacgaaucauuguuuuagauaaaauuuuaucuagugaaggugggagaauguuuucaagcagagggcuucacaccagcacacuguaccuaaacugucaccccucacagucuuuggggcugggcauucagccuuugcuaccagcccuucacuuggcauccacauuuuaacuuugagcccuuggucaaaacguggacuuaauuuggguuggugcugugagggucaucaguaacugggggaaugacaugguccuggagacagagcugcuuggcaccacucugagggcauuaggacagucgcagagagugaggcugucugucaccugcuugcaggaguuggugcugcuuucuuucacucccuccaugagcauuuuaucucaaaggcaguauacuuaaccuuccuaaccagccauuaccaggauaugggcucaacucuguugaugucccagcuccauccauacccccuuguucagcucuggaaucuaauagcacauuugugaggaggcagggacaagcaucuuuaccgaggucaucauggggucaggcugauagccauggucuucuuggccucccacacuagcuagugagauaaacucgcuacagauaauugaggucaucccaaaagacaacaaggauagcuucuggguggguggggagcagaggggaguggcaggaaguauccaagcuuaaaagagacacugugcuuugccugggaagauguaggaaggccuccuggagcagguggcugguggcugaccaucccaguaacuauccuugcagacacugcccuagccagguugguuaccacuucuccacaaacucagacgucgaagggguagacaaaggucuaugguccucaugugaagaccgaaaccagacuugcauuugucugucccucuguggaguuggaaaaguggcuuacccgcaauggaggccacugccagaugugucuuccuggugagucuucuugcuuauaagcuucucuuuacuuuccagggaaggguguggcagaguucuuugggcugguguuuuccagccuuuuuaaaguagcaaaacucauguuuugaauugaagcuuacucccucaaauccuuaguaauggccucuuaggcuauuccauugaaucagguuugaaaagcccccuguuuuaggcagaaggaaaaggaggugucuaccucuuaugcugucccuuccagccuuuacagagagcuccugugucccauuuaaagcccauguuuuuaaauucuguaguuuugaaguucugccauguuccuaggaagaaaacagacuccaggagagaguggucauuugaugucacauugauagaugagucauccuagcuacaaaaguuacucuccugaaaauccguuagaauaaauucuaaaggucagcuuuaugcuucuacuaauuggcaguuguucucaaugugcuuguuuguggacuagaucacccccaaauuguguagacuuaaauuuuaguaaagaaaaaaauuguucuagugaaagucuaagauuucuacguagauuugaacuugaaaagcauaggaaugauuacugaauucaguccagugguuuucauugagaaccuaaguguguucuagguccuuuuguagacguugggcacauagaauugaauccagaguuucuguucuugaggaacauugaacuuuucuguuauuuuuccaguagauauccacagcuagggggcucugcaguagaaauuaaacaggauagugcagaggcugcccaagugaaaagaaugauucauucugggagugagggaauuaaagcuucauggagaagugucauuagaacuaaacauaguugaaggcagagaauuuccauaaaguugggacuaucugggggaccaugaagagcaucauguaauuggggacaugcggugggagguaagacuggaggagccuaagggaagggcccucgauuaucccacugaggagaagggauucaucugugggccuaggggcauacaugggguucauucaaauuuacccucuggaaagaccucgccagccagguuuugcaggauagcuaauaagagggaggccaagcuggagucagggaggcuaauuccugggcugcuuuaagaguggggaagagagucacaggcugggaccaggggccaacccacacccccuggggcugcuccguggcacuuagcacucauccuuggcuggcucccugcuuuggugcucucugccugcucuguagucuuuccuacucauuguguuuaaagaauaaauuauaaguucuguccuuaugaagucugaaaaguguugugugccagaacuuuucagaaagauuuucaauagcagcauuuaaaaaucaacuuauuaaaauuggguucucuuaaaguaaugguaauugacuaggagugugcaucaaaauuaugaaguuuuuguugcaaaauuuaaacaguacagaaaauauauuaaacacucauguuuauacuaucuggaauugaucauuuucauuauauaaguuuuuuuuaaugaaaaaucaaguggcaaacauuauucuguacuuuuuccucuacccacccuccgucuucaaccaaaauuaaucuuccuuucuuuccuaccacccacaauguauuuucuugccacuuacuucccuuagaaaaucaaauccagugaaagcucucucuucucauuuugcuccuagauuuuugcccauugucuuuuucuuuuucuuuuuuuuuugagacagagucuugcuuugucgcccgggcgggagugcaguggcgccaucucggcucauugcaaccuccgccucccggguucaagcgauucuccugccucagccucccaaguagcugggauuacaggcgcucaucacgacacucagcuaauuuuuguauuuuuaauagagacgggguuucaccauguuggccaggcuggucucgaacuccugaccucaagugaugcgccugccucagccucccaaagugcugggauuacagacaugagccacugcgcccagccgauuuuugcccaauuaucuaccaugaauuugugcaauagccauuggcaccaacaugagacuuuuccucuggaauuuuuagcagcuuaagauagacucggccaacaauuuggugaccuuggauacagacccugacugcagaggagagauacgagguucaggacauauaggggaugguugaacuagaaagggaauaaugcgaggagacagugaaccaggagcagagaagcugggagaguagagacaaagcgucaguagacugaagcugagauucaagagcucgguaagauggaaaaaagaaaaaaaaaaaggcauuuguggccagagcacagugauuuuggaaauuaaauuuauacauucagaguuguggggauuuucucccccgccccccccgggguuggggcauuuucaaaauaucuaggacaaggcugggcacgguggcucacgccuguaauccuagcacuucgggaggccgagaugggcagauugccugagcucaggaguuagagaccagccugggcaacacggugaaaccccgucucuacuaaaauacaaaaaauuagccagguauggcagugugcaccggcaguuauagcuacuugggaggcuggggcaggaggguugcuugaacuugggagguggagguugcagugagccgagauuguacugcuguaccccagccugggcaacagagcgagacucugucuccaaaaaaaagaaaaagaaaaaaugucuaggacagaagcuagaguacaaacugcaggccuagaagagagcuuagcuuugaaggaguuguuucuuagugaugggagugcuauguguuugucuccuacucagacaaaacccuuuugacccacugcucucaaggggguagguuuuauagaugacccacagccuguagcugggccugagucuacuucuaaaguagaagaugaauccaugcaguugcagugugaaagaggcuucuaggccuauggaauauccauuuaaaaauccugaggaugcugaguuagaggucucccuuggaccuugugucaccagcugcagcgacagcagugucaccaacaccagcuuuaccuguugucuuccaucucacccuuucccuuaguuuagccccuauuggcgucuccaguggaguagugagaagcagcagcaugucugaggauuagcucacagccuuagaaauuauucucuacuucgaauuguuucacuuaccauuaauucaugaaaaagucauuaacuguuuuuuuaagcuccagggauuuauuaucccagcauguagaaagaaugcagaagcauucuccauguguuaagcagucuuuuuccuacucagaguuucuuuguagaguuccaugcaggagucucuuugccuguauguucaguugcccuaagaaguuguucagacccugcucagaguccuucuuuccccauuagcagcaaaaaggcaguccuuucuugcuguuuucagaagcucacgguagccacagccaaggucugggaagcaccaccacacugugggccaucuccaucuucccaugaagaugggccaagccaccucugguucacuucucgaguguguuuaggugaguguaugacucgggacaaaacuaagaggaaaggaagucuucgccgugcccuccgcucggcaggaauacaucuuaggcaguagauguauucacgucaggcucuggauguguauugaagaaaaaccuguacuugcugacauugcaucaucccaguagagcagaaagagaccugagccccucugauuauguccagucgccggugacuaauuuaugagcuacaugugcucccccggggccauuuucuuguucucgcccugguggccuuuaugauuugauuucugaacaggccauucuuuccaaacugcuguuccuuccaauaggcagagagcuuaaaguucaaauuguugauuuaauucuuuugaguucaagaacuucacuggggcauugcuaaaguccacacugcugaaucauguuuguaucaucacugauuccauccaggaaugggccuguccacagggaagguagacguacuucacuucacucuguguugcuccgugaagcccccugagccacucugcuccuucaggacuuggcuguuagcagugcaggaggcaaggaaagccugagcaacaaccuccuuugucuguguccacaccaagacacuuggccuugucacgggauuugggaaaugauauaaucuuuccuggcauuucccaaucuucagggggaguucuuuugcauuuaugacauauacgcuuucuccucaaagauauuuuuauuaccuuguuuuuaauuuaacugaacgaaaacuaagauuggagacaauuucucaggcuucaguuggaaccacuugccaacaguguggugauggagaaauuaaugaugggagccagggcacugaauauguagauaaagauaauucugugugaacugagccaggucuggauuuucuuuauaagggcaacagaaacagucucaucauucuacauuuuuaucucuucauagcgaaaucccauuguuaauuggccuccaacuuagauaaugcccuagaaugacaucuauccaaaagguuaucuagugaggacaagggcuccugaguauuucaggucccgagcagaauccagcuuggaaagccaguccauuaccuggcccccguagacugcaagcucacccagggccaaggcugcaagcaccauacuaaguacuugaagcaguccugaacaaaaguguuuuuaucuuugauuuauaaauuaggacacagaggcguggaauggcuaacuggcuugcuuagagucacaagucugaaguuaauccagggauaucuggugccacaagccaagcucuuugcaggauguucuucugccuucccaaagaguacugguccaggaugagguucauuuuccugacuuggaaugcuuugcauugucucccuccacugagcccucuucauugugucuuuauguuugaaagaaauagaagaaggacucacucuggagcuuaacuugagccuggagccaguuuagguuccucuggccccuugcugucaccucuuagagaaaagggggcugaggucagaagggugccuucucccagacaccuggauccggcaggaagcuguccuaaaucccaggcuuccugggagagagucaugaggcacaccuaugaguuugcucgucuguaguccucaucuacaauccuuuaugaugugaagccccacaucagaguuaaaggaaacgauguugacaauuauaaaauaccaaauauagcugaguauauuuaaaaaugaacaaugguaaaagccuugaaaauuuuuccuuggaugugaauggagucuuuggcauuuggaaauacaauaaaaugaauuaauugcugcuuauuaggcagcgagucaggagaagcaugaaugugccuucuguccucugcguuagcuguuaccugacugaaguagucuccuuuuguauuuacuccugccuuuucuaaugauaagcaaauuagagaucauagcuagaaaaaaaaucaagugcccuccauccuuuuuccaaaaccauaauauaguucugugauguuuaucugcucaagggguauggcuaauaauugcagaggucauguggagccacauagugcaagauuagaaagaacaucugcaagauuacuucuuaggaaaguauuuuguguuuugucuuuuucugaaaaagugauugugcaagcaaauugcugucuuuccucccuugcacuauauugcugguuaaagcauauuugaagaaaaaccauuuaauaacuaucaagaguuuuugaauccauggucguuuuuuugacuuuacuauuuuuucugacguauuugauggacuucuauaugaauaaauuacauuggaauccuaucuuuaaauucugaaaucauggcccaugaauaaacuguuuggaauauauugauuaugcuguucauuaaaauuccauauauggcagcuaucauauauuguauaugcaagcauguaaccuuuuuauguuaucuuuaaaguuuguucaugguaauaccuauagaauaugagauaauugauuuugcagaauaaucaaaagcugagaagcagaaggaagagaagggaacaagacuccucugauauccagacugauccgugagauguccuugaguuuuaagaguacaccacuccagccaugugcauuugugauauugcuguccuccugucauguauauuacauguagauauuuuccaaacauuguguccauuucaaccauaaaaaggaggcaaucagcagaacagagagcuauagcagcaguagccuugcucuccuucaugaaauaugaaagccuguuuuuacuuagaacaauaacaauuuguaaggcuucaggcugaggaguuuaugcaugacacagccugcuggaccauguagcagaggcagcgagaccauugagugugguguguuggaaauugguuaaugauaaaaguaggguagaugaugagacaggcaucccgagucucaggucaguuggaccguuuguucuuagaacccauccucuuucccaucaaaaguccauagaccacccauaguuccugcuccaugaguguuuucugcauugcaggucaugggcuuggguugggguucaguuggaaaagggagauuucccuuuucuuuccccacuccccaaaacauuuggcuuuuuauguccucauucuuuguaaucuuagggauagagggacggaaaaucagcaauaaguagucagugugaacuuguccaaacauuuuucuaggaugcaauuuucuuauucuugcucauaugcacacgcacgcacacauacacacucagaauauuuccuguaaccuaagacuucacagagcauaauuccguauuaaccuaacaguuuuucagcaucaaacaaugugcucaccuuuguaaaucucauccacaucucagaaauguuggugugaagacaucuuaaaauuagugugguguacaaauguagcauguguuugaauuuaccuagcuucgcuuguuuggauagauuagccuccuccccuuuagagugaggaugaguagugaggauagagucgaaugcuuuaaagucugggauauuaaaccagagugacacagaggagcaguucacucaggucugacacuuagaguuauuuuuucaaagccaggcagguaucucugggcugcaaaugacaauuuagagguccuuccauugaaaucucuuagcuuggcauucuuucaaauucccguuucaggauaagugggucuguaggcagacccuugguucugauuucaagauaucccugguggugcuuauuauuuccagggucacauuagauuuuaaacaaaaacauuuuaauccuuuuaauuuucaauauauauuguagauaaaggggagauguuauaaaaauuaaaugaguagucagaguagcucgaccacaaaagguaggaaaucacugguauagacauuuuaguccauuugcagaaaauugccuauucucaaauagguaggucaagugcagaaagaaccucuacuugagaugaaauuuccuuucuacacuuagcuuucuauuaggacagcagaccaaagcugcccaaauuuuaacauccugcugucuucucacuaguaguuuccuugacuauaugcauugaaaaguaucuguuuauaauggaauuuacccucauagcuacaaauaccuuuaaacccagaaggacauuaggcaguaaugugcaacuuuuaauuuuauaaauaaagaaacuucgaagucauuaaaugacuugauccacauaaugcagcucauuaaugucaggcagggacagguuugaagccaggucuccggacaccccaguggguacaccuuuuauagucuuggagcaaguuggugucauaaaagcaauugauuugcucuccugcucuugaacuccuguuuucauuuagguaccugguagaaugcuggguaaugagagagucaaaccuuacuuuaacagaagaaaaagaucauguucugaagcugugugacauaaacagcaaagauaggugcuuuucuccuuuuccacacugacugauuuccguuucaaaaaagaauaucaaacuuguuugaagauuucaaaugauuuuuaauaagccuagcaaauuucaagcaacucaauaaagcgggauguggagaugcagggaacucauuuggaccuggacuuagaauucaugagucaccccacccaagugugcacaaacagauucuguauuugggcaagcagaagugccucugucugcagaauuucaaauacguggaacucuucgggucugugagaggauccacgauguucuucuggaauggagccaagcccucaaguucuuuuguagcuauugcucagaugugucagucaggcaggcaagacgucugugcugccauuuuccaaucccccuagccugggccccagagaaguuguaaggcuuguucugugcugaggaaggcaccuguggucauaccugagccauuaccucaguuucagaaaucugccuugagagcauuuauaacccccuugguagagguugaguggcuugggggcuggaguccaaagugacuggucuaagagaaaccaauggauucguauugaugucagggugauguugauggggaauggaguuggugugacuagggccaugguuucuguucaugggcuacccucugaggggauggacaagcgaggagcagguaaagccacagaauagccaacaguagauugccuggcacugaggucugcaugugugggcccaguuugucaguuuaucauaaaaucccauacacuucaagauuugcccucuuucuggcauccucaguaucugacauguuucaaaucuuaaaaaaaagguuaguugaggaagcuagcuuuagguuagaacauuugacagauuagcaaauggagccccaagucgaagaacugccaucugauaagaaggagauaacagcagcaaaaggaucauucugagucacucuggccguucuuuugaggcccaggaauccugccagcuucuagggcccuuggagugucacucggccacgggaggugucauuacagauguucauaaugaccuugagcauccaugaaaagcuguuacuugaggcuccuuaguuuuucagucacagccagaguaauauauaagacauaaaaauuaauguggcugggcgugguggcuuacgccuguaaucccagcacuuugggaggccaaggcggguggaucaucugaggucgggaguucgagaccagccuggccaacauggugaaaccccaucucuacuaaaaagacaaauacaaaaauuagccgggcaugguggcauaugccuguaaucccagcuacucaggaggcugagguaggagaaucacuugaaccugggaagcggagguugcaaugagcugagaucaugccacugcacuccagcccgggcaacaagagugaaacuccaucucaaaaaaaaaaaagaagaaauuaauggaaguguuaggcuccguuuucuuuuuccccccuccccucccuuuccuuuuuuccucccuuccuccuuccccuuuucucccucccacccucccuuucuuccuuccuuuucuccuucauucuuuuuuuuucugauggagucuugcucuacugcccaggcuugagugcaguggcuugaugaacacagcucauugcagccuugaccucccagguucaaacaguccucccaccucaggcucuugaguagcuggaaccacagaaguacaccaccacaccuggcuaauuuuuuuuuuuguguguguguguguggagacagggucucucuauguaacccaggcuggucuugaacuccugggcccaaguaauccucccaccucagccucacaaagugcugggauuauaggugugagcagccacaccuggucuuccccuuucccuuuuucuuuauuggcucuuuuucaaagguuaauguaagcuuuuuggaaauucacauugucuuccugacaguuauagggcaaaguaguaucuacacccugggaacaccuagcacaucuuucuuagaagcccuuagcaguuguucaugagcuuugauuuuuuaaaaacuccuuuggccuugcuuuugaugccuugauguguuuuuuucaucaccuuugguuauaucaguaagcauugaagcacccucucugcugguacuuggugucuuagccugaagcucccuuugacguucccuggagguggaaagcacucuuuuuauuuugaugucaccauuuuguuuuugcuuugauggcauuugggccuggaauauagacccucuauuggcaccgguagccuuuauaugccuacgaggcucaaagcccugccugugcccaccgggccugucucauaccaggaggcuauuucucugucuguccuggggaagccacagaaccagugcaaaggaguugagggguaguuuuuuauuguugcuguuguugggugcccuucucaaucauugccuuucuagauagccaucuggaucaccuuuucuuccuaaaaugugaaaaggcccacaccccuaugcauuuuauuguucccaaguauuauauguuuguguacauauauacauauguauauauacacauauauauauguuuuuuuuuuaaccaaagaagaaaaaaaaucccuuuuuaugcaauccuuuuaacaaauuguuuauuauuguauccagguaacaagcaugguaaguauuuucaccaaacugaguauucuguauuuuagcugugcuuggcagacuuuuuuggcuagcuuuguguuguuagccuuggcuuuccuagaaaagacccguucaggaaaaggagaaaccacguaccuguagcauccccuaggcuccuggcuucaguacgaacccacguagccuuagccccacggcggggauaccugagaaagcaugcaccccgccagcaugcugcuuggcccuguuacccccaacccccgcugcuucugagccucuccagccaggugucugcagggcuuccaggccuugcaugaccccagcagcuccugggaccauggcccugugacagucaggacacacagauagggcuccucgagcucuguggacgguccuaccccaguccacagcuacaucucuucucucacuccuccucccauccguuugcuuaaaagcagggccuuuauuuuuuuuucuuccuuaaauguuuuaaguaauuggagaaaucuucuggaagcugacaagcuaaauaaauacguuguccacucuucugagaggcuucacauucuguuggaaaauggauuuaaucccuaaaaaaagccuugccccauugggucuucccaguaaauguugagagguacgguagguugagugugguuuagccuucuggcuguguuauuuauccaugcauguuugcuuuuuuuggccuauuuuguggcucuguauuuuaguccaugugcucguggcugugccuguguaaccugccugguagccaugcguuauguauuaaguuggugugucacugucaccuucaaggaucagacugcaaaggauaaggcccugcagcacauggcggccauguccucagcccagaucgucucggccacugccauucauaacaagcuggggcugccugggauuccacgcccgaccuucccaggggcgccggggguaagucaugagcucaguccaguaaugacagcugcugggguugggguuggcaugugccaguguuaagccucccaccuccauuucuugucaugugggucagguaugugagagggcaaaggcuaccuugucaacugauaacugagucuaaaguggugaaaguaaggagggaagggaggcagagagcuagagagaaagggagggggaggagaaggaggaggagaggaagaaaagaaaaaaggaaaaggaagagggagaaaaucagaagaggaaggaauucugagucccugaagacauggaauuaaaugugccuuucuggguugggcucaggcgucuucucucuuuaucuuuuuccuggcccuuggucucugucccucugucuucaggggcaacuagccccuaaagggacaagguauucuauuaacauuuacauuuugacaccuaccaaaggcugagaagcauuauguuauaaucucaauccuccagguaaucuuaaaugcugcuuauugucauugccauuuugcagaugaaaaagcugagguuauucaguagcaaaacaagaguuuggauagcugggaucauaguggaauggauagugaugucaagaaucagccccaggguugcuugacuccugaggcugcucuuucccuccucuaugucaugcccccuuuccagcccacaccaaucgcagcagggaagcucgcugcagagaagcugccugcauugccgcuuggagcuccuggccuuguucaagcuuuguccucugccuugcugggucuucacugcuguugacgcagaauauuaugcagggaauguuucagaaugaagggaggguacauggauaaaucagucaguucaaauauuggugagcccccugcagcacgcgcagaucuuugcuuagguguaaggaaaacaggagcugcugccugcgucugcccuugggggcauuuucaggaaggaggcgcuaaggggagcucuggguugccaguccaaggauauagguuguggucucgugcaaguggugaccgcauuugcacucugggaaagcgauucuguugggugaucgaaccugcugucuuuuagcagggguugugaugcguaggcauccuaaacugugcuuugaaguaaacucguaauucugaggccuuugcauuuugccuuccaguucuggccgggaaugauucaaacagggcagccaggauccucacaagaguaagucugaggaggggugggcacugacaacuacgggcuggucccagcccacguggggagagcucuuccuggaccauagugucucagggccuggaggagaaaggagcauuacacugaggucccagaaggcauccccuuuuuauuguguacuuaggccccuggcaggaaagagacuggcuuuucggaucugggagagguggaagcaccccauucccaccuuaaguauuagcagucauccagcuggaagcaagaaguggaccccucuuccuucaugguauugaaggcugagcugugguccuccuugccugagaaagggcggcacaggugauccucuagcccauuucauucuagccagcccuguaguaggauggcuaguagacaaauccuacugaugccuugggggcaagagaagaaagaucaguaaacuggaaauaagggcuauuucgggauaaaagaaaggaaaccuugccuauaugcuguaaaaaaaaacuugcauuguuuggccuagagaaggagagccugaagcaugucccacacuuugccuagaaguggugacugcuugaccucagagguucaaaggcagaugccacagcacaaggaauucaggcugucuuuccagcacaucccauugaacuggaaugaggcuuggugguuugaucccuaccuggcugcuggucccucucaguuuauggaacaacugccucugccuggggugugcuaccaccugcaggcagggaccacagcggugaaggaccucccacugggaggucaugguggggccuggguaauagccccugcugcagaugcgaucucuuaacucugucugccaucucucuguucccagcgucaagccuuuugugcagcaggccuaccccauccagccagcggucacagcccccauuccaggugagugucccugaaacuccuuuuugggagcacagccccacacagcugacagcugggucuggcacuuuguucccagagucaagagaugcucaacuuugccacagccgcacauugccccugacuugcaggauccuuggguagccuguagcucaggagggccacagggucccgauucccaucagucaucucccaagagcuuuucagaugguuuguuuaagaaacaggaagccuccucacuuucacugaagacgcuggauuauccucagaaggcgaaguugcugcagcaucuuccucaauauaaacuggccaaauuaggcagucuaagucucaaggccagauaggguuucauucacccuuucuuagauaaguagauuucgguccugcuaccuuucuuuaaaggagagaguacauggaagcucaaaguggaaaacaugaaucugucuagccuaccugucuccuuccccacaaggcgcaccccccauccccaccuguguguguagaauuacuccuuugcacuacuugagguguacaguauaaaagucacugcucucccuuauggauuccccaaacugaaaaugcuuucacguauugcccugugcccgagugcuacggagcauucagagagaauauucuauagugcuagugaccacagucuuaaggaagaugggcaaacacaagaagugcauggcauguucgggucucacaggaagucuuuggaagcauucacuucucacuguccugucauucuuggcuugguccccaaguagaccccuuggugcaggauuagauguccucauacugcagcccuuaaccuuagcugaaguuggcuuaaugaggaacacaugcuuugugcuuauuugacuguuuaccaucacuggggcccucugccagcaucugucgucugaguuauccuggccagagccgguggagagggggcuguuggcauuuccuucugggucaucuguagagcccuguuccaguauuugccugaggcccaaggggaggugagugaccagcaucaaaggugacgauugcucuuucaggguuugagccugcaucggccccagcucccucagucccugccuggcaaggucgcuccauuggcacaaccaagcuucgccugguggaauuuucagcuuuucucgagcagcagcgagacccagacucggugagugugcccagagaggugugucuugaauccaggauuucuuucccuuuacuguuuaccuccuugcuucucuuucuuuccuccuuuaccccgccccaugccugacaaauauccugugugaaaacgggccuaggaaagaauagccuuuugauuaaguaaaaagggauuccuauuggcagauuuguagaaaacagcagagcaggagguguauuacuguccuggaccccaaggugcuguggggaauacuugagucagagagagggacguuuacaagcucuuauguuuuguaaaauuuaacaagaaguaacauuuauugagccuugccauaugccuggucccaugcagaguuauuuagauauaugaucacaauucauccucauaaaaacccuaggaagcuagguacuaacugacaaaugaggaaacagagagcguaaguaacuuucccagagucacacaguuaaucucugauggauuagagauucaagcucggguccugaaaacucuaaagccuaaucauuuagcuguuauuccauacucucuuuccaacucuguuuucucaagauagcaaguuguucucuucuuaagaacaacuucuuaagaagaaguggccaggcaugguggcucacgccuguaaucccagcacuuugggaggccgaggcagguggaucacgaggucaggagaucaagaccaucuuggccaacauggugaaaccccgucucuacuaaaaauacauggccacgcacauguagucccagcuacucaggaggcugaggcaggauaauugguugaacccaggaggcggagguugcggugagccaagaucgcgccacugcacuccagccuggcgacagagcgagacuccgucucaaaaaaaaaaaaaaaagaagaaguaacaaaauggcacuuuagcaguuugccauagagugcagugcauuauaauaucauaaauaccaguaacauuggcaucuggacucuauuugucacuuucuucuuuccuaccucccccacccccaucuuguacccaucgucccauuguuucucagccaggcauuucccauacauaugugauccucccuucuuucccacccaacaagccccguacccuuucuucacacccacuccuuggcugugaguaugagcguugcaucugugugugggugagcccaaggcaaaaacugaaggaauccuuaguuugucucugagauccucaccaacucucaccacguucucuaucucaccccauccuucccaucucauaagucccaugcugucuguguguugccugccuuaaugucauuucuauuaucgggagacagugucaagaaugagcuaagagccugugguagauaaccgagaugcugaacaauuggaggugaccucucacgggaguguuugcacuucagcuugagggaaggccucccguggggcagaggggcuugaccagucaucaccagaguggagaacccacauguggcccacucaugucuuuguccacaaaucaugaacuuugggagcugguggaaaaauagagcugcuuccaaauuagggggaaaaaugagggaaggaauguaaauugggcccaucaggacagguacaagaaaauggggcuauucagaccaggaaagagaagaaaaggccaacuggaugacuccuuccaagcagcugaguggcuaacaggaagagugauggugaggguuaaauccgucuagguggaaggcauuaagacaaacugaaagaugcccugcgugacucuguccugcugguucuuucugggaagcauacauaguucuuugguugaaggcugggcuuuggcccagaugcugcuucugccucuuguaacugguguuuccaugacacuuuguuguuuacagaguacuuugugguugaguauuucauucuguccuuacagugccccaucagauagguucuguuuuccccaugauagguucuguuuuccccauuuuacagauaaagaaacugaggcccagacauacuaagugacuuaagauuaaacagaaggaaacaggagcccaaaucuuguauuucauuguauccuuuucacuaucguaaaagaucaccucccaguuuugagggucucuugaauugucuuuuuuuuuuuuuuuuuuugagacagcgucucgcucuguugcccaggcuggagugcaguggugugaucuccacucacugcaagcucugccucccggguucacgccauucuccugccucagccucccgaguagcugggacuacaggcgcccgccacuacgccuggcuaauuuuuuuuguauuuuuaguagagacgggguuucaccguguuagccaggguggucucgaucuccugaccuugugaucugcccgccuaggccucccgaagugcugggauuacaggcgugaggcaccgcacccgggcuugaauugucuuuucagucugaauaucuccuguguaagcaaauuucuguuugcauaugacuguuuuuuaggaaacagcuccaagacacugggaggcaaaaguccccacaugauuuuugcuucccugguuaaaauacuauggaaucauuuauaaaaauucucuuuuuuuaaaagaaauuaaaauaaugugguagcucccucauuguuaacugugcucuccaguuauggaccucuuagggcccagaaggcucgauugccucuuuuuguuguuaguauuuguugggcuaaacauuuugaaucauucagaccauucugcaaacauucgugugcaccugcaugugcaagaagcuguacaggagaggggcucaucgcugcccagacggccacagccuccgccccuggggaguauaaugccuagcaggggagacagacacgaaacagaugauuaucugagagaucauugcaaagugcugugacuucuaggaaggaagaauacugaacgcugugaguaacaggaaacagggcaagcuuccuugaggaaguagcccuuaagccgaaagauggaggauuggacagggagagaauaagggagcagaauauuccagaggugaugaagcugaaguguauguggcaguauauuaaaucagugacuauuuuuggaaagucaaggcccacuaaguugcuagaguagaggccagagauaaguguuucagguacguucaggauacauaugauaaucugaauggguaaacuggaucuggccugcuguuguugaauaaaaaagcuugacuuacauagacuccaccacaugacuuaaaaggcccuggaaugaaaggaaggccugguguaacauccuugggaccuuugagaaagauaguuauauuuuaggggauaugaauuggggauugggagaaauuagaauuuauuuaacaaguauuuuuugagcaccuacuacacgccagccacuguuucagguguuagaaauucagcagugaacaaaacaaaguucuuuuucucauggagcccacacuuggguggagaacacaagaacuacccaagcacauaaauacccaguaugucaggggaugcuaacugcuuauguggaauaaugguccuuugucacaacugauuuuuuuuuuuuuuugagauggggucuuacuguguugcccaggcuggccucaaacuccugggcugaagugauccucaugucucaggcuccugaguagcugggacuacaguuaugcacugccaugccccaaccuucuucacaauugaaaguuacuugcuuuuuggauuuaaaguauauaauuucagaaaauaauaauacccccuaauagauauguugauguuucuggcuuguauuaugauacuaagugaugugcauuagacauuaccagccagagcucugucacugcugugaaauuauuuugccuaaccucagucacuauuguuggugucgcuucugauauuccuauguuacaaacacucauucuucaguugaacacaaaugauuuaauauaugcaaaugaauguggaaguuuuuuuguuuuuuuuuuuguuuguuuuuuuuuuuuuuggagacacagagucuugcucugucacucaggcuggagugcgguggcgcgaucuuggcucacugcaagcuccgccucccagguucacuccauucuccugccucagccucccaaguagcugggacuacaggcauccaccaccacgcccggcuaauuuuuuguauuuuuagugagacaggguuucaccguguuagccaagauggucucgaucuccugaccucgugaucugcccgccucggccucccaaagugcugggauuacaggcgugaaccaccgugcccggccgcagauuguuaauaggaucuauauuugauuuuaguggacaugugagggccugaagguugguucuugugcuagagggaaaaagugguggcugaccaguugaagugauggagaauuaauaaaauuauuuaaagcauuugacaguaucuuaaguaccagccucucaaguuauauacugugugcuuuauuggacaaacacaacgugcuauuacaaucaagguauaaugguacuucagggcuaagguuacacugaaaaauuuguaucauguagauaguuucuuuggcucuuagaguuuuugugacuucucagacuuuaauuuugcuauaguuuuguuccaacaacagaaacauuaaggccaucuaagauaaacucagcugauacauuuuaacaaauuugggcauacaguacuuaaaauauaacauccagcauuaaccacauuaauuugauaagcgaacaaagugaccaauaauuaaagggcccuaaguaaguuaaacuuugcauuugaauucucuagauguuuguuacagacagacauguacauauguuucccccuacuucuuuguaacggcuuaggcucauuagacccaagggguuauaaaauauuuuuaguagagaagagaacuuauagguagugcuggcaaaaaaagaaauuauguagccagguuccaugcuauuugucauuagugacuucuuucaucuuuauugagcucugugagguagguuauucuauucccuucuacagaagaggcuuggagagaugcugccuuacaguagccagcuuugcaccccagccugccuguagcaucucuuaagacaagauaagacaugauugcuggcugggugugauggcucacgccuguaaucccagcacuuugggaggccaaggcgggugggucacuugaggccagaaguuuaagaccagccuggccaacauggugaaacccuaucucuacuaaaaauacaaaaauuagcugggcaugguggaggguaccuauaaucucagcuacucgggagacugaggcaggagaaucgcuugaacccaaaaggcggagguggcggugagcugagaucacgccacugcacuccagccugggugacaagagugaaacuccaucugaaaaaaagacaugguugcauacuuugguaccaccaaagccaagagaagaaccuuaguuuaucuccuccuuagucugaaguggccuuagaaccagcauuuucugaaauuuacucguuggcucaccacauaugucacccuugccaacauugaagacuuccucacaaccccaccacuccuagcaauagugauggccaacauuuacuaaauauuuucuguaugccaacacuaugcauuaucuuauguaauccuuaugaaguagcuugcccaguguuagacagccagcugacaugggaaguaggauucagauccaggucuguugacuccacauccugagauagugaccaaaaggcuauacgguccauuuguagcugaugaguagucuguuuuuguagcccagggccguaaggagcuaaugggagaauaauuagggggaugaucgcccccugcuggcucugugucauguguaaaccagacggcagcuuccccaaguugguggugguuuauguuggaggagaaccagcgagucagucccucuguuaccuuuggcucuacuggaagcuaagagaaaaacagcagagggugaagaaaggaaggaagaguguaaaaaacaaagacuauuuuaguuggaaauauacuuucuacaugauuucaguguugcauaucaaaggaucucaaguguuaagugugauauccuccacccagggugggcuauuuaaaaggggccucccugaaaucaggguccaguuucuggaggccaaguuaggcagaugaaaacccggccuggcugagcugucagcugaauccugaaaguacacagggagugguuuuccugauaaagccuggagugaugccuccaccucaauucuggggcacggcggguuccuccagccccccaccagggcagcagcuggcaaaccccugccugcucagacugcccggucaccaggcugugugucucaugccuguuguggucuggaugccauagugagcaggagccaggaagaaagcacagaaaggauuuacucaggcgggaguuacacaaccagaggagggaagaguuggggguggagaaagaggcaaagagauuguucucuuuagauuuugaggaagcacucacugccuugcagaagagaaguuccaugauacaguagaggaacaaacccgaucagggaaggcacacguuugcucaacauaugaaacucauuuauuuuuauuuuuauuuuuuuaauugaggcagggucucacugcauugcccaggcuggaauguaguggcacaaucacagcugacugcagccucgaccucccaggcucaagggauugucccaucucagccuaccaaguugcugggacuacaggcaugcaccaccacacccagcugauuucuguauuuuuaguagagaugggguuuuacuauguugcccaagcuggucuugaacuccugggcucaagcgauccacccaccucggccucccaaagugcugggauuacaggugugagccaccgugcccagccaagcaacuuauuuauauauuaugucaauaaugaucaucaccagcacuuaugagcucuguauuaguaugcugagcauuauguccagucuguacauaaaggaaccguggcucagaaacguuaaauaaaguuaucaagcucuaccuccaaaaacggugacugugccaaaguuuaccaccacucuguauucuuaaccaugucacuguacuuuugaagaaauaaagacaaaguucaaaaguuaaaaacagcugccugcaaaguaggagcuccccaagcaaggccagaccucugagggccuuccacauuggguagaugguuacucuggguuuccucugaguuccuauuccaacccauggaaaauugucuuccacaaaaucagucucuggugccaaaaaggggaccgcugcuuuagagccuaucuuucaucaugcucuaguggcagcaaagaggugacugauacuagaauucuuagcagcuguuugagauuuggggcagauuaccgcagcucagccucaguuuccagucugucuuaaguggacauaacaggaucgcugccaugcuuacugugaugauuacauuuaguaauaucccugaacauacugagcacuccacaaaugcuucugaaccugaaugucuuacaguaaugugaaaggaaauugagccagagcucuggacagggaucaagcuugcgagaaugugcucacuaagugcuuuggacucuacugaaauucuaacaggagucagaauauuuuucaauuacuuuugagauggaguuuugcuucgucgcccaggcuggaguacaguggcacaaccuuggcucacugcaaccuccaccuccuggguucaagcaauuccccugccucagccucccacauagcugggauuacaggcauguaccaucaugccuggcuaauuuuuguauuuuuaguagagacaagguuuugucauguuggccaggcuggucucaaacuccugaccucaaaugauuugccugccucagccucccaaagugcugggauuacagaugugaaccaccaugcacggccucaauuaguuuuuaaaaucaauuaaacuuuucauaaagguaguaaauuaauguggucaaaaaaucuccaagcauaagagaauggaagggagaugucccuuccuucucauuccuauccuacccuuaaguagguagccacugcuacuauucucuuaugaggcuuuguagugauuuuagugcauauacaaucuaauaugaauauguauucucccaccccacccugcuuuuuaaagagaggaugugaucuaauuugugcuucaggaacacgauggcugcaucaggugagagcaggggcuggaggaaacuauacuguuggccagcugguggcugaugaggaccaaaccagggcaggggccauggcugaggaaauggcagaggggagagauguuauggagauaaaauuaaaaagccuuguggauuaaugagcugugagaagaggaggauaaaugguaaugacuggguguuggagaccaaggaugcugauaagauuugaagaguccuggaacagaggaggaagcaggauugcuaagaacugacuugaugauaaugcuuuugccuuucauucucaaaauaagcuuguugaaauaccuauuagagacaggaaagcucagagaguuuaaguaacuucaucugggaccuggcuaauagauggcaggguugacuauuugaacuuugucugaauuucacaguguaugagaaaaugacacuuaccccacuaucugggaaaaugggaagggcagggauuguucuccauucacagauggacauuugauuugggcuccaggacaggagagaguuccugaagggucaccugggcuuggugauggcagccccucagccagaaggaagggaguuuugcugccugguguucuggcccuuaucuuuauuccaaggggcuggaccuccuggacguggaugugggaguuagcagucuucauagucagagggagcccaaggucuccccucugggggacuggcaggccugugguugagcccgcauggaaggucuguaaauauauccugcagauaacaugauucuuucucguaaaggcaguuggucaaacgugggcccaaggaugauuuaauuucacauuuuuauacuucuuucaauggccuaaauuuacagaucaacuaaaauuccguugucagaacacagauccuuucuugguuuggaaaaugugaccaggacagcucuaaggaaauaugacauuaaugaggccuguggaagaaagaagagggggauggcugugcaugggggauuagguuggagacacaagauaaaaagcaagguuucagccgggcgcagugguucaugccuguaaacccagcacuuugggaggccaagcaaggcgugugggucaccugaggucaggcauucaagaccagccuggccaacauggugaaucccccgcuucuacaaaaauacaaaaauuagcugggcaugauggugggugccuguaaucccagcuacucgggaggcugaggcaggagauuugcuugaaccugggaagcagagguugcagugagcugagaucgcgccauugcucuccagccugggcaacagaggagacucugucucaaaaaaauaaauaaacaaaaauaaaaaagaagcagcagcaguaagguuuuaauucccgauugccaggaggguucuugccuuuauccugggcaggacagagaagggcaccggugucucuggaggagcuuccuaguuuuauaguggcugcugaggcaguugcuccaucuugggguggagaauggcuguuugaacaaaucugguuccugguccuucagaaaagaggcuccuucucuccuguaauucagggcuuggaagugaucucaugccaguaagccaggucaccagcaucugugcagcucuguguggccugggcggaauuuucacauugacuguuucauuugaccuuguagacaggcuaggguucaucacugcucagaugaggaagccagggcccagaaagguuaagcaacuugccucaagccacucagcucaaaaauagcagagccuagauauucuaacccaggugucauuaauguucccaucucaugcuucggaauaaguggucggaaaguacauuuggccuuccagguuuggggaggaaggcugcagcugaucuaacgguuggcucugcuuaguccuugaaugucucucagguuuuucucauguuuuuccaagccuggucuuccagcaggacguaggagauggagugucucccggggaaggagaugauggcucaguguggagcacccccaugccccucacaguccugagcccuugccgagccaccugcgagccccucccggcccagggcacacucucuuguggcagcagacauuguacuguguuucuaagaugcucuggccacuuccccuguuucuucauuacccuuugggaaggaggccacugaaagcgucuggaaauccggguucuauagacauuucacagaggccccagucaggcccccucugcuuucuuuggcagguccgcaccccacgcaccuuccugguugcucacucagucggugggccuuucagcugcacuucuguggggaagacacacuccugucugaggaagcagcagccccucuguagagauggugcugggagugggaggugggaaggaugcaucucggugugagaucccggaaggaggcauucacuugcuccuuguuuccaaugauguuucucucugggaagaacgaggggcaugggaugaaguggcauaucagggccaaguggccagaacagggcuggugcccuggacagugagcugaggagagaacccacuucagauucacuuucuccugggcaggaaccgugagcacaggcaagcuccugggcugaaugugcgggaaccugucuuggcuuggcuccgcagccauucccuguccccccaggggccaccgcaggcugcccagccugcccugggggguagguggacagacauuccaggcaggaccgugacaagaaguaaauguaggugauuuguccuuguucuguuccagcuuguacauuagcauaccuugacaugaguuauuugucuugauuucuuuaaauuccuaaguggauuauaauuuuuuucuugguauuauuugacagcagucauuuuucaagguuucacuacguucuucaaauacuuagaauuuuuggaacaaauuuaggaaaagacugccaucuucagguuggacggugcagugcaggacccggugugucugagggcaccucgcagaugcugaggacuagcagauuuguagggcuuuuucuuccuuuuccacaaagauugaacugccuucaucaguucaauacaucuagauucaauacaucuagaauguauugucaguccuuuuaaaaaaaagagaaaaaagccccagugaccacuguuggaaguuguacuguugugguuuguuucaucuacagugauggacaaccuccuaggcuguccccacuccacuuuugggaacagacuuugcaugccuuagaggaagguaggaagcagguaucuggagaggguacugugugccugagggaaaugcggacgccagaccccacaaggcuuccccacacugccacuacccuagcaccgaugguaacaucagaacagaaucgccuuaaugagucugaaacuuucccugucuucauuuaugcuuuaaguuuuaguauguccagguuuuuguuaucagagggaccguauugauuucacauuauuucguccaaaguaaagaaacaucaugauucuuccggaaaguaauaacaacagcaaauuacgugcuauguacaguguuauguguuuuccuugcauuaucucauuuaauauucuugacacuccaguacaguagguacuauuauuauuccugcauuauaguucuacuaaguauacauauuuccacuauggcuguggaaacugcagcagagagagagggcuauaaucacuugcccuggaugacucaguuaggaaguggugcuacugcucagauucaaacccagaucccaucugacaccacaguccagguguucaucacuccucacugcaggcucccuaagcagcaaagaacagcagggaccaggaaacaaagugacccauagagcagcuuugaaggaagacgaaaguccuuuauuaaccccccccggguaucucagaagcccuuugcaagugaaugguugacuuucgaggguugcauucaccuuuauuauuauuugcaacugcuaugaagaauaacuggagggauuauagcaaaacaaagagaaaauggacauuucuccaagucaaaauagaaauccacauauuaagauggcaucagguacugcguggcauccuugauccagguaggguuuuacuggugcaacaucuuuuuggugaacccuaccugcagacaagcgucccagcuccuguccagcuguccugagcguuugagcuguaggaaagcuuugcagucugacccgagcuccuuuaaagcccaaggaacuuguggcuaacacagaguaaacauccugaaguaauguuuuuugcuuccuuuuaugguucuuucccuuccucagaaaaacuccauaaucuuucaagauaguuuuugauuggugguuuauuuaauaaaauaauuguauaagccagauugaagcacguggcccauaggaaaagcaguauucugcuccuucauggcuccucaccuuccaguucuacuuuuuggggaccauugcuugcagccuuuucagccauuucuuuguauuaauauauuuaccuccacauuucuaaauaacaugcuuauauuguauaucucauucuauuaauuuuaggcaucaucuguugacuucuuaacauagaagacuacgauuuaguucucuaaauuuaguauaugccccccuccgucuuccuuucagucccccuaugugcuuuucucuaaauuuaguauaugccccccuccgucuuccuuucagucacccuaugugcuuauaucacauuaaaaaaaauuagcauucaguuaauuuuacaaacccauauaaauuuugcacacagcgugguuaauguuauauauuggaaccauuuccuuaauuguaaaacguuuuuuucugggguguaugguugucuucuuaaaaaauuguucaguuuuacauagcuacaccaauucacccucaaaguuucgaggagaacucauacucuucuccagauggugagauauaaaucagguccgcucucuuggugacauccuuccaggaguccucagcuccacggauccacucuggacugguugcugaccuggcugguuucuuuaccuuucuucuauguuaggccccaucucuuuuuaaaacguauuccauccuuuuguaggaacauacccuccuauagcucccugggaacaaguugcaaggaaggucaguuuucugauaccuuaaauaucugaaagaguauucuacuuucauguguaauggauaauuugauguucauuaugguuuuugccuuggacuugugaaacuuuauucauguuuucuaggugauuuccacauauuuucuccuugcuaaugaacaauauguuuaaugcuggagaauaaggucauucuuauaaaaagagcagguaaaugcuaauuuaguucaugugauauguagaagugguguugacugucuuuauuauccccaucuucucuguaggaauuuaugagaacauauauuuauuugggaaagauagaauucuaaguaucgagguaauaagcuugcucuguacagucacucuguagguucuaugaagaugagcacuuuguuguuagcucauggauuccuggugucuagcacagugccuggcauguaugauggaugauaggugugcugguucauucuauuaaaaucuguaaaacaggcagagugaguaccuuuuccaucguugaccuugagauguugauaaucaguugugccucuacugagugccuaggggacucuuuuggagaagucaaaauuagccuccguuuuggauauugaggaaaucgagucuugggccuugcauaugugagucauugacauucgcccuuuuucugcucauaucuugaucccaaaugccaguuuucuuucccaaaugccaguuuucucuuaugaguauuuguuuugugccccauagaauagaauugcccuuuuuuuguuuuaugugccaccuucacuuuuggggaaacuaccacugcuggagaagaaacgagauuuauuugggaaggagagaagcaaauaaauaauccaccuuggcccacuucccuuauaaggagaacuggcaagacuggaaauagagccuucaccaaaggguuuuuagaauucauuucauuaaaacuugaacccaacauacagauuucuuccuuucagccuucuggauuuggggacagagggauuccugaccuacccagguugaaugaaggggagaggguggucuguuuguuucaaugcuguggucuccagggcaccuucuguaguacuuuguauucuuagaaacagagucaccaccucuuggcagcagugaagccacucagaugccaauggucagaguuugguuucaagucaccagccuuguagagacagugcccaguuuccuuuggcaaagacagccugccccuucucuauucauuucagccuugaacacagagguaaauuccucaaaauagaaaccuuuguggacucuaucugaugcauuugugaaucauguuugucacuaauucuaauuuaacuucauagaaguuuuaaaacgcuguuuaguuuuuuugcuguuguuccuuucccaaaucaacuuucaaaaaacguugguuuaacgguguuagaaaggcuuagacauuuucuuuugggggacagugugauuaauguuugcagcaaacgcaagggcugugguguugacagauccaaguuuuauuaacuccaggacuauuccuggaugugugaccucaggcaagucaguucaucucuaagcuucuauuuccucaucuguaaaaugauuuaaauuaaauccaccuccagcagcgucaugaggcaaagauuaccugagaucacaucuauaaacaacacauugcucacagcgcccaguggacacaaggucucuuccuuccuuccuucaggcacaggugagaggcccacacucugagcagcugguuaugagugggccauuaucagggauuugaacagucacuuggcuucacugcuugcucccagcucuuggcuuguguuucuuuuuucuuuacuaggcaggagggauagcaaaagcaggaaaguuauuuugcuucuaccucaggaucuagugaaugucacaugauaauaaacuauaacaauggucaucuuagcuauaauuuauugaacaugaacacuuuuuuuuuuuuuugagacggaguaucucucugaugcucaggcuggagugcaguggugugaucuuggcucacugcagccuccgucuccuggguucaagcaauucuccugccucagccucccgaguagcugggauuacaggugugugccaccacacccggcuaauuuuuguauuuuuaguagagaugggguuucuccguguuggccaggcuggucucgaacuccugaccucaagugauccacccuccucagccucccaagugcugggauuacaggugugagccaccaauccuggccccuaucaaacauuucuuauauggcagguccuaugccaagcaccuucugagcauuagcuccuuuaauauucacauauguugcaaauauuacagguauuauauccccauugcacauaugagaagucuugagguuucagguuugugucuggcuccaaggcuuucgugcuuuacacucagcaccuugcuuuucagcuguaccuucaugguccccauugguaugugguagauuuuacccccauucaccuucuugaccuguagaugucagggccgugguucccauuuccagcagugcagugcagggacauuuugauguuaagcacaaagacuucaaguuucccagcuucucaacuucaccccagcucugaccuggcccaggggcagcuagcgaggcagaacagcuaggagugaggagccuaaagggagacugggauucagcucagugagucccuaaggcuuguaucucaugccuuccauaaacucacuccuugcagaaggcgcuagaauggacagaagcggugccuucuggaacuggggcggucugagagcuagcuguaagcagagguuguuaaucaggguuggauggacggauacauagccaguugucuagguaauaaacaaugccuuuugcccuguacuccccauuccauuuuguguuucugauugccuuuauaccaacgucugugcccacaccuuugcccauguuauucuuuuuuacuuuugcccacugagacuagaaagacuagaagcuucuuagcagcugugacugugucucauacauuuccaugggcuguuguuuauaauuggaaaaagugauguggcaacauuugaaaaaauguauaaaaagcucaaagauguucccuccuacccuuauaaucucaccucuucccacccccauaaucucacuucccuaacacaauggcuuuuacuuuuaaccuuuuuaaaaauaauuucuuccuucugaggcagacccuguuguuuuauaguaucucccagcuucugucuuaccugccagguggcuaguccaugcagcugcauccaugucagagcuugauaggguucucucuuucaccucaccugauaccuuuuaggauuuuugaagcuuuggaaaagauaccacucugauguugaacaggagagggaccuggcccucuccaaaagauacuggccucaguugcacugccccuuauaugcaacacuggcaucagauggaguguccagccuccugucuuuuggcaugguggccagagauccaaauguggguagcagguuauagauuuaaaccaguauuccuucaggauauauuucauaggguuuugugaccaacugaguuugagaaacucuagauuauauguuuaaaaauguuucuuuauggaagugccuuuuuaagagacaaggucuuacuguguugcccaggcuggagugcaacagcaugaucauagcuccauuacaccuucgaucuuccaggcucaagugauccuccugcuuuagccucccagguagcuggaacuacaggcaugcaccaccacaccuggugauuuuuuuuuuuuuucugguagagaugucucacuguguuguccaggcuggucucaaacucuugggcuugaaugaguuucccuccuuggccuuccaaagugcugauauuaaaggcaugagccaccauggccagucaauggcacugcuuuuaauacgcuaguauuuacugugaaucucuaagagaggucuuauuaaaagaauaauagcuagauuuuauugacugcuuauucuuguuagaucuaggaucccugaugaagucuguggagugucuuauuuaaacccuguaacaauccagugaagugaaugccaucacuguccccauuuuagagacuugagaggcacuugcgcaguaucauagcuaguuugccuugggcaguguuuugugcuugaguaggaugagucuagacccacacaaucuuuuuuuuuuuaaagcaggucccagugauuaaguuccauggacuguacauucuuaacccauguauaauacucagcuuugcccaagccuucuguuaguugggacuuccuguggaauagauuaguacucagggacaguaguuggagaauugccaguuuuaacuuggaaugugagcagacuuggacugcuagauaaagaaggcggauggaguuucucagugaacccuauuugguucugaggcccauggagccucugcauccccagguuucuuggucugugucacauuaaguugguauuaaugccuauucagugggagaggcaugcccgaagagucuggaguauaacgucuagaccaguggucucaaauuuggcuguguauuggaauucacugaagaagcuuuaaaaauuaugauguuuggccucucucagggauuccaguuuaauccagauuaugcccaggccuuugugauguuuaaaugauccuuggguauucugauguagccuggguugagaaccauugguuuggacacacuccuuugugguccaguuaccaugucuuaucccaaagcaaggggaagaaaaggguucacuuugugagugaaaugacuuaaugugguuuagaguuuuuuguuuguuuuuucaugaaugagugaccuguguucuuuuucaucagccauguauggccuuguagaucuucucugugaucuguaccccaguccuaacuuugcacugacagugacauauugagcagcccuuauguagaaguuuuggauugguuacuaaggggacuggugacaaagaggcucagcacucuuauuccugcuggaagaaggaaguggguaccauugcucagaccacuguaucuacgcugucccaggagaguugggacaagaagugcauucuggguuaugacaugagcuaacugcacacagauuucuuauugggcuccaaagaguaucacuuucauuuucaguugggucaggugaaauuggguaauacaauuguuucuugguuugguagcuggguaacuuaagcuguuguuauuaauguguccgcaaaaaagccuuuuuuagauauuucggaaaauauaugcccuugucaguaaaaagcaaugauugucucaacccuaagcuauaaucgcuuuucuaaacauacucaucauuucaaaagcauugauccuggacuggaaggccuaauuccagaauuuugguacuacugcucuuuauccaguucaagauggaugaguuccagguugaucaaagaguuuguaaugggaauguuucuguugguuucuuacaguacaacaaacaccucuucgugcacauugggcaugccaaccauucuuacagugacccauugcuugaaucaguggacauucgucagauuuaugacaaauuuccugaaaagaaagguggcuuaaaggaacuguuuggaaagggcccucaaaaugccuucuuccucguaaaauucugggugaguaagacauugcugugauuuccgugguuuuugucugaauggucacaucucuuacaugagcacagugcagcacagcuggcuuuggauuuacacugagugcaccuucaugugcuucugcacaauugccaagggagcacggacucacaccugugaacuguccucaugccggccuuaugcauccacauggugcaccugggugacauucucugucccugccaaagggcacaagggacaagcagccucuuuggacuucacuuaaauucccggagcugggaugaaaauaaaguuacaugcuucaagauuuuguaagcaucagagaggaaacagaauugcuuugcccaguguauacuucauuugugcuuuaaaaugacgggcaaaguccccuggcugcugcagcuuugcugauguuccagagccucugagaggagcuuugccacccuuuggcacuagucagccuugggccaggggaaugcuaaugggucagaaugggcauaaguauaaugugugugugcuaagggauuggggcaccagauaaccugcuagcgcugcgaguuuaugauuccucagccuuuacacacauuuuuuuuuaaaacuguuuuaaguguuugugccccuuagcauggcauuaaaggcccuaagcgaccugguuccaggguagcuuccucuuguguccugccaaaccccuguugccccaccuguccagucuaugcucugccuucuguuugucuagauggacuuucugcuccuuucucccuguaccacugggccagcuccuucuccuccaugagacaauagcuccacuauaauagaaccuuccccauuugagcagaccauugauuucucuuuuaaucccauugcauuugguaaucacuucccaugcugugucaugauuguuuggaggugucccccuuccucugggcucugccucagggggccuuauucauauaguggcuuccuuuuuuauugaaugcuugcuuugugcuaggagcugugcugaaugcuuuacgugcauuucauuucauccuccacguuuuagguggaauuugccucagcuccaccuaggaaaaaaggcucguagaucaccagagacaggcuuguagguuggguaccuggagcuugacaucagaucugugugacuuuaaugccucugcucuguuuccucguugcauaaucccuuguggacccugaccacaggaucugucaaccuaagccucuacguaucucuauaccaagcaagaaccuuacacaacaaagcccaacagaugugagaacaaauggaugaauuaaagaaaaauuuauguuuuagauuccuuggaaggaaauuugcauauuaaauuaguuuguuucguuucuuuuagccuuccaugauaacuagauuucauuuuuugugcuuccauuauugaaauuugguuaguaguccaggcacaguggcucacgccuguaauuccagcacuuugggaggcugaggcagggguauuacaugagcucaggaguuuaagaccagccugggccaaauagugaaacccugucuacgaaaaauacaaaauuagucaggcgugguggugcacaccuguagucugagcuacucaggaggcugaggugggaggauagcuugagcccaggaggucgaagcugcacugagcuaugauugugccccugcacuccagccugaguaacagagcaagacccuguuccaaaaaaaaagaaauuuggauaguagauguagccuucuacuuauauuaauggauguuggaucuguaauacacauggacaaccugaaaaagcgaucacagucacauuuuccuuuucugaauugguggcugccuucuaguaauuuggauggugguuggagaucaguuauaugguaacaggguagcuuucaaaauguggccugcgaaccccuagggaguuccuugauaucauuuuaauggguugacaaggucaaaacuauuuuuguuauaauacaaagacaugauuugccuuuuccauucugcuuauauucacacugaugguacaagagcagugggauagaacugcuuuaguaugaaucagagcaguggcuuugcugcuaaaauucaugcaguugaaaaaaaaaguccuucaugaauuuuauuacaaccuagaguacacauugaaagugaacacauaaguuuuaucacaucaaggaaaacaaaugacauuauuuguugccaaagauaaaauuugggcuuucaaaugaaaauuagaauacugggaaauuugugccuaccuuagugaacuucucaguacuuaaagacuuuucugaugagauccacgaugauauugacaaaauguaauuugauauuguguuagagcaauggauuuuaauguaacagaguuggaaaaauucauugauaugguuucagacuccauauuccagccuaccauuaagaaacuacuacugcuuguugacuuuugauauaguaucaaaggaaaaugaccacuguuaucugaggagucugucacauaauguaaagcagcacuaccugucucacuaauuuuuuaaaaauacaggcauguuuaauuuuuuuaaaaagauguauaucaacauguaauuagcuuauuauuucuuaaaaugaaugaauauuuuaaaauuugcucaguuuuaauuuccaguacagaaaauauagauauaaccuguaguaagcaaaaggucuuugagguccucaauaauuuauuugguccuguuugcaguaucguacaugaucaccaaacugcugcuagaaugcucacaccuguuacggcaaauucaaaacccaggaaaggcgucuccugggaauuuacuugaggucagggucaggcugucugguacaucaauaauuuauuuacgaguguaaagggguccugugaucaaaaaguuugagagccacuauuuuaaaggauguaaaaagggguuguuuauccaagugaaugaaaagcuaauucggaauuauagaauguuaugaagagaaaccauuuucaguaauuucaaauucaacaguaguguuuuuaaauaagguuucugauaauuagcauauuguuugaauauaaaguagcauagagugcgcuuagaaagucuuuuuugguuuugccuccaaaauugcccuuauuuuacccaguggaugauuuuaauaaauguuuuccaugguggggcccuucagucaugaauccucaaauaacaaagucuagauugcagauguuuagaguaugguagcuguugggagaugugcaaauuuagaaacaguuacuccgagaucagauacuuguuuauuaagauuugcagaauuaaaauggagaacuuccaugaauaugauagaaaacaucacuccuucaguagaguuguuaggaauauuuaaccuuuauaaagaaauucagucauaacuauguuaaaauaaaggagggaaggcaauuuaaauucgguuugcaauuugaaaugucauuggcuuccucuaaugacucaguaagaaugaauuacauuuagaauaucuauccuuggauaucaguaggugcuuccaguggguguuuccgaaguagguuuaacacucccuucgaaauaucuuuuagcaauaugcuuagcagaugugcuuauuuuuguuacaacagagacucuauacccaguccuuuucuucucucuuuuucaaauggccuaaagucucuaggcugucaguaucagccugacucuuaccuguuuauuugaucguuccugaauuugguuuucagaauaucugcuacguccaaccugggcucggucaggcuagaccacgugagggguuugcuauggaagaauacuauguguuaccuaaaguaccugcauuuaagccccagaugcaggcaccucaguucugccaguugacacuuggaggcgaaugggauggugaugagccaaguaguagucacuccacugauuuuaggguggaagauucuacuggcaucccaggccccagagcauaaaugaauaacagagucaaggaugccagcaugaguaccccucuaccauauaagcuuuacagugucucaugccuucauggugugggaccccuuaaagcccguaugaauggcuguuuaucuguuaagaucuuucuaaagagccuuauugagguauaauuuauauacuauaaagaucacucauguuaaauguacaauuuaggccuggcgugguggcucacaccuguaauccuagcacuuugggaggccgagaugggcagaucaugaggucaggagaucaagaccauccuggcuaacacggugaaaccccaucccuacuaaaaauacaaaaaauuagccgggugugguggcgggccccucuagucccagcuacuugggaggcugaggcaggagaauggcgugaaccugggaggcggagguugcagugagccaaagaucacgccacugcacucuagccugggcgacagagugagacuccuucucaaaaaaaaaaaaaaaaagaaagaaagaaaaguacaauuuaauuauuuuuagaaaaauuuacagaguugcauaaucauacuaaaauccagcguuggaauuugucugucaccccgcgaggaucuccugugcccauuuguaguuaguucuuauuuccacccccagccccaggcaacuguggaucuacuuucugucuggaucaauuugccuguucuagacauuucauaugaaugaaaucauucaguguauuguuuuucacagcuggcuucuuuuacuuuuguuguauuugaggugcauccuuuuuauuguagaauuagugucccauccaauguauauaccacauuuugcuuuguucauucacugguugauaggcauguggaucauuuccacuucaggcuauuaugaauaauggugcuaucgagucuuuguagacaagucuguguggacauaccguuucaucuuucuuggggagcuaccuaggaguggaauugcuggguccuacgguaacucuauguuuaacauuuuaagauacugcuaaacuucuuuuuuaugugguuguaccauuuuacauucucaccaguaagaucuuagggguucuucuccuucagccauuaugucugcaaguauugggguacagauuacaggggacaucuuagaugaggggcugguaagcaaaggcacugagacaggguguguguaacguaugcuucaggugcauugagguguguugcagcugaaucuucacugguaauggaaagauaggugaguagaaaaauuuggaaagagaaggaauccagaauuuaguugugacagcaguagggagcagucgguguuuuaacaauuuuucagucaacagaguaaugggauucuuuuuacugaguguuacagagacucugcauuuugccuuuucuaguuuuauuauauuuuccuuuucaugacagccucuuacucauuuccuuucuauuucuuuugcccucuuuuuauuuacuccuauguguuuuaauucuacagcguauuuaauuacaaagagagaaaaggugauuuugcaggaauggaagggaagggaagagguuccucucuuuuucagcaguaccugaaccugacgcuuaacugguaccuucuuuaagccaggcacugugccagggcuaagcacauacuugauauuauuuaauccuugugagauacaugugaugagucccacuucacacaugaagaaaucaaaccauacaaaggcaaagugacuucugugacaucauauugcuaguaaaugccacaucugcuagacuccagaauccaugcucuuuguguaaaccugugcauggccucuucagggagcacgguucugucacuagaaaccaucccaacauagcuucacuuaaauggaagcuaauggugauugcugaaggauagcagccuugguaguuucucuuugaaguccugucauuaugagaugcucugguguguuuacaugggagcuaagguguauuuucauauauauguucuguauauuauuauguucugauuuuuuuuaaaaagccuuucuugcugggaaaagacuggccuuucugggucuagccaauucuuagaguaggaacaugauucugucuaacagaggauaguccaggagccugcuuuucauaugcaaaccaaccaguccagaaccagaccuccucuaugugguccaggcaccccaggauacaguguuccucugcccuaaucauucccuggaaugguaccagacaacuagggaccaccucugaagcuuagagccagcuggaguuauucgaacuagucaauccuuaauuggucauucuguuuccccugcccugcccauggaaagcccaggaaaggcucuggucuaagcuggccucuugucuucugccuccugaccacccuaguaucuuuccauguggcccuugauggccugccaugcuuccugucuuggggaccuuugaguguaauaaauuuuuuuccugaacuucuccugugcucuguggccgcaccugacugaccaucacauaaaagaauacaaaacguaaggugaauaaacuauuaccaggaaauucagguuggagucuaagucuuaacuagacaaguuagugagauccugcaacuaccauuaggagaaagcaguguuguuuuuauauuaugauuaugaagguauaacauucuagacaguugggaauauauaauuuuuaauucaguccuaaaugcaucaugaauauaaccuaaugugauacauauuuauguaguuuugaucaaggaauacgugaaaucugacacuccacuuuuauaccuuaugaaauaucauguuagcuauaugucaguauacuucaaauuaucuguuuuuuuuuuuuugagacaguguugcucugcugcccaggcugaagugcaguggugugauuuacacacaugguuauguguguaaauaaccauguugcuuucuaaaauaguuguagcaguuacucucucaggccaugcaugaauagaccaggcaucuucaucagccuugacuggugcaauuuaaaacaaaacaaaaaacaaucuucuauugucacuuguuauuugaguucuucuacaucugcuuuuauuuuuucuuccuacucaaaagucuucgauucuuccucauucucuguagaaacaaugauuacuauuaagguugaaauaccauauuucuucaauucugagacauggacuuguucccauuucaacaguucuaaaauuggaaugcuucugucaguugauauccaaagcacuuugccacauuuucuuuauauccagucuauuauugaauacuaugcagccauaaaaaggaaugagaucauguccuuugcagggacauggaugaagcuggaagccaucaucguuagcaaacuaacacaggaacagaaaaccaaacaccacguguuuucacucauaagugggaguugaacaaugagaacacagggacacagggaggggaacaucacauaccagggccuguugcgggguggggggcgaggggagggaacuuagaggacaggucaauaggugccacagaccaccauggcacacguauaccuauauaacaaaccagcacguucugcacauguaucccagaaauugaagcaaaauuaaacaaaaaagcaucuucuccaccccuaggcagaggaguagguugugacugguuauuaucaccugacccuggccagcauagaagacaucuugccauucccuggacaccuuaguugaguuauuugcacuuuauaguaccauagcaguugaauuuuagcuuaaauuuaaaucccuaauuaaaccaucucggaaaauuacgcauugauguggcauugaaauuguuauuaugguucaagaggaguuuuggaaccagauuuuuuauaaaugaggcaaguacuuguacuggcagcuagucauacuucuuuuuuccuuacaaaacaugaucaggugcuguguaggcucuaggaaagagggauguccacccacaaauggaugaagcugugcuucauugcagcauugagauucaggcagauggauugccagugacguggcagacagugcaauuaauguaacaaaaugucaacagccuugggaauugaucauagauugaauucccagagcuagaagacaugaguaugauucagucaugcaucccgaaggacaaaaacccaaguguagcucacagcugacugucaaaagcaguuaauuucuagcuauaugaaguuuacagaaggaaauaaaauuacagauuuaaccaaauaagacaugcaauugagacuaauaccuuuggaggggccucagaauucuauuuccuguccuaauaauguucaagggugucaagauuggaaacacugcucuaaagaaagcuguaugcuuuuaacauucuauucauaaacauuauaacccaaaacuauucauaauaauaauuaguacaguaaaggcuuagucuuaaacuuugauuggaauaauaaagaagaaagcaauaugaaagugaaaucuuacggauuuguaucauguugccagguuauaacaaauuuuuaaauauacauuuaauauuucugcuuucacucuaaucauuaucaaauuagucauaucuuagaaaccaggauauaugauguuauccuauacuuauuuaaaauuguuuuguauuuuaaaauucuugggauuaugaucauucaguguaaacaauacugucuacauaguuacuuaauuugcuuuuuuuuuuuuuuuuugagauggagucucgcucugucucacaggcuggagugcaguggcacagucucggcucacugcaaccucugccugucggguucaagcgauucuccugccucagccucccgaguagcugggauuacaggcaccugccacugugcccagcuaauuuuuguauuuuugguagagaugggguuucgccauguuggccaggcuggucuugaacuccugaccucaggugauccacccgccuuggccucccaaagugcugggauuacaggcgugagccaccaugccuggccaauuuacuuucuuaaccuauuauuuuuaaaggaagaaaaagcaagccuacuuuuacuaaccauagcagaugugagaagauuuuauaaaacaaaaaaaggggaagcaaguuaccuggaaagaggacagccauuagaagaugcuuuugucuugguagaaaugaaaucacauuuguucaacaaaaugacagucacucuacauaaaacuggguuuuauuuaaagagaagaaacugggcgcacaauaacccagcagaacagaccccacccccauuggagucucagcuuguuucuaauuguauucugcaugauuuagauuggaauuguagaccugagucugucauuuggaaccaaacguccuguugcuauucauggaagagggaguuaacaauacgaaaucguuugcuuuccacauguuuugaacugcuaucaggaaggaggggccuuucagcucaauaaguuuuccauuucucccuacuucugucucaucucaaaaugcguuuuaaaguuaacugaacaauauuaagugaugaaaugauuuaaguagaagaaagauuagugagaaguaucacgauauucagagguacuugggggcuaauacauguuaaauuuuaaguagacugugguuacaugagucuuuuuuuuuuuuuuuuaauuaucucuugauaggcccugcuauuguaagcacaggaagagagaaaucaauacauuuguauaucugcccauuuugguuuguuuucguaagaaaaauaucuggagcuugugagcacuuucuguggugacugcugcuugggauugcuccuuccugguucccgaacccuggaugccaaacuucuuuguaggccuuucuaagggagcguacccugucuguggccuguguucagugcugcaauguauauaauagauuuucaaggcuuuuuuuuuuuaaguuaccuggaaaguuauuuuauuucaaucaguaaaugguccuaaagaaauugcugugcauugggcacucugccacauugccaacucacauuaccaccugagaguuuguugaggaaucauccgcaagcaauucguaggaggaaaaggagaccucaagagacucacuugaaagcuuuucugggccaucucguugcuagaaagucauucaacaaacauuugccaaugucgucuuugcuucuggaaaacugggaagcagaugugauugagaguucugauuugcaggcucagggucuggugagggauggcagacaugugggcaggugaacaacagcaccgaggggugggagcuguaguggaagugggcagaaguugcuguggaagcacagagguggaacccuuuuugccugagaacauuucggaagggcucacaaagacauggcauuuaaacagaaucuugauagaauuuggucagugcaaggggagugagaaggaguuuucagggcaguggauacucauguacagacaaggaguccugggagguggcgagagguccccauggccacuggggcuuaccgaacucagagaauagggagagauguggguggaaacccuggucacaggggcauucacuucaaaagaccauaccugaauccucugaaagccuaaaacguaguaggaaugaaaucauggauuucacaggauaggauagcuuggaaaaugagcacaagagcuuacauugcuuuuccucccauccucuucuaucaaaccacagauacuucucuuuuuuuuaaaccuuugacucugaagucuucagggcuuccgggcagaaucucuugcauugggaguugccuugaccuggaggaauucauuccaacagcuauuccuaaaagacuuucuguccuggguccuuugucucugugauugcuaagaaagcccaggucaggggucugucccuuccuucuggggccauuuaauuccacucccuucuguggcuacagacugagaugcuaagccacgaucccaccugagcugcugccacaauuagcuugauucaugcugucaccuuuaccauuucaccucaagaaaaaccugagaaggaaagaauugaugugccauagucgggguggcugcauauuuucagacccaguuuugcaaggcguaguuggauuaacuggacacuucagggaucucagucaguugcuuaaaacugaaccuaggcccuugguggugugagagacccccucuccaugugcagguaaagauccacgguaccuccuaccccccaguccaccccauguuaauuuacuuuuuaaauuaaaaaagugaugcagguuuguuaugaauaguuugagcaguugaaaagaauauagaauaaaaagugagauccuccuugcacacauacaugccuguggucagccagaucccaaaauuuggaauguauccuuuuagacuuauacguauguaucuacaaccauuauacguauacauauacaucacuuguuuuuacuaaaaagggauuaugcuccaaguguuuccugcaacuucauuuucccuaccuaaagugucuuggacauaugaugccuuuuacagcaaugagaauuugaggguaagucucaguuuuuauucucugugguaaagguuucuugauaaguagaguugucagauuuaucagguugcccaguuaaauuugcauuucaaauaaacagugaauacuuuuuugguguacauguccuauacaguauuugguauauauguucauauguacugaaaaaguauuugcuguucauuugagaugugaguuaacuggguuccccguuuuaucuggcagcucugcacuuguuaguucacuuacguaucauuggcuugggguuguuauuguuguucuaugaaaaacuuuucaugcacaaaaccuugaaaccauaaaaagguccuguuuccugggaaagguggugucugggccaguguucacacaccugaugaaugagaaagguuuggggccagcucagcugggcacccagaauucauuacuugccucuauuggaaagaacuggcccguguagcugcuuuguaguuggagcugagaccugacucuuucauccuagccacuaugugaaguugccacuaguggucaccugaaguugugugggugauauuaauugaauuuuugaaaaacuaaaugcugguauuuguaggaauuugcagugcagacgggcagccuuucaaccagugcauagcauaauuagagcaagcuuuuaagauucuuugaagugccaaauguuuaugaaauucaaauaggggugccaaucugcacaauaaaggggcccuuggugguguuuuuaaaaaucuucuauuuuguagauguaaauauaugccauaauuagcgggaaguaacuugaagagccacggcugaguuuauuccuauuauucuuauuuaaaacagcuguggcaggcaggcuacagcugcugucucaucauuggguugggcagggcauaagggccgaagugaacacacucaaagacucuuuucugagggcagcucguucacucccccuacaugcuggcuuccuugcuggggagcugucucacgguuggcccagcuuccccacccaccccaagccucugaaugucaaugggacuggcuucaagggucuuagccagaaggcacuugccugcaaaugagagggcgaggagccuuuuagagcagccagcuuucuccagaccucccccuucucucugcccauggcagugcugccucuaggggcacuguugccccacagccccaggcccagugcagagcgauuguccuuuggugccugugggagcagcugcaaugccgcacugcgugcccugccuggccgagccuuaccauguggcaggccuggacggcugcccgccacagggcccagcucccagcaccgccugccaaggagccagaugcuaccauuggaaaaaauugcuucacaauuugaaaucuugguucuuugaucauugcucggagaggaugaagaagagagguucaaaguaguguuuuaaaaugccagcgucucguugcagccaucagugccuauuagacugucucugguuggggacaguccucuugauguuuucauuuuugcaaccaggucauucuccccagcucuuccaagcccucuggauaggaagggaagguccacagccugcuccugacccugugccccugcugucccccugccucgcgccuuagagguuaucugcuugccuuuguuccagcaggcuuuuccccaauaaagcuuguaacaaaguuguugucauccgccaaaugcugccaccgcgugagcugcucacucccauucuucacugggcaggaguagccuucacuuccugauccuucugcccccacagccaggucuccagaggacggagguuuugcagggaugauccacucuguccccuggccuagcacccgccuccaaggacuucagaucccacauacuugggugaggcuucauucuuccuuacccuugaaaugggaagggucagucuuuggagaguguugcauuuuucauauuuacugccaaaaggcaaaaacaugaaauuuaaaccaaacagauccaggauggcugggcaugguggcccacgcguauaaucccagcacuuugggaggccgaggcagguggaucacuugaugucaggaguucaagaccaaccuggccaacauagugaaaccccaucucuacuaaaaaauacaaaaauuagugugguggcgcacaucuguaaucccagcuacuugggaggcugaggcaguagaaucucuugaacccagaaggucgagguugcagugagccaacauugugccacugcacuccagccugggcagcagagugagacucugucucagaaaaaagaacagauccaugaauaaaugggcuuacugaguaagagguaauagaggagaaacgaauccagacucuuaucuggggacuaaacuguuucaguuguggaaguaaugaguauaagagaaggaugauuugggaaagaauuuggaaacuuuugaugggguguauuuuuguuuucuguugcuguccgcuuccucugcccaucauugaaaccggcuucugcuucgacuuuuuguuguuuuucaggacuugcccacaaauagacccuaaagucuuuaauucacucaacacacguguuaaugauggccuuuuuuuuagucccagaaagaauucuauaacaugucuaaucaugccuuuugagaaauuuauaccuguuugagcuguuauacucaauacguaagacccgucauaaacacaaaucagaaaaaguccuaauuuuucuguuuggaaaaagccaguguugcaucugugccacacacccgacaaacguggguuggggccaagacuggcuccauggugacagucuuuaucguguuuauugauuacagacucuugucucguugaggaaaggugucagugucucuagaugugauuugaggcucugucuucaucucuauuguggucaauauuucaaauugacaagugaacaggagugaugauagguauuguuaaugacugugaauuuuauaguacauuauagauuacaggugaauuuuauaugcauuaucuccucauauuaccaccguggccuuuggaaacacaucaucuucccuguggauaaagaugagaaaagcgagacccaaaaagugauuccaaaucucucacuucugcugccugugcugucaguccagugucugagaugagaugacaaaugagaagcagcauucacagacgccuggaccagugucggacuggaugggaugaguggaggacugaacuuuguagaguuuaacaaaaguaaauguaaaacuugaaucuugggaagcaaacagaaccugaagaacuaugugggugaggaggaggagaggaauggugaaguuaaggaggaaaggagagaaaacugcagaauuguguuacagaaguguucuucggucugugguacccgaaguucuggauggaaguuacagaggagcucauuucaacuuaacagauguaauaggcagcaucauggauccccagacaugccuccucuguagccauggaaucuguggauaaugguacauuacauggcaaaggggaauuaaaaguuguuaaucagcagauagaauaucuuggauuaucuaagugggccuagcauggucccaaggucccuuaaagcagaagagggagacaaaaaaagacauccagagagacgacagcuggcaaugugagaaggauucggcugguguuucuggcuuugaaaauggagcaaggggcuccgggacaaggaauguggguggucucagaagcuggaagaggcaaggaaacagaacccucuucagagccucugucuaguaaggaguugcgucccuucuaguuccuugaucuuagccagccuggagcugaauuaaauuucugaccuacaggaauauaaaauaauuaguuugucuuguuuuaaggcacuaaaugugugauaauuuguagcagagaaaauuaauauaacagaaaaaagcauuaacaguuaaggcugucuggcaauauuauuauuauuuauaaauagagauggggucuugcuguguugcccaggcuggucucaaacuccugggcguaaguggccagcgugccuggcccagcagcauuauugaagugauuuuccugugucugaaaguauuuagcuuuaaggcagugcaggucaggaugcuguggaaaggauuucugcuuuuggagguaggagagaguugaccucugaacuaaguuucagcuuagcguuuagggucucuguuucuagagcaaacagggagaagauuucuuagaaggacucauuucccuggacuuaccuuccccagccauauuucuaaguguuguuuuuuaacacugcagaaccuggccuaugaccagccuuuuuggcuagcuugugcccagaagaugggauaugguuugacuuuggaauuuauuggaaagauaaguuuuacuaguuuucaacuguuucuuggauuuuuguuuuuauuuacuuuuagaaaauauccugugguuagguaaaagcugauuaggcagaaauaguuuguaucucugauagugguacauuuuuaaaaacucauuuucuugccuucagaacuacaugaaauagguuugcuuuccaccuggagugauuuucaguugggaggggggacgugucaguaggguagauaaugaacucugcaaaucccagacuucuuuguuguugacuuaaugcuagcauucuuucuuugauauuaccuucacuucaugggaguucagugacugcauuucuuucuggaauagccauaacacuaucagcugacagauaauuauauauauauaaaauuauauauaucuugauaauuauauauauaucuugauaauuauauuuuacaucaauacuuccuccuagaaaauuccugaagagcaucugugauaugguuggauagcuacauaauuauuuuccauguucaaggguaauuacaaagcaguuguaauggcaaauugguuauuuacuguuaguugggaagccuuuuaaaaucuaaucucuuaaauuuacacuaauaauuaaauagagaauuuucucagacuguuucucccuaccucuuaucuaaaugaaggauaaaaugcacguagacucuaugaccgaguaauuacacuccuaggaacguccaacagaaacacauccauaugucccucaaaagcauauucaagaacguucauaguagcacucuucuuaauagguccauuuggaagccucgcaaaugucccuaaguaauaggguggauagaucguggcauuuuucauucaauggaauauucuacaguaaugaggaugaaugaacuauauacaacaacaugguugagucucacaaauaaaaugcugaguaaacaaaacuaaacacuguaaacccuguugcacuugcuuaaaguucagaaaccagacaaaacuaaugugugauguuucaggaucaugguuacgcuggcaagguguauagaugauugugccuggaaggaaggauauuugggggagagagggacuuccauuucuucaucugggugcuggcucacuugaugaaaauuaaucaagcuguaaacuuccaguuuguguacuuuucugaauguauauuuuaauuuuauguaaaacuguuaacuuugacagcuuuaaaacauguaauuuguugggaugguuucugaggguagguuggguauucuuuaauaacuuuguuuugaauaauucuaucauuguaacuacagaucauccauuccaaauggaagcuauauuaaaguuguuuggggaguucuaagagauaaugguaaaccaauggugaggugguaggaauggucugccgcagcugcaagcaguaaggacuuugcuuggcuguagggaauuuacaaacaauggcaaaaccaucuaaaaaaucaauuuucuuuuuauuaucaccauauuaacugacaaaaccuccuuuguuggccugaguccuaaauaauuggugaaguuaguguugaauuuuuuuaauuacuuuuuuuuugagacagcaucuaguucuguuacccaggcuggagugcagugguacaaaucauggcucauugcagccucaaacuccugggcucuaggaagcuuccuauuuuagccucccagguagcugggacuacaggcacaugccaccauguccggcuaauuaaaaaaaaaaaauuauuuguagagauggcaucucccuauguugcccaggcuggucucgaacuccugggcucaagcaauccuccugccucaaccucugaaagugcugggauuauaggugugagcugaauuuuuauuuuuuauauauguauguauacaacauauguugaauuuuuauuuuauauauagaacaucuauaugcuucaaauuagcaagcacauuauccauuauauuacuucuccuucaguaacacauguggacucagccuaguacucauuucaggugcagucugaguccacaguccccauggugcuccuuguuccagugguuaaacagauuugucaaugagcaacaauaguagaaugauuaugaagaugaggaaacagaacuuuuuuuccauuccuucauucucuguuucugcuuugggaauuuuuacguuuacaauuuuaaauaacugaaguagagugcugguuauuguugaaagucauuuugucaaauaaaggaaggcggucuuaaaaaugcgucagaucugcuaggugugccacugcugugggacagcugcuuucaccagcguuacuuaagcauggaaccucguacagacagaaccguaacaguugugaacauauucagcaauuuuacuaacaucaugaugaauaauaccauucuaaacuuaguuaacauuuuaaaauuauauauauugacagauuauuuuuucuguuuuaagguugacaguuuuuaaaaacaaucuauuuacucucccagugacccaccugcccccauacacaauugcuuauuucacuguguucccuuccauaguccagucuguacaccaaaaucacuagacugcuuucccccaugcuuagaaauagggucuugcuacguugccuaggcuggucucaaacuccugggcuuaagcgagccuccugccucagccuccugaguaauugggacuacagguauucuaccacacccagcuugcuagacugcauuugauuauuuacuagucuuucagaacaacuugauuaaucaaaaucaacuaguacaauguuagcuuacaguguauucauagcacauggagacucuuuuucaaagcuaggaauuuaaaguugaaagaaagaaaaauaauuucuaaugcaccuuuucugcucaacacaaacuuauugcagcaucauugggaagcaucauagauauucaucaguagagcguguauuaaauuaugguguaucugugccauagaauagugugcagccacuagaaaguguggcuguucauuauuucaaauggcuguacuuuauaguacugaaauuccauguuaguacuauaugaguucuaaguggcauagguauauauauauguuuaacgcaagguuuuagaaaaguuaauauaaugugcuacuguuugugugauaaaggaggaauguauaugcuugaauaccuaagugcugaauaucucugaaaggacacuugagaaauggauaacauugguuaccuuuagggagguuggcaaauuuugggguucaugcccauuuuacaguuuuauuuuucccccgucuuuaccacaugcauguuuucacuuuuuuaaaaaauguugggcugcgccaggcaugguggcuuaggccuguaaucccagcacuuugggaggccgaggugggcggaucaccugaggaugggaguucgagaccagccugaccaacguggagaaaccucgucucuaccaaaaauacaaaaaaaauuauccgggcaugguggcgccugccuguaaucccaguuacuugggaggcugaggcaggagagucgcucaaacccaggaggcagagguugcggugagccaagaucgugccauugcacuccagucugcaacaagagcaaaacuccaucucaaaaaaaaaaaaaaaaaaucuggaacguuuuggcacaggcuacaucauaauaauaacagcauuaauccugccaccauaaagcaccugaacugcuuuucacagcgaaguauucuaaggugucagcaaagcgaggcaguggcaguucuugaagguaacacugccauguugaaagcucgaugggaauuccaguguucagagccccugugugccugagguguaugguagccccucugcccuggagacuggagcucaguuagacccaggggccucuucagccuugggaguucagaugcugaucucauuuagggaaagacaugcaugauuuccugcugagcugcucuuuuguggagccaaauguuaaaccuuugaaugugagaaaaaugcacaccuggguauuuuuguuuguuuaugauuuauaccccauaaaauccaaaaugcagaaugugaggaaagcucacuacauuuauggguaacauaaaaccggauaaguacaaguuaaagcagauuggaaaccaguaaaaggagcuguacccugacuguuaguagcuauuagaagcaccugagacaaguuaauuauuguaguugaacucugaauuuagcuuugaauuucuuggcacauaaggugaaaaggggaauguggaguacaugguucucuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccuugugauccgcccgccucggccucccaaagugcgguucucuuuauuuguagacagaaaguaggaaguuuugccuaaggaguuggacauuuuccuaauaaccaauucaaaaaggaaauuuaaauguagauacuuauuuuaaaguauaugaugacucaggucuuagugguuagugccugucaagguauaaaaauuagccagucagaaucugccaaaucuggagcaauacggugccucacacccguaaucucagcacuuagaguggcugaggugggcagauaacuugaggccaggaguuugagaccagccugggcaccaaggcaaaacccuguuacuacuagaaauacagaaauuaguugggcgugguggcacaugccuguaaucucagcuacucaggaggcugaggcgggagaauccacugaaccugggagguggagguugcagugagccucgcaccagugauuccagccuagacgacagggccagacccugucucaaaaaaaaaaaaaaaaaaaaaaaaaagugccaaaccgcacaaaauauaaaaucucauuugagugucagauccacguaccucugcuucaacaaccaccacggcaguccacauuuaucaucucucgcuuggacugcuauaauggccuccuaguauauauauauauacauacuuucugcucucuuccggagucuucuccgagccauggucagaggugccuuuuggaaggcagagcugguugugcccugucacuguuccaggccugucugcucacuguguccuuuggucucaggauauuucaccucuccagcucuccugccauccucucucucuugcuuucucuuuagcgcuucuuucuggcucugugcccucuucucucuuauggaaugcuucucuugccuaagccucgucuucuuucuugggaucugaguugcaucaucauuagaagugucccugacccugggggcccacuccucaccguuugugcucguguccccccguaccucucucccuggugcuuaguuccgugugguauguuccucacuuaauuguaagccucacgagagcaggcccuggcucagcuuuugcuuuuuuuauccgcagcucugagcauugugccggaugcggagcaggggguugguagauacuugagggaaggcagcuauuacucuguggcugucuuuggucuguuuugugcugcuacaacagaaugccacagccuggguaauuuauaaagaacaaaaauucauuucucacauuucuagaggcugggauguccaagaucgaaucuguagcaucugguggaaggcacaugaagggccagagagagccagcuuacuccugaaagcccuacuuauagcagcguuaacccauaugcaagggcagaggcucaacaccuaaacccaucccaaaaggccucaccuccaacacuguugcacugggguuuaagcuuccaaugcaugaauuuggugggggcacauucagaccacugcaaugaucaaacgcugcagcagccaguuuccccaguggacauugcauccugcugaagacauuucucucugaagcacagugcuaaucauaccacuuccuuggcacgcaggcuuucaagggaguauccauuuccuacaaaauacaaucuaaacugucuucuucgcccccauaaccugugcccaaguugcauuuccaaacucccagucugagguccuuaauccaugcccagaagcuagaaugcagcacuccaggccuuggccugcacuguacccccagccuucccugcaugugccagucuaaaucauuccucaacugagaccaccuguggaaagucauaccuuccauugcugcaacucuaaguaucucugacaugguacuuauuuucuaucugaaugauaguuauuuuauguaucuuccauaucaguuguaggcaaaacccguacauugucuagcaugaaccuuucauaguaggugcuuaauaaaaauguguuaaaugaauggcaacuuaagucauuauuuaacaucuuuguaagccagucuuuaauaggaaccauuuccccuccagauauucuaauuuuuaagaaaguuucuguuuguacauauaugacaaauggcuagucagcugcagucucuuguuuuuuuuaaaaaauaucucuaaagaugagugaacaugaauccaauuaauauccugcuuucugugcauauuucaaagaccuuguggaucuuuuauugcaaggguauaguaguauucugauacugaaugcaagaaaguaaaacaaaauugauacuuguagcaugucauuucaagagaggacugcccaaauuagcaaacucuuuaaaaaacgacagauggguauugaacuuguuucuagaugagcaucaccuucccaagccagcccucuucauucagccaagcagaggucuuacccugaaaguuacugcucggugccaugacuccugggaugagagaauaacccacaccuccauuuccuuuccaacaggcugauuuaaacugcaauauucaagaugaugcuggggcuuuuuaugguguaaccagucaguacgagaguucugaaaauaugacagucaccuguuccaccaaaguuugcuccuuugggaagcaaguaguagaaaaaguagagguaaguuggccucuguauacuggaaacuucauucaagggcagacuguugccuuccuuuaaaccuuccuuggggcagagaguuguauuuuuggaugucugcuucuuaccuucuguauuaguccauucucacacugcuaugaagaacuaccugaaaauggguaguuuaugaagaaaagauguuucauugacucacaguuccacaggcuuaacaggaagcaugauuuggggggugucaggaaacuuagaaucaugguggcugaaggugaaggggaagcaaggcacgucuucucaugguggcaggagaaaggugggugggaaccaccacacacuuuuaaaccaucagaucuggugagaacucccacaguaucacaggaacagccugggggccaccugccaccaggccccuccucugacauguggggauuacgauucgaguugagauuuggguggggauacaaccaaaccauaucacccuccuucuuucucccacuucuuuuuccuguuaacuucuaaaaagccaaagugauuuggaagcaccugaaaggaagcaaauaggaugucccgugccaguccucugacugugucugaagucagcugugcccugcucagccagugcugugcaccuuugcuugaggccuugugggguagugugguaugaaagcugggucgagauaggcccugccacucagaaugaugcccucccuacacccaaccccuagguccaagggcacucccaggcauuguagauagacgucaaggugguacucagcugauuggcaccugcccucugaaaccaugauaccuugaguuugauauuguugcuuuugccauuuccacugccuucgcuuuuaauuguuuuagauagaguuuauuauauauuaggauccaaucucuuuuuacggcuuuuauguuucauaccuuccucccuuuaaaaagauguauauuuguuugaucagggugaguugcuuuguugaauaauguuuguuguuggcauuccuuaaagguuguauuuuuuagugucuucuauccaucacccaauuaauugauccauguucagugagcaguuuuuauuugcaguggccccagaccuuucagguucaagagcccaccuuagcuguacaaagacuuugugcugaggagggagagagggagaaggauauauuucuuaagacccugggcuaagcaaugaggauuugggaugcugcaggcccucguagcacaagcccccugagcaauggacaggccuuaugagaauguuguugaggaaagguuaugcuggcagaagaggauccaggggaguugacucagauggacaauuuaagcuuaggggucaugagcuuucccacaaugguggcagugggaauccuguaagauguuuugaauggaacuuagaaacuaacuggauauuaaugaggaggaagagucaaaagucacacucacauuuuaugcuuggaaggaugguacugccacuaauagagauaaggaaauaagguguucaagaggaaauaggcaaugauuauagaugcaagacuagaacuuggaugacagguaaagacuggaaauauaaauugggaauccugagcauuaaggauugggaauggagaccuagcugcagagagggaauagaaagggcacaggaauaaggauuaaauuuggggagcagccacuagcccuaggauaaguagagggagacauaaacagaagaacagaggacaaaaaugaguggggagggcgggaauuggcucaacauaaugucuaggaagcccaggaggugagaagguggcuguaucaugaaacauggcugggacgccuggaaccagaugaccuccucgccucuaagaaggaggaagcaaaguuaccugugugugauugggaguguggaagaugaguguuaggcaauguuagugaauagcuaaguugucagggauguucucuguaguugaaauucccugccuggacaggugcauuugagaaaagaugaaccagacagcuuacucaauuucccaaaugucaaauuacugguguccucagacgauacacccaaagcucuaugcaaauucagggagcagggaaagguugcucuugacugauaaaaucacaggaauuuuuauggagaagguggugugcaugguaggugggguuuuaccuuuaagccuuuuaucuguuuagaaugugugucugcauuuggugugaaguaguaguccacuuauauuuucuuccagauaggcguuuguaucaaaaccacuuaugaaaugauucauucuuucccaguuaaacagaucuguccccuuuaaauuaccauauauucugagagcuguuccuggagucccacuguucuauuccacccacuauuugugucuacguaucccaguaccauguggauuugauuacaguggcuuuauaguauauacugauauuugaugaggcgagucaggcucacuauucuuuuucauauauuuucuaagcuaguaaccaacauuuauucuuccaaauaauucaaucacuuaaacauauaaagaaaaacaaaaaccuuguuugagcaaucuaauuguaauugcaucaaacuuagauguucuuuuggaaaaauuuuauauuaaauauuucuaaucaagaauguauuugcauucucauuucauuuuauguauuucaauaagauuuuaucauuuucauuauacagguuugucucuuucuuguuaaauauauuucuaaauauuauauaauauguuguaauuuccuguuucuagauucgaauuaauagagaaaagcucuugauuuugcauaucugucuucaauauggccaucuuagcaaauucucauacuuaacuuuaguuuuucccccagauuccugggguacccuuguauaguuaacugauguuaguugaaaaaguuuugguguuuugcccuuuaggauuauauuuacuguaggcuuuuauuaauggucuuuauuacuaauuuaaguguuuucuuucuauuccuauuuuacuuaggauuuuuauuaguuacagcugcaauacguuaucaaaugcuuuucagcaacuguugcuauaugauuuuucuuccaaguuguugacauaacaaguuaauacauuuccucaauguguaugaaacaccauagcauuucugaaacagucuuacuuuggauuuauuguugcauucuauuugcugauauuuuacacagaauuuucacauuacauuucauaaguaauauucgucuauacuuuuuucuuuuccuuuuuuuuuuuuuuugagauggggucucacucugucacccacacuggaaugcaguggcaugaucuuggcucacugcagccucagccucacugggcucaagcaauccucccaccucagccuccugaguaucugggacuacaggccugugccaccaugccuggcuaauuuuuuguauuguuuuguagaaaugugguuucgcuggucugaaacuccugggcucaagcgaucugccuaccucagccuaccaaagugcuaggauuaaaggugugagcugucacacccaacuauauaccuuuuucaauaaccuguuugccaaauuucagucuugaauguacacuaguuucauaaaaagaauaacacuggaaauaacuauucuuuaaagauuacauaaaacuuacuccugugaaacuauuuggucuuuauauguuuuuuagcauguacuuuuaauuaauuauuuuuaauugauagauaaaaauuuuauacauuuaugguguauaacaugauguugugaaauaugcauacacaguagaauggcugaaucgagcuaauuaacauguauuaccucacauagcuuaccaauuuuuguggugagaacacuuaaauauucucuuagcaguuuucgaggauacagcgccuugguauuaacuguagucaccauguuguacaguagaucucuugagcuuacuucuccuaacugagauuuuauaucacuuguggccuccaccuuuuucagugguaaauagcuaaacuuguuaguuguggucauuuccacaaugacugaucuauuuguugacauuuuccccuucuuuuugacucaguguuagcaaguuguauuuuucugggaaagcaucucuaucugcuguguuuucuuugcuuugccgugugugugugugugugugugugugugugugugugugucugcuuuaggguuaugugaaauaaucucuuauguaucuucuaauuuguacuguaauugugguuuugccacuuuucuuuuuucuccuuuuuacuuguaugaagaguuuauuuugucugucuaaaggaccaguuuuuaauucugucugcauuuuaaauuucuauuucauugauuugagcuuuuaucuuuauuaauucccuuuuccuggcuuccuuugauuucuuugugguuuggguuuuuuuuuuuaaggauguguguuuuauucuguaaauuuuuaccuuuaaugaugaagacauaugaggcuacuucauuaaguuuccuucaagugcagcuucaucauggcugauacguuuugauguaaaauaucucccuuuucauugcucuuuaguuuauaauuuucuuaauuccuuuugauccaagguuaucuaggaagccuuguuucuuauuucugaguuauugaaacugcauauauacuaguauuuucuuaguuucuuccuuucauaaacaggugacauucaggggcucaugauccgugagaaauaaucaguuuuuucuaaaguagagagauuagcuauauugguuguuaaccuaugaggcuuuaucacaauaaagagauuuucuuugaagaacuguagcuagcuggggccugcucuuacagaucuccuccagguaaagcaucauaauuaggcaguuuuauuuuuuucugaccuuugcuaaaaggaucugucaacgcuucuuaaagcucucaucuuuccaacuaauuuuuuaaaaaacuuccagaaaaauaauggauucuauguauagcaauaaauuuggagauaguuuuuuuuuaauuaaguagauuacguaaguaguauagcauauagaagaugauucauguugaaaaacuaaaaugcuuuuaugggcaguaauaucuguuucauguguuuuggagucaaaaguguaaaaauacugaaauccuuuuuuccucacagacggaguaugcaagguuugagaauggccgauuuguauaccgaauaaaccgcuccccaaugugugaauauaugaucaacuucauccacaagcucaaacacuuaccagagaaauauaugaugaacaguguuuuggaaaacuucacaauuuuauugguaaugguuuugucucuuuccucugugggcagaugcugccaugaggcuugacagaagugaggaaggugggccugggaggcgcugggccugcgccgagggaacugaccagguuguuggauuggguuccuaguggucagucagcaguugaauuugcaucauccauagggaaaacuugggcuugauucuguagaagagaagggguuuuaucuggcugggguuucuaagguucgcagaacuggaauucaguuggguaauaaaaagugauguguuuuuaucucuggcugcagaguagaaaggccuggagaacuuuuaaacauccggcuguauccuagaucaauuaaaucaggaucugugagaacaggacccaggcauguguauuuuuuuaaguuccgcagguaauuucaacauuagccaaguuuuagucucagcagcaacaugguaugcaaaucaggcaaaagcugaguugguauguuuguacuucagacauaccuugacauguuccaugauggacuuccaaggccuucuaagaaguuacaugcauuaaggcaggaaaauauaagcucucaguaccagaagaaauauaaauuagaauagaaugcauggaaugcagugaccaggaggaggaaaauguucuucauaggcuaaaaaaucuggcuaggcugaguacaguggcuuaugccucuaaucucaacacuuugggaggccaaggugggaggauccccugagcccaggaguucaagaccagccugggugacauagugacacccuaucucaaaacaaacagacaaaacaaacuuaaugggcagcuaaaggaaagggaaaauaguguucaagguccaugaugggaaaacucaccagugccccuggaugguucuauguggguuuuccccuaauacuuaacuuuaaaacaaauuucuucugggagcuuuauuuggggacuucagaaguuguuaggaacaaugucauccucaaaauagaaaauacucaguaauggguuucauaaggcucauuuaaaaaaguaacauuacuugauuaaagggaaaaugccaaaacaaaacuugagggaaacaaucuuagcaaaagaggggcaacaaggcuauacuguggccaaauacuccucugaaagccuacuuuauuccuuuuuguuacuaggauuaagaauccauacagcaggaauucuuuacuugguguuuuugguuccauugggacaguggcuuucaaucagcaguguucuguuuuuuuguuuuguuuuguuuuguuuuuguuuuuuagaaaggcuguuucccaguuucccaaaacucuaauuuauaccuuuuaccuauuucugugguguaaauaugcccuucaugggcaauuucaagcuaccgauagcuauucagcuaaugaaauuccuuaauauuuaacaauaauuuuuaugagccaguaggagccagcuucuauacaccauuguauaaaaaaaaauaaguaacauuuaaaaauaaaaacccugugcauauuagauucauccaggaagguuuaaaacaucuaaggccuaggccccacccuggaugaauaaaaugagucccuggagauggggcccagcauccugguuuuuauuuuuuaagcucugcauguaguugaagugugcaaccagguagagacccacugcuguaagagauugggaaaugagccgcaaggacucucagaguuuauagacacaugauuggcauacaacuagcaaacagauaauuuugcauauaauuuucguuuguuccaagaagagaaucuuaauggguucucagaugugcccauguccuucuaaaauuuagaagccagcauucaggggaaguuuggaauacaugcucuuuaauaacauugaucaguauuccuuucuuuaauggcccuuuggugaaaauagagcaauucaagguuugcaggacuggcauauagcaggugcuugacauauaggugcuuccuguugcuaucuaagaauagaugcaucacuuuagcagucagacgaguagaagguaagugugacaucuacugaggaucuuaaguggccucaggaauuaaccaaaacucugaaugaauggcuucccugccucucuugggggggagucuuagcuguuuauuaaaaaucaauucugauucuguuucugcaugcuaaggaugcauguucucaguccguaaaacucuaccucagagagcacagcuaagauaaauguggccuggaaaaguguuaaagccccuguuacccacagaaccugacuacaguugugcacugcauagcagugugaagggcggaccacguguaugguagugcucccauaagaugauaauggaggugaaaaauuccugucaccuagugaugaugcaacuauuauauaauacagcauaauuauuuuuaaaaauaaauuuagguuagccuaaguguacaguacaaaaguuuacaguaguauacagugaugcccuaggccuucccauucacucgucacuuacucagugacucaccuagagcaaauuucaggccuguaagcuccacgcaugguaagugcccuauauaggugaacuacuuuuuaccuuuuauaccauauuuuuacuguacuuuauguguagauauguuuagauacaaaaaauacuuaccauuguguuguaauagccuacaguaaucaguacaguaacaugcuauacagauuuguacccuaggagcaauaggcuacaccauauagccuagguguguaguaggcuguaccgucuaggucugaguaaguacacucuaugcuguugguucgcaugacaaaaccaccugauuacacauuaggagguguccucauuguuaagcaacucaucacuguauaucauuaaugcugccuugcaaaauaugacuucaaccaauacagccauccagauaacuuagcagguuagauuaauuucaaaaugugucauuaagcaacuaaauaaauuccuuuaauauggagaauuaauaccuaucaaucaauauauauuagaauuaauaguuuaguuuuagaaaaacugaaauuaagccagcacucuuggauuuugaaaauaaaaucaucuaauugaugaacaggagaaauuguaccucauauaaaaugacauaguauuugcagauaacuuauacaaaucaucucuuauacuuuaaaucaucucuagauuacuuauaauaccaaauacaauguaaaugcuauguaaauaguuguuauacuauauuucuaaaauuuuuauuauuuuuauuaugucuuuuuucguccccaaauauuuuccaaucugauauugauuggaucugccaguguggaaucgcagauugggagggccaacuguauucuuauuuaauagaaagcuugcaagaaguuugaauagguuguagaggugccaggugcugugcuagacccuuuguaaauguuauguaauucucacuuucagacuaugaggucauuuuucucauuuuauggauaaagaaugucaggccaccccgaggucacagagccagugauggaaauaaauuugagauaccaucucacaccaguuagaauggcgaucauuaaaaagucaggaaacaacagguccuggagaggauguggagaaauaggaacacuuuuacacuguuguugggacuauaaacuaguuccaaccauuguggaagucaguguggcgauuccucagggaucuagaacuagaaauacaauuugacccagccaucccauuacuggguauauacccaaaggauuauaaaucaugcugcuauaaagacacaugcacacguauguuuauuagagcacuauucacacuagcaaagacuuggaaccaacccaaauguccaacagugauagacuggauuaagaaaauguggcacauauacaucauggaauacuaugcagccauaaaaaaugaugaguucauguccuuuguagggacguggaugaagcuggaaaccaucauucucagcaaacuauugcaaggacaaaaaaaccaaacaccgcauguucucacucauaggugggaauugaacaaugagaacacauggacacaggaaggggaacaucacacaccggggccuguuguggggugggaguagagggggaagggauagcauuaggagauaauaccuaauguuaaaugaugaguuaaugggugcagcacaccaacauggcacauguauacauauguaacaaaccugcacguugugcacauguacccuaaaacuuaaaguauaauaaaaaauaaauaaauaaauaaagcuaaacuuaaaaaaaaaaaagaauggauagaaaagaccuugcaagguaucuuauggucaugaaaucaaaagacuugaguuuaagacuuuauggccuuggucacuuagucuucagacaucaguuucaccuugauuuauaaacagaaugcucaagucugcacuuucuaccucagagguuaucauugaaauauuuuaauucagcuaagcugugagagaugguacugccuucugggauacaaugcaaauaaaacccagcacuugucacguaguaauucaugguccuucaggaugaaagaggcagguaaauaaaccauugcaagcaaaugauggcuguaguguacucgugaaacagguaccucugaaaugcagagugaugagguagggauucucagggauguugccucgauggauaaggagacaucuuucugauuacuaagaauagggguaucccauggguacauacuuagguaccaggggcuggggugcuauggugaauuaggcaggugggccgccauccuggguucugaugcaggaggcaggcaugcaucaagucaucacaaaauaaaugaaaacuguagcucuugcuaccuggcagagggacgcagggcauucguagaacaggggaauuugaccuaguucaggcggaagcugaggaaggcuuccugaggaagaaacaguugagagcucucugcguggugaauaugcaaccaugaccaaacgaaccucucagcuccuucccugucaaagagcacccacuccuagaggucguaugauaucauaugagacaaucuguguaaagcauuugauacugaguagauggauaguaaacacucaauauuuguuggcuauucugaugugaauuuucauucauucagcaauuauuuauuuauuuauuuauuuauuuauuuauuuuugagguagagucuugcucuguugcccaggcuaaagugcaguggugcaaucuuggcucgcugcaaccucugccucccgggcucaagugauucuccugccucagccuccugaguagcugggauuacaggcucccgccacugugcccagcuaauuuuuguguuuuuaguagagacgggguuucacaguguuggccaggcgggucucgaacuccugaccuugugauccaccugcauuggccucccgaagugcugggauuacaggcgugagccaccacgcccggcccagcaaauauuuauuaaaugacuugugugccauguccucaagcuaguugcugggaaacagggccccuguuccuuaggaacuuauauuccacugggugagauggauauuagaaaaaaaauuguacacgccaguauguguuuaccaacuguauagcaugcugugaugggaaaaugagauguacugcaagacuauucuuuaaguagggacuggaagcuuggauaccuuaagagcaagggaaacuaaacaggggaaacagccugauacuuagagggaaauuaggccuauaacaaacuggaagaggcucucaaguucaaaauguuuucauucaaacaaugcuuuggcguaaucaaacacaaaaguaacagagucacugacgcguuucauguuuuugcuugauuagauuugcucuuagaaaguuccuucugagaauagcauggggaauugagaccagagugaggacagaaaggagucagggucugugugguguggagggagcugcaaugauuugggcuggagaacucaaaauacgagggauaauuagagggauucaagagacuggaggggaagcaugaguauuucacaauacauuuugaaagauaaagcccaugucuauggaaagaaugucauuccacaggauucuaccuaucccacuguuccuugauucagcagauacuuuucugggucuaggcacuacugguuaacauaguggugagggaggcacuccugcagcuucucuguccuuggcuauugugaaacaagauuuagcagaaguuuaagacuaggaugggaaaaagaguggauuuuaaauguucucaucacaaagaaguacgugaagugcuugguauguuagccugauguaaucgucccacaagguauauacaucuaucaucacauuguagcccauaaauauauguacugcaagacuuuauucuuuuagguagggacuggaauuauuacuugucaauuuaaaaauucagauaaaaaauaagacaauuucuuagaguaaaugauugccuugcgggacagaauuaaagagaauucuuuguuguaaagaaaucagcccccuaaaaaacaaaaacacaaaugugcuaauuuuugugguccuuucuugggcauagauuaugagugacccuaucuagaagguauuucuuacuuaugauaaccacguuuagaugggcuucaggucauaguuguaguguucugaaucuguguuagaggacacagagugaggcugagcaaaucucucuuggacuuaagacuuguucuucuccaauuaagucauagucgucauacacagauggaauauguuuucauccuuuugguauuauauacuuuuuuuuuaucuuaacaggugguaacaaacagggauacacaagaaacucuacucugcauggccuguguguuugaaguuucaaauagugaacacggagcacaacaucauauuuacaggcuuguaaaggacugaacaugguuauuuauauauauagauaucuguauauacacacacacauaugugcacacacacacucucucuccauuaucgaacgacugacuguaaaccucaccacacaggguggugcccuggccccgaggucaccccgacuuuucuaaaucuuguuugagugaagucauuuuuucauguguucauacuaucauuguagcugugaaguucugguacaguuguaaaaagagaaauugaguuguuucucuauguucuucagaugugcagcccacaauuccucgggaaaggugaaccugaacaacccaagucucucucugcagagcccuguuucuaauugugguagaaaauauugagacagagcauuugccaugggacauuuacagccuuuauacaaauguauuuaguucucuuuuuuccaacauaaaauucuuguuuuaagauacaaguaaaauuaaucuuuaaauauaaauguaaauuaguacacaaaacuaagaaucuuuagacuuaucuuuguaacuaauuaggguggaaguuaugaaagaauguaauucacuaaauuauuuuuuaaaugaaaccuuuuuuuuucuuuuugaaaccaaauguuaaacuauagccuuaagaaaugcuugguagaaguguccuaaugagacaaauuuguacuuuuauccucaagguuaacacuaaucuccuaauccauuaaacucuugaacagguauuacaaaggaagaaaacuucaccccuuauccuuaacauauauaguauauuuaaaaaauauaaaauuguauuguacuaaugugaugauggauuauuuaaugaaaaagaaaaaauggcucuuuuugcaauaaguagauacauacugaaaaaaucuaaacuuacaauguuuauagucuugugugugcaguuauauuuuauauggacgaccaaauuuuuuauuaagaugaguaaauauuugaaccacugaauuuuaauaacaaaauuuuaaaauuggcaugaauacggaauacugcacugugagaugcaaaguauacagaaucuguggcugggagaaaauuucaucaaauagacaaguaaaaggcucaucaguuuuagcaucucugcuccccagaaaauuguaagcauccucaccagccuguggauacauucuuuauuucuagugacccaauaugcauauuaaccugcuauaacuagggcuauauguguagguauguguauacauauacacaaaugcacauauagaguuaacacauuuagugaacacuuguuuagugucacucaguuugcuaggugcugauauguacguauaucucaaugugucuguagacuuagauacauccucuugaagcacauccauuucuuuagcgucucucaguaaguuacaguacuuguuugacuuagguuuaagaggcccagcuaccuaucucugaccuuuucaaauaggcucauuugggagauucuuuugccaggagagauucaacuuuccaaucuaaguauuccagagcauugcccaggcagaguugguuugauguggccagauguuuugaguuauuucccuuaaguguuucacuggggagagaacagggagugcuccuccagcuucccaaagaaauauguuuuuguaagugguaggaacaugugcacacaauagaacaugaaauaaguuuuuuaacuuguaaaacaugucaagauuuuuccaccaagcuagaaaauaaaaaacuuaguucuaccacauccaauuaacuuacacacccccuucccugucucaacaccugcuuugacccugcuuuucuauuauuacaucagucagcaucuuguggucccuaacaugaggauguggcuggcucgugggaaacagcaaaacacuaagccugaccucucccaaauugggaagaccagaggagaaagugcaaaacuguccccauuuggaaugcccauuccuucuagaaaccaguuggacagugcuccucugcccuucauaaacagacuacuguugggucccugauuccaggcuggccugugaaggauugccccagguguccccuuucacgguugucacauuuacagugacuucuguugaacaccccucuuagggauguuucuuuugcucuuauuuccugcaucuuuccuuaagggaagccccauccucucccaggaccaggaguuuaugaccaggcgagcacaaauggcuaaaagccaagcuguccuagaacuucagugggagagcugucugguucauauucuacccaggaaugguacuuuucagugcagccaggagggcucuugggauuuccuuuccaaagcacaaaaauacugggacccaagaagaacagcuagaggacaacucuguuggcacagagacggggacagcccagucugcugaccucacagggucagcugggccccccuggugcuucaccaccugcauccucuugcucagaaugccuuugcaguugaguuuucuggguuucuaugauugaccuugagguuuacuccuugcucuuacaacauuucuaaggauuuuuaaaaguuuacuucuugucuuguucuucuaaagcuuucuccaggacagauauuuucccugucuuaaccacugguccagucaucccagugggcuucucuuugucucucccagauuagaccuuugggugagauuggcaucacaacaucuaaucugagucugucuuuuguccuucauucuguauggcagucucccuuuguuauaaaagcuuucuaaagcauacuaaagaagccuucccagagccccgucuugcuucucuuccaggugcucuauccccucgagacccucuggugccaggcuugcuucacggccaucuuguguugucacugcagaguuuggaggccaguuuuccacagccuaaacagggaggagcugcagaauggggcucuggucucugggcauucauuucccucauagaggcugagaauaaaacaaggacuuauucacacauguucuagaaccccagaauggcccaaguuaccugagaccaggguuucucaaccuugacaccauugacauuuuggacuggguaauucuuuguucugcagagcuguccuuugcacuguaggagauuuacuaauaucccuggccucuacccaguaguaccacuagcaccuauuccccacccagcgugucuccagauauugucaaauaucccaucgggugcaaaaugaucccuggucaagaucuguugcccaagauguuacaggucacaaugaccacauuugaaauuguuuucccuuucauuuuacccugugaaagcaucucuccuagagccuugcaagaggcaggugacauuguguccauauuucuuccuguuucagaacuucuguuucacaacaauuucucucucgcuacaaguauucuuucacucagcacuggggaaguugggaacagcuggucaccaucaucccuuuaaucaacucacaccuguuuaaagaguguuucugauuugaccuucaucccuuaguuuacuggcguuaaaaaaagucucagcaauuuucauuauuucucgugggucucauuaucaaaccuuuacuuauuucggcauauuuccucugggcuucuucuaguuucugccuuacaagcaaugcuguucuguaaauuuauugaaaccucuggaacauuucaccuuuagagauggaggauggaaggauugguaccagaagagggcuaagauacguuuucugucuugagcugaaagcacagucuacucuccuucguuuugucgaugagaaaguugaggccagaggggaggugacauguuuagagucacccagcugguuagugacagaaaaagcgugagaguugucuaggauuccugccacuuuggucccuggccucuccugggggaggcugcuguucuuaggugcucuaagcuuaaucccucagaauguguggacaggucagcuuagaagagauggggagauucaggaucccccugugccagagcacagccucaccggaugcugcuucccacacugaaguguccuguccgaccauugcuaucugaggcauccacaagcagguaggaaagcuggcgagccauuuuacuuccugaggacaauuccccagccacaggcucugagucaaauuucuauuugguaagcauccuagcagcaaaguccugcacucagaccagccaaaaaacagcccccauuccaaguacuuggugucaaaaguccccgaacgacuuuuaaacccaagucuucuuaagguuucaguacugugguggcuuuagcaguuguuuuugugcaacuauaaauuauuuaaaucaucugagaugacagucaauuuuacaaaccagguacauauuaauuuguauaauuuuguauaugcucugguacacuaccugaacuaacgaaggguagaacuaauucuguuugucaguguucacaccuguaacauuaggaggauaugucugcauugcuuauuucuuuauguugguguuucuguggcaaagcccugcacauggcauuucugaaaagccuuaaaucuuuaagauguugcauguaggguaugcagugcaaaaggcugccucagaacugugagcccuuuuguaagcuggaagcauuucucuuacuacuguuacuuuuguaggaaguuuucaauucagagcugccaaaguguucccguaagcagugccuuaguaauaccuuagucaugccgccagccuuuucuuacaccaauuccuaauguucauuuacgaauuggcccaauauuggaaacaaaacaagcaaaaauugucuucauuuuuguuuuguaagcccauuuuuucuccaguucuauaggaaacugacugcuugguguaaaauccgaaacuggacacaagucaguucuuucaccacacucaaauguauauaccaaaacaaaagguugcaacuucauaguuuacuaugaaaagcaaauuguacuuuuuaauguugccuuuuaaauucaugaccaaauacuuagcuauuugugaaucuucugcacucuagcaugaaagugccuuugguuugagauuccagcuuagaaaagugcugccauaauaacgauaauuuguagagagaccaaaaauauuuugagaucaccguaaugccuuugguuuaccgggaugaguaaccaaccacaggccucuguucacaagagcacgacgugguccccgccugcugcuagucugucugccacugggggccucccaacauccauagcacacuucagcggaaggaccccagaaacuguuguguuugugugugcugaugaccuagugugucauuucaccucgucacccagcccugcguccggaugaggggacuucugcacaaaugacagaaucucggcugguggacagauacuacagcuuucuccuccuccuuguguucguguucagucucuguggagacuuucuuuuccauucaaaugacagugcgcacuuaucugguuuacacaaugauaccauuuugaaaguuggaagccucaaacugagacgacagugcagaacaaaacaaaagugaguuagggucguuaaaauugaaguguucuucuuagggcaaacauguugacuccgaguauuguguaugaaugugcuacgagaaacuuccaaagagcaccauucacaauuuggcauuuucaaagaauguuccagcccucaaaggggcaacucuuuaaaguccuuguuggcuuuuauccaaaccuuguagaaauugggaaagcugauagagguaaggaagacgagugaaaaggacaagaaggccaaacaccagccaaaaagaaacuaggaaaaaaagauuuucuuugcuaauauagauguaaaaauaacaucagacaucuuugaaaauuagccucuaaacucuuaauacauacguucugugugucucuaccuggcgucuuuaagaauauccucucugggcucugaaauuuuaggagugauucuuauccacuccaaguuguaaguauuuguagaaauuugugcaaacaaacaaaaacuaucaaaugaaaagaaaauguacucaaccuaacuuauaguuagcagcuggaauucucaacucuucccugccagcacuauaccacaguguggaagaaauuagucaaaugcuuguuuuccugcuucucuuuucaacuguuacugugcuuuguuugaaaguaguuuucucucucaaagccguugcuuauaucguuaagaaugaagguuuguguuuaaaauuuauugcauugcaaaggguaguuucacugaagucaugcaccauuaaauaagaugaaauauuuguauuuauuguccuacuuccuaagccguaacuucuuuuccucugugaauuugcauugagucacucaugcuacacuacaucgcuuuaguauuugagauggcauuuauguuuccucucguuuaucaugaaauggggucagauuccaucagauuccaccucugucagguggacucuugucugccuuccaugaugagauuuuuuuucuccuuccccuuucuuuaagagaggcugacagaucuaggugucaaucaauuggaaaccagucucugauuuuuuuucauuaguuauuuucuaucauuaguuucacuguguaaauuagauaucaacugcacuucuuuaaaaaaaaauacaucucccuauuaccuccuugaaagauuuacuucuguaggccuuuuucaauaggcucaugacugcagacaaggaaaaaaaaaguaaaaacaaaaacaguaugugccugaaaaugacaaaaaaaaaauuuguaacauuuaaaaaagaaaccugaauagccuuuaauucuuuaauaauacacuuaaauuuuauguaaaucgguuuucgccacguguguuuguucacauucuaaaugacuuaaugggauucucacggucugugucuuugugucacguguauaaaaugggcuugugauguaagcguuucaucuggucagugguuccuuugauauuguacugcugcugggagugggcuguggaaccugccuucggguaacuggguuccucuuggguagauuggagagaugggggugggcgugggcaaauucucacacauguuuucuuaaccuauuugcagaaacuuucaaaaggcauuugauuaaaccucuuggcaguacaguauucuuguauuuguuaacgucuguguuuagguacugguaccuuuuuguuuuaaaauguucuaaguguuggcuuuaaagugaauuuaucuuuaguaugauaguuauaugaaaauuauaggauuugugugcagagaauuuuuuuauaaagugcuuuguaaaaaaaaaaaaauguauucuagcuuuugcgguacauaugugugauaacuuuaauacccaugacaguuaagugcaauuauuucaucacucuaaaaaugcuauuuuugugucaguuccugcagguguuuucaugucuuugcaaagugacacauuuugaugccuucuugauaaagugguagacauuuuguagcuuucuagaaacuuuguauucauacgguaucaaugaaaaauaaagaaaaugaaaguguggguca

SEQ ID NO: 34831 - RNA, 19446 nt, Homo sapiens
cuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34832 - RNA, 19446 nt, Homo sapiens; identical to SEQ ID NO: 34831

SEQ ID NO: 34833 - RNA, 26351 nt, Homo sapiens
acacuugagccaucaccaaucagcauaggugugcuggcugcagccacuucccucacccacacucuuuaucucucacucuccagccgcugacagcccauuuuauugucaaucucugucuccuucccaggaaucugagaauugcucucacacaccaacccagcaacauccguggagaaaacucucaccagcaacuccuuuaaaacaccgucauuucaaaccauuguggucuucaagcaacaacagcagcacaaaaaaccccaaccaaacaaaacucuugacagaagcugugacaaccagaaaggaugccucauaaaggugaguccgcuucuuucuucucgcuuuauuuuuauugcaauauucagacaggucucccccuuccuccccccuuccuuccuccccucucgccgguccccucccccacugcuacgccgggagaguugggccggagaaguuuccacgcaggagcccaaacuuucuacuuccagcgaaagcccgcgucggagggcgacugccggcgagcgggagcggcgcagggcucggggcgggcggccagcucagccccagcgccagcgccagcgccagcgcgggcugagcucgcgggaagaagggagacuccaggcgcgacagcagccgcggcuccuagccccagcgucgcccaaugcucccgacccgcgggaaaagacgaagaggcucuguggugcccaaggcccuggaacggccgcagagagcaaccgcugccggcugcuuuguccagcccgaggcccagcgaacgcgcagagagcgggcgcuccgaggacucgccgagggagcgccgagggaaccugcucgccgcgucuccgcccgcccgccggcccucgggcuuugugccgcacugggcuccggcgcagaagagucagccggcacucgagcgccgaggggggcaccgcgcccgccaccagcccgaguggagucagucggcaaggcagccgcacgcuggagguagagggaagagcgagcuagcgcgagccgggaaggaagccaccaggccaaggcgguggaacgcgcgcuccgagggagcucagagccgagcgggaggacugucagcuuccacccagcccccgggcucuugcccccaacuccacuggagcgcugagcucggaacuugaaaacucucugcuccccaggcuucccccgacucucaucucccuugccuugcggaggcuggggcucuucccuguucuccggcccccugcgcuugguggguauuuuuccuuguuuuccucugauccagucucaccagguguugggauuucagcaaguuuugaggugcagaguugguuugcuuuuuuguuuguuuuacuccgaauccccuuauguuuuucuugguaaggccuugaaaauaaaucuguaugaaagcauuggccuucccccucgucugaucacuucuucucccggcuaauuagucggaguaauuugagagcuuucgauucuaagaucccaggaggaaaagugucuuuucaaaguucauaaaguuguugccucuuuccuugugcagauuuucucagucucccugcgccauaauagcccugaauuuuagcaaguguaauugggggaaauggaguugaauuucaaguggaaaugcuuucuuuuucgagugcuaaaaccuggcucuucauucaugagcgauuucuagaaaguuuaaaaacaaagugaacgugguuucuuucuuucuuccuuuuuauuuuucuuauacucucccaagcucccuaagccauucuggacguuuaacucgaacuugggaagguuuuagaaggggcugggagcagaaaaugaaaugaaaggcaaagagcuugagccuggcgaguuuacugaagagaaauaauaguuguugcgguugacauuacauuuuuuauagccagugaccuuugcaaaagcgugaaggcaguuugauuaguuguuaucuuauuuggcccuagagaguaaaacuuugucaucauaauugcuaauuacucuuuuggcugggggcgggaggaccgagagcucuccccuuuaccucaguuaaagaguuuggggauggaauuugagaauuaaguaauuaaaaaaagaacagcauuugaaaacugaggcuuguguuggggacagagaggugggggcagugaccacucucuugugguccaaggcuggggcgacuccaaaaugucuggagacuccuucguucaggaugugguucuauggccccagcgaggccguacagagccucgggcugagcuggggggcugaggcugcaguugggggucugaccucuccggugcacaggacugcuuccgggugucgaugugccccacuucccggguugcuucugcacuuaguguucacguuuacuuaaguaauuagauagcuucuuagcgagagggaagugggaauggagcagaacuggaauuugaaauacuaccaccuucccagcugcuucgaaaacuaaucaacgaggccucuuugugcucagcuacugaauuuaaaaaaaaaugguaucaagaaguuacaagccaggaugggagcauucuguugugauugugcacagcguggguuacaaaguggaguucuggaaguuuuaccccuccuaggggaauuccauuccccaucuccccaccuacuacuccuuugcagcuucaggguccugcauuuguuggggugggguauuuugcauuagaguuggagauuuugccuauccagggcauggcuaugggugccgggacugagagacaggaaggaagcauuggagagccaaccuagauaaggguaacuaguaacccucugcuguggccaguauuuacccaaugcugagaaaaaguccucauuuucgguuuauuuuuauggauuuaagcugucuaccaaguaguuaaaaaguagaccaggaauggccuuguagaguaaaaugugcuucuugaaauucuuugcuugcaggcaggcagaucaauaaucaccauagguaaaacagaaaaaauaaugcauuuaaaaaaaaacagagagaaaugaugcugugacuguuuuguuauuuuaccucuuuuuggggggcagaccucuugaaugggcucuuuauuguaacucucucuucccaauugagcuccccacggugccguuguaucuuuuuacagccccuaacaacucacaccaguaacacaauuaccuccagauauuuacaacaagaaauuacuuuucuauuuucuccacucacccaaaagacuuuuuuuuuuuuuccuuugggaaagguagggagguguucguacgggagcagccucggggaccccugcacugggucagggcuuaugaagcuagaagcgucccucuguucccuuugugaguugguggguuguugguacauuugguuggaagcuguguugcugguuagggagacucgguuuugcuccuuggguucgaggaaagcuggagaauagaagccauuguuugccgucugucggcuuugucgaccacgcucacccccuccuguucguacuuuuuaaagcagugaggcgagguagacagggugugucacaguacaguuaaaggggugaagaucuaaacgccaaaagagaaguuaaucacaauaagugagguuugggauaaaaaguugggcuugccccuuucaaagucccagaaagcugggagguagauggagagggggccauugggaaguuuuuuugguguagggagaggaguagaagauaaaggguaagcagaguguuggguucugggggucuugugaaguuccuuaaggaaggagggaguguggcccugcagcccucccaaacugcuccagccuaugcucuccggcaccaggaaguuccaagguucccuuccccuggucuccaaacuucagguauuccucuccccucacaccccuucaaccucagcucuuggccucuacuccuuacuccacuguuccuccuguuucccccuuccccuuuuccugguucuuuauauuuuugcaaagugggauccgaacuugcuagauuuuccaauucucccaagccagaccagagcagccucuuuuaaaggauggagacuucuguggcagaugccgcugaaaauguggguguaaugcugggacuuagaguuugaugacaguuugacugagcccuagaugcauguguuuuuccugagagugaggcucagagagcccauggacguaugcuguugaaccacagcuugauauaccuuuuucuccuucuguuuugucuuagggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34834 - RNA, 26562 nt, Homo sapiens
aauauuuugugugagagcgagcggugcauuugcauguugcggagugauuaguggguuugaaaagggaaccguggcucggccucauuucccgcucugguucaggcgcaggaggaaguguuuugcuggaggaugaugacagaggucaggcuucgcuaaugggccagugaggagcgguggaggcgaggccgggcgccggcacacacacauuaacacacuugagccaucaccaaucagcauaggugugcuggcugcagccacuucccucacccacacucuuuaucucucacucuccagccgcugacagcccauuuuauugucaaucucugucuccuucccaggaaucugagaauugcucucacacaccaacccagcaacauccguggagaaaacucucaccagcaacuccuuuaaaacaccgucauuucaaaccauuguggucuucaagcaacaacagcagcacaaaaaaccccaaccaaacaaaacucuugacagaagcugugacaaccagaaaggaugccucauaaaggugaguccgcuucuuucuucucgcuuuauuuuuauugcaauauucagacaggucucccccuuccuccccccuuccuuccuccccucucgccgguccccucccccacugcuacgccgggagaguugggccggagaaguuuccacgcaggagcccaaacuuucuacuuccagcgaaagcccgcgucggagggcgacugccggcgagcgggagcggcgcagggcucggggcgggcggccagcucagccccagcgccagcgccagcgccagcgcgggcugagcucgcgggaagaagggagacuccaggcgcgacagcagccgcggcuccuagccccagcgucgcccaaugcucccgacccgcgggaaaagacgaagaggcucuguggugcccaaggcccuggaacggccgcagagagcaaccgcugccggcugcuuuguccagcccgaggcccagcgaacgcgcagagagcgggcgcuccgaggacucgccgagggagcgccgagggaaccugcucgccgcgucuccgcccgcccgccggcccucgggcuuugugccgcacugggcuccggcgcagaagagucagccggcacucgagcgccgaggggggcaccgcgcccgccaccagcccgaguggagucagucggcaaggcagccgcacgcuggagguagagggaagagcgagcuagcgcgagccgggaaggaagccaccaggccaaggcgguggaacgcgcgcuccgagggagcucagagccgagcgggaggacugucagcuuccacccagcccccgggcucuugcccccaacuccacuggagcgcugagcucggaacuugaaaacucucugcuccccaggcuucccccgacucucaucucccuugccuugcggaggcuggggcucuucccuguucuccggcccccugcgcuugguggguauuuuuccuuguuuuccucugauccagucucaccagguguugggauuucagcaaguuuugaggugcagaguugguuugcuuuuuuguuuguuuuacuccgaauccccuuauguuuuucuugguaaggccuugaaaauaaaucuguaugaaagcauuggccuucccccucgucugaucacuucuucucccggcuaauuagucggaguaauuugagagcuuucgauucuaagaucccaggaggaaaagugucuuuucaaaguucauaaaguuguugccucuuuccuugugcagauuuucucagucucccugcgccauaauagcccugaauuuuagcaaguguaauugggggaaauggaguugaauuucaaguggaaaugcuuucuuuuucgagugcuaaaaccuggcucuucauucaugagcgauuucuagaaaguuuaaaaacaaagugaacgugguuucuuucuuucuuccuuuuuauuuuucuuauacucucccaagcucccuaagccauucuggacguuuaacucgaacuugggaagguuuuagaaggggcugggagcagaaaaugaaaugaaaggcaaagagcuugagccuggcgaguuuacugaagagaaauaauaguuguugcgguugacauuacauuuuuuauagccagugaccuuugcaaaagcgugaaggcaguuugauuaguuguuaucuuauuuggcccuagagaguaaaacuuugucaucauaauugcuaauuacucuuuuggcugggggcgggaggaccgagagcucuccccuuuaccucaguuaaagaguuuggggauggaauuugagaauuaaguaauuaaaaaaagaacagcauuugaaaacugaggcuuguguuggggacagagaggugggggcagugaccacucucuugugguccaaggcuggggcgacuccaaaaugucuggagacuccuucguucaggaugugguucuauggccccagcgaggccguacagagccucgggcugagcuggggggcugaggcugcaguugggggucugaccucuccggugcacaggacugcuuccgggugucgaugugccccacuucccggguugcuucugcacuuaguguucacguuuacuuaaguaauuagauagcuucuuagcgagagggaagugggaauggagcagaacuggaauuugaaauacuaccaccuucccagcugcuucgaaaacuaaucaacgaggccucuuugugcucagcuacugaauuuaaaaaaaaaugguaucaagaaguuacaagccaggaugggagcauucuguugugauugugcacagcguggguuacaaaguggaguucuggaaguuuuaccccuccuaggggaauuccauuccccaucuccccaccuacuacuccuuugcagcuucaggguccugcauuuguuggggugggguauuuugcauuagaguuggagauuuugccuauccagggcauggcuaugggugccgggacugagagacaggaaggaagcauuggagagccaaccuagauaaggguaacuaguaacccucugcuguggccaguauuuacccaaugcugagaaaaaguccucauuuucgguuuauuuuuauggauuuaagcugucuaccaaguaguuaaaaaguagaccaggaauggccuuguagaguaaaaugugcuucuugaaauucuuugcuugcaggcaggcagaucaauaaucaccauagguaaaacagaaaaaauaaugcauuuaaaaaaaaacagagagaaaugaugcugugacuguuuuguuauuuuaccucuuuuuggggggcagaccucuugaaugggcucuuuauuguaacucucucuucccaauugagcuccccacggugccguuguaucuuuuuacagccccuaacaacucacaccaguaacacaauuaccuccagauauuuacaacaagaaauuacuuuucuauuuucuccacucacccaaaagacuuuuuuuuuuuuuccuuugggaaagguagggagguguucguacgggagcagccucggggaccccugcacugggucagggcuuaugaagcuagaagcgucccucuguucccuuugugaguugguggguuguugguacauuugguuggaagcuguguugcugguuagggagacucgguuuugcuccuuggguucgaggaaagcuggagaauagaagccauuguuugccgucugucggcuuugucgaccacgcucacccccuccuguucguacuuuuuaaagcagugaggcgagguagacagggugugucacaguacaguuaaaggggugaagaucuaaacgccaaaagagaaguuaaucacaauaagugagguuugggauaaaaaguugggcuugccccuuucaaagucccagaaagcugggagguagauggagagggggccauugggaaguuuuuuugguguagggagaggaguagaagauaaaggguaagcagaguguuggguucugggggucuugugaaguuccuuaaggaaggagggaguguggcccugcagcccucccaaacugcuccagccuaugcucuccggcaccaggaaguuccaagguucccuuccccuggucuccaaacuucagguauuccucuccccucacaccccuucaaccucagcucuuggccucuacuccuuacuccacuguuccuccuguuucccccuuccccuuuuccugguucuuuauauuuuugcaaagugggauccgaacuugcuagauuuuccaauucucccaagccagaccagagcagccucuuuuaaaggauggagacuucuguggcagaugccgcugaaaauguggguguaaugcugggacuuagaguuugaugacaguuugacugagcccuagaugcauguguuuuuccugagagugaggcucagagagcccauggacguaugcuguugaaccacagcuugauauaccuuuuucuccuucuguuuugucuuagggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34835 - RNA, 26562 nt, Homo sapiens; identical to SEQ ID NO: 34834

SEQ ID NO: 34836 - RNA, 26562 nt, Homo sapiens; identical to SEQ ID NO: 34834

SEQ ID NO: 34837 - RNA, 33170 nt, Homo sapiens
acccucuuuucuuaucauugacauuuaaacucuggggcagguccucgcguagaacgcggcugucagaucugccacuuccccugccgagcggcggugagaagugugggaaccggcgcugccaggcucaccugccuccccgcccuccgcucccagguaaccgcccgggcuccggccccggcccggcucggggcccgcggggccucuccgcugccagcgacugcuguccccaaaucaaagcccgccccaaguggccccggggcuugauuuuugcuuuuaaaaggaggcauacaaagauggaagcgaguuacugagggagggauaggaagggggguggaggagggacuugucuuugccgagugugcucuucugcaaaaguagcaaaauguuccacuccuaagaguggacuuccaguccggcccugagcugggaguagggggcgggagucugcugcugcugucugcuaaagccacucgcgaccgcgaaaaaugcaggagguggggacgcacuuugcauccagaccuccucugcaucgcaguucacgacauccacgcuugggaaaguccguacccgcgccuggagcgcuuaaagacacccugccgcgggucgggcgaggugcagcagaaguuucccgcgguugcaaagugcagauggcuggaccgcaacaaagucuagagaugggguucguuucucagaaagacgcggaguacgaaagaaugcggccgacagagcugggcagcgcguaaagcucccagcgugugauuugagcuucacuucggaagaccuaauaauuagcgauucucacugagcuagaacgcgggcuccgguuacugcgggcgcugcgcuggcugccucggcgggaagcgcgcgggcgccaugggagccgggccgccaagcccgggaaagagaagcgcccaccacccugcggcccuuggagggccagagccggggcccggaaguguccccuuagugagucagggaagggacgacccaaacuuagacuaacuugugguucagccgggcgaaaguccugggagcccggcccuaaaagcagcuggagacgcccaggccggcuuaggcggggcacccaagaaccccgcccgggaguuuggggcggccucugggccaggccccggcuagcccccaacccccacucccacucgcgcuccugcgcccccuuucuaggucuucugggagcaccuucggagcucagucaccugugacagguguugggaccuccgcccgacuccgagcgguggcgcccccugcucaccucaccuggaaacgggggacgagcgcaguggcaguccggccgcacgccuuaccugggccgggauccucuccuccgcggguuccucucccuggagcugggcggcgagcaggucgccugcuucgcagugggaaguggaccuucuccuccagucauaaaucaaacccagccauccucgggccuccucccucauuagagauguuuauuggagaucguguuuauucggcugucacggcgagaaaacgcggugacauaauuaccucugaccagaguccucgcuccgcgcccagggcgagccgaggaccuccucugucgccuucucaugcccgugcccuucgugaucggagggcgcccgugauaggcuugucuuuuuuuccucagacccucucauagaauuuggaugacuggaauuacuauucagauuuccccagggcccggaguuuauuuauuuauuuuagaauuggaaaggaaaaccgaagggaacccaacgccccuccggggcagaagggggcagcgcgcgcgaggcggaaggacagucacucucgcugcacaaacuuucccgcgggccgcgccgcgcgugcaggggcuggacgccacccggcgccagagccgggccugaggagcggggucuggccgggaacgagggcugccagccuggguggugucauuuguugcuucauuuuucauucccuuuccucucgugaggaaucagaggcaucgggccgcgcgggcugagaauucuuaaauucuccccggccgcauucggcugagccaacccgcaguuccugucagccccucugucccccgggcagcgguuuuccccgcuagccagguuuggaagucacccucugugagacuggguuaggaagugacgaaaagcgccgaauuguuuucaaauugaaaauacuuuuuuuuuuuuuuuuggagauagcgcugacaaauauaugggaucccggcuuuugaucccuggcugccgccucuguucuccugucgcuaauaaaacucgcauugagccccuuagugccuugauuaacaggcagauuaacucuuacugggguugggaacagcuuguccuaaucaaugucauuuuaaaagcccgucaggaugcgcuuagcuucgguucccuggaugcuugagcgagccagccaugacauuugcucccucccccuccccagccucaaaucccccaguaaagcccccaguucccgccugccuguucccaggucuacaacgggacaaaucgcaggaccgggucguuggccuuuagaauaggcagcgguuuagagaggggauauccagggagaagggacugagguggccuugacuugcuugcuuuuccuuugaagcugaacucuugccucuugggggcagagguuacagggaaaagagagauggggggaucgucacagggugaugaaauggaaagcaaacuuuucuaggaacccuauuugcaaaaaucggagagugccgcugauuucaguuguccuacaugucaggaguuuuaaaccuaacuccuaucuggacaacagcauggagggacugggaggcaaagccuugggagucugacccgcugggcugcuaggaaucccuuugcugggagacuccacuggacaauguuauuuuaaagguauuuugggggugggcagggagaagacagagagagaaagagagagagagagagagagagagagagagagagagagacaggcuggccucccagagcgaacggaagaggacugaggacugaacccagggagccccuagcacuggccauuuggcaggaggcgaggaagggcgagggcaccgcggcuuccccccaagccgagcaguggccacagccugaaggugccacggggcggcucugggaucuucuuggcuuuucuaggcucugggcucggcgaggcugccggguuagcgggaaccggcagguugcuggagaaaggagagggacaaaggccuggaagugggggaggcaccagggacugggcggccgggaugggagccuuugccuuuagggcucacuggacccguuugccagcuccgcggacaagggaucccaccuucccagggucugcaaaaagagagacguuuggggcacuacaaagugacgcaggugucugccaagacuuuccuucuccaaaaaaugccagucuucacccuuuccagcgcgccggcgcugcgccucugcuugaccggggaaagagagaguuuggaggugucagaacugucagaacuccggaugggaggcucuugguucugaagcugggagcuggaggcacuuccccccagaagugggcacuucuuugccuccccgaaggccugauggggugggcacaggggaaugccagggaucggugcgggugagaugcuugccucaccucauguugacgcaucaauacuggcuagaagcucugggcaggcucuggcgagccacggucccccagcgggacucccuccacgcagacagccccgcuaccgggugggacgaccccggcggcccccgcgggaacgcacccgccggccugagagguccucccucuggccacagggggcggaggguaggggggaacaggggccuguggggaggcggggaaaggagacagaaccuaaagcgcaauccccgccgcccccccgcgucuuggagggcagcaagugggccucgggcguguugguagccgcaauuaaaauggcgaccugcgaguugucucgguuuuguacacaccucuggcaaccgcgcccgcaccucagucucggcccccacaccccuaggccgcuucgcccccagagccgguacuuggcagagggagugaggcuccccacgagguagaacagcacccccaccuuccuugagaccaguccagagagaacgaggaaaucucacucucaccccucucuccuuaaacuuugaaaacucggccucauucugggguugaacuccccuccccaaauauugacacaugggaagcagccaaguccuuuuuguuuuuuguuugugcggaggaguuuccaggagucuuucccggagcccccuuccccacccaaugacgucaguggcauucacuccucgcuccuugccuuuucugauuuuuuguuaaaacuuuucuccgcagcgagauggggguuggaggggugggagaaggagcugauucaaagagccagugcccuggggggaaauagcaacaagauuacggcugcuucuuuccgaggcaaagcuuaagaaggugcuaauccacucggucgcuaauugagagguuguaaaaaugauacucgccuccaguucggacagaaucacuucccccccccccgcccccccgcaagucccucgcucaugcacagcggacuugagucuugaguccaagcuucuuuaaugcucgcuuggaaaguaaaaggagagagaaagagaaagccgacuuucgcuggucugggacucagggccgcggccccacuugccggcauccuccgaaagucgcgcuccugcgaaaugaaaccucgcccaggaggccgcggaccuggacacccggcgccaccuccuucaccucugacccagguuuccucccggcgcugcgagcucccggggaaggguuagagccggcagcccuccccagcccggggaggggagaggguuaugcgaccccaccucuggcuagggccggggaggccuuugcuucccgggagcccugcccgggcuccuuggucgcagggcugcugggucccaggcaggaacgagagggugaggcccacauguggcccggcggcccagggcggcuugcagcguccucacugucccggcugccaggggcugcggcgacgcggccagucagcagcgaguucaggucgcgcagauuuuauugaugagcucugacuuucagcacuuucccuaagucaagaagagucuagcguacccuucggcugcuucauuucagccucccugccucagcucuucagcccuauucccccucgcccuguccugggguguguacagcagcccaggccuuccuucuccuucccggcuccguggcccgaagccgccgagagagcucgggacagcgcaggaccaggcagccgcucgcucuccugucaccuuaacugcaggcuccgaggggcgccuuuggaguguacugagguguguccuaaucgugcggcauucaacaaauggacuucugguguguggucagaagagaaaagccauuuacuuacuuuccuccccgguuuucuggcaacagcugaaggggagcugccuccguggacugagcagacccaggagagggagucguggugcggagacacacgcaccacacacagaugaccgguggcacacacgacacacgcugacauaccgacaucgccagugggacacacacacacacacacacacacacacacacacacacagagagagagagagaaucccucccagcauuggucauccgcccccccacccaggcuuccacucccccuccccucuuaucuccccuggcuuccccuccucucgggcgcugcgaaaagcagccgcacuuagucaacaaauggcacgugggagaaguuggugaguguuuggugaggacucuucagggcuuuucacaagaacccucuguacacaaaguaaguggcguguuuacucgggccucuccagccagagcugugccucugcuccgcugcgcaccgcggcuuccgaaaggagaaaggagagaagaaagggcggggagagcgggguggaggauuuggacaggcccuggaggcuugggcuggggaggccucuggccucguuuaguucucggcccggcaaccuccucucggccuaggcuucgccgcggccuccgcagcuggaauggagcugccaggacccagugacgcucccgccccuuuccucuucuuccaaggggccaggugggcuggggugcggccgccgcugugcucugugucuuggggccccggcugggauggggugggggcgggcgggggcggggcggcaggccacgcuguccuggaguuggcaagaaaggacagcacagaaacuugcacccuccgaggacugggagucccgaguccagcuuagggggagugggggcgcgacccccaacccagaaaccuucacuugaccgcucaaguucgcggcagcagggcgggccgcgccgaaucucggcgugcgcggagcggggagaugcaggcgagcgccagagcccgggcucgggggcccugcgccggggagaggagccgggacccaccggcggagccgaaaacaaguguauucauauucaaacaaacggaccaauugcaccaggcggggagagggagcauccaaucggcuggcgcgaggccccggcgcugcuuugcauaaagcaauauuuugugugagagcgagcggugcauuugcauguugcggagugauuaguggguuugaaaagggaaccguggcucggccucauuucccgcucugguucaggcgcaggaggaaguguuuugcuggaggaugaugacagaggucaggcuucgcuaaugggccagugaggagcgguggaggcgaggccgggcgccggcacacacacauuaacacacuugagccaucaccaaucagcauaggugugcuggcugcagccacuucccucacccacacucuuuaucucucacucuccagccgcugacagcccauuuuauugucaaucucugucuccuucccaggaaucugagaauugcucucacacaccaacccagcaacauccguggagaaaacucucaccagcaacuccuuuaaaacaccgucauuucaaaccauuguggucuucaagcaacaacagcagcacaaaaaaccccaaccaaacaaaacucuugacagaagcugugacaaccagaaaggaugccucauaaaggugaguccgcuucuuucuucucgcuuuauuuuuauugcaauauucagacaggucucccccuuccuccccccuuccuuccuccccucucgccgguccccucccccacugcuacgccgggagaguugggccggagaaguuuccacgcaggagcccaaacuuucuacuuccagcgaaagcccgcgucggagggcgacugccggcgagcgggagcggcgcagggcucggggcgggcggccagcucagccccagcgccagcgccagcgccagcgcgggcugagcucgcgggaagaagggagacuccaggcgcgacagcagccgcggcuccuagccccagcgucgcccaaugcucccgacccgcgggaaaagacgaagaggcucuguggugcccaaggcccuggaacggccgcagagagcaaccgcugccggcugcuuuguccagcccgaggcccagcgaacgcgcagagagcgggcgcuccgaggacucgccgagggagcgccgagggaaccugcucgccgcgucuccgcccgcccgccggcccucgggcuuugugccgcacugggcuccggcgcagaagagucagccggcacucgagcgccgaggggggcaccgcgcccgccaccagcccgaguggagucagucggcaaggcagccgcacgcuggagguagagggaagagcgagcuagcgcgagccgggaaggaagccaccaggccaaggcgguggaacgcgcgcuccgagggagcucagagccgagcgggaggacugucagcuuccacccagcccccgggcucuugcccccaacuccacuggagcgcugagcucggaacuugaaaacucucugcuccccaggcuucccccgacucucaucucccuugccuugcggaggcuggggcucuucccuguucuccggcccccugcgcuugguggguauuuuuccuuguuuuccucugauccagucucaccagguguugggauuucagcaaguuuugaggugcagaguugguuugcuuuuuuguuuguuuuacuccgaauccccuuauguuuuucuugguaaggccuugaaaauaaaucuguaugaaagcauuggccuucccccucgucugaucacuucuucucccggcuaauuagucggaguaauuugagagcuuucgauucuaagaucccaggaggaaaagugucuuuucaaaguucauaaaguuguugccucuuuccuugugcagauuuucucagucucccugcgccauaauagcccugaauuuuagcaaguguaauugggggaaauggaguugaauuucaaguggaaaugcuuucuuuuucgagugcuaaaaccuggcucuucauucaugagcgauuucuagaaaguuuaaaaacaaagugaacgugguuucuuucuuucuuccuuuuuauuuuucuuauacucucccaagcucccuaagccauucuggacguuuaacucgaacuugggaagguuuuagaaggggcugggagcagaaaaugaaaugaaaggcaaagagcuugagccuggcgaguuuacugaagagaaauaauaguuguugcgguugacauuacauuuuuuauagccagugaccuuugcaaaagcgugaaggcaguuugauuaguuguuaucuuauuuggcccuagagaguaaaacuuugucaucauaauugcuaauuacucuuuuggcugggggcgggaggaccgagagcucuccccuuuaccucaguuaaagaguuuggggauggaauuugagaauuaaguaauuaaaaaaagaacagcauuugaaaacugaggcuuguguuggggacagagaggugggggcagugaccacucucuugugguccaaggcuggggcgacuccaaaaugucuggagacuccuucguucaggaugugguucuauggccccagcgaggccguacagagccucgggcugagcuggggggcugaggcugcaguugggggucugaccucuccggugcacaggacugcuuccgggugucgaugugccccacuucccggguugcuucugcacuuaguguucacguuuacuuaaguaauuagauagcuucuuagcgagagggaagugggaauggagcagaacuggaauuugaaauacuaccaccuucccagcugcuucgaaaacuaaucaacgaggccucuuugugcucagcuacugaauuuaaaaaaaaaugguaucaagaaguuacaagccaggaugggagcauucuguugugauugugcacagcguggguuacaaaguggaguucuggaaguuuuaccccuccuaggggaauuccauuccccaucuccccaccuacuacuccuuugcagcuucaggguccugcauuuguuggggugggguauuuugcauuagaguuggagauuuugccuauccagggcauggcuaugggugccgggacugagagacaggaaggaagcauuggagagccaaccuagauaaggguaacuaguaacccucugcuguggccaguauuuacccaaugcugagaaaaaguccucauuuucgguuuauuuuuauggauuuaagcugucuaccaaguaguuaaaaaguagaccaggaauggccuuguagaguaaaaugugcuucuugaaauucuuugcuugcaggcaggcagaucaauaaucaccauagguaaaacagaaaaaauaaugcauuuaaaaaaaaacagagagaaaugaugcugugacuguuuuguuauuuuaccucuuuuuggggggcagaccucuugaaugggcucuuuauuguaacucucucuucccaauugagcuccccacggugccguuguaucuuuuuacagccccuaacaacucacaccaguaacacaauuaccuccagauauuuacaacaagaaauuacuuuucuauuuucuccacucacccaaaagacuuuuuuuuuuuuuccuuugggaaagguagggagguguucguacgggagcagccucggggaccccugcacugggucagggcuuaugaagcuagaagcgucccucuguucccuuugugaguugguggguuguugguacauuugguuggaagcuguguugcugguuagggagacucgguuuugcuccuuggguucgaggaaagcuggagaauagaagccauuguuugccgucugucggcuuugucgaccacgcucacccccuccuguucguacuuuuuaaagcagugaggcgagguagacagggugugucacaguacaguuaaaggggugaagaucuaaacgccaaaagagaaguuaaucacaauaagugagguuugggauaaaaaguugggcuugccccuuucaaagucccagaaagcugggagguagauggagagggggccauugggaaguuuuuuugguguagggagaggaguagaagauaaaggguaagcagaguguuggguucugggggucuugugaaguuccuuaaggaaggagggaguguggcccugcagcccucccaaacugcuccagccuaugcucuccggcaccaggaaguuccaagguucccuuccccuggucuccaaacuucagguauuccucuccccucacaccccuucaaccucagcucuuggccucuacuccuuacuccacuguuccuccuguuucccccuuccccuuuuccugguucuuuauauuuuugcaaagugggauccgaacuugcuagauuuuccaauucucccaagccagaccagagcagccucuuuuaaaggauggagacuucuguggcagaugccgcugaaaauguggguguaaugcugggacuuagaguuugaugacaguuugacugagcccuagaugcauguguuuuuccugagagugaggcucagagagcccauggacguaugcuguugaaccacagcuugauauaccuuuuucuccuucuguuuugucuuagggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34838 - RNA, 33170 nt, Homo sapiens; identical to SEQ ID NO: 34837

SEQ ID NO: 34839 - RNA, 13721 nt, Homo sapiens
ggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguu

SEQ ID NO: 34840 - RNA, 27551 nt, Homo sapiens
gacacacacacacacacacacacacacacacacacacacagagagagagagagaaucccucccagcauuggucauccgcccccccacccaggcuuccacucccccuccccucuuaucuccccuggcuuccccuccucucgggcgcugcgaaaagcagccgcacuuagucaacaaauggcacgugggagaaguuggugaguguuuggugaggacucuucagggcuuuucacaagaacccucuguacacaaaguaaguggcguguuuacucgggccucuccagccagagcugugccucugcuccgcugcgcaccgcggcuuccgaaaggagaaaggagagaagaaagggcggggagagcgggguggaggauuuggacaggcccuggaggcuugggcuggggaggccucuggccucguuuaguucucggcccggcaaccuccucucggccuaggcuucgccgcggccuccgcagcuggaauggagcugccaggacccagugacgcucccgccccuuuccucuucuuccaaggggccaggugggcuggggugcggccgccgcugugcucugugucuuggggccccggcugggauggggugggggcgggcgggggcggggcggcaggccacgcuguccuggaguuggcaagaaaggacagcacagaaacuugcacccuccgaggacugggagucccgaguccagcuuagggggagugggggcgcgacccccaacccagaaaccuucacuugaccgcucaaguucgcggcagcagggcgggccgcgccgaaucucggcgugcgcggagcggggagaugcaggcgagcgccagagcccgggcucgggggcccugcgccggggagaggagccgggacccaccggcggagccgaaaacaaguguauucauauucaaacaaacggaccaauugcaccaggcggggagagggagcauccaaucggcuggcgcgaggccccggcgcugcuuugcauaaagcaauauuuugugugagagcgagcggugcauuugcauguugcggagugauuaguggguuugaaaagggaaccguggcucggccucauuucccgcucugguucaggcgcaggaggaaguguuuugcuggaggaugaugacagaggucaggcuucgcuaaugggccagugaggagcgguggaggcgaggccgggcgccggcacacacacauuaacacacuugagccaucaccaaucagcauaggugugcuggcugcagccacuucccucacccacacucuuuaucucucacucuccagccgcugacagcccauuuuauugucaaucucugucuccuucccaggaaucugagaauugcucucacacaccaacccagcaacauccguggagaaaacucucaccagcaacuccuuuaaaacaccgucauuucaaaccauuguggucuucaagcaacaacagcagcacaaaaaaccccaaccaaacaaaacucuugacagaagcugugacaaccagaaaggaugccucauaaaggugaguccgcuucuuucuucucgcuuuauuuuuauugcaauauucagacaggucucccccuuccuccccccuuccuuccuccccucucgccgguccccucccccacugcuacgccgggagaguugggccggagaaguuuccacgcaggagcccaaacuuucuacuuccagcgaaagcccgcgucggagggcgacugccggcgagcgggagcggcgcagggcucggggcgggcggccagcucagccccagcgccagcgccagcgccagcgcgggcugagcucgcgggaagaagggagacuccaggcgcgacagcagccgcggcuccuagccccagcgucgcccaaugcucccgacccgcgggaaaagacgaagaggcucuguggugcccaaggcccuggaacggccgcagagagcaaccgcugccggcugcuuuguccagcccgaggcccagcgaacgcgcagagagcgggcgcuccgaggacucgccgagggagcgccgagggaaccugcucgccgcgucuccgcccgcccgccggcccucgggcuuugugccgcacugggcuccggcgcagaagagucagccggcacucgagcgccgaggggggcaccgcgcccgccaccagcccgaguggagucagucggcaaggcagccgcacgcuggagguagagggaagagcgagcuagcgcgagccgggaaggaagccaccaggccaaggcgguggaacgcgcgcuccgagggagcucagagccgagcgggaggacugucagcuuccacccagcccccgggcucuugcccccaacuccacuggagcgcugagcucggaacuugaaaacucucugcuccccaggcuucccccgacucucaucucccuugccuugcggaggcuggggcucuucccuguucuccggcccccugcgcuugguggguauuuuuccuuguuuuccucugauccagucucaccagguguugggauuucagcaaguuuugaggugcagaguugguuugcuuuuuuguuuguuuuacuccgaauccccuuauguuuuucuugguaaggccuugaaaauaaaucuguaugaaagcauuggccuucccccucgucugaucacuucuucucccggcuaauuagucggaguaauuugagagcuuucgauucuaagaucccaggaggaaaagugucuuuucaaaguucauaaaguuguugccucuuuccuugugcagauuuucucagucucccugcgccauaauagcccugaauuuuagcaaguguaauugggggaaauggaguugaauuucaaguggaaaugcuuucuuuuucgagugcuaaaaccuggcucuucauucaugagcgauuucuagaaaguuuaaaaacaaagugaacgugguuucuuucuuucuuccuuuuuauuuuucuuauacucucccaagcucccuaagccauucuggacguuuaacucgaacuugggaagguuuuagaaggggcugggagcagaaaaugaaaugaaaggcaaagagcuugagccuggcgaguuuacugaagagaaauaauaguuguugcgguugacauuacauuuuuuauagccagugaccuuugcaaaagcgugaaggcaguuugauuaguuguuaucuuauuuggcccuagagaguaaaacuuugucaucauaauugcuaauuacucuuuuggcugggggcgggaggaccgagagcucuccccuuuaccucaguuaaagaguuuggggauggaauuugagaauuaaguaauuaaaaaaagaacagcauuugaaaacugaggcuuguguuggggacagagaggugggggcagugaccacucucuugugguccaaggcuggggcgacuccaaaaugucuggagacuccuucguucaggaugugguucuauggccccagcgaggccguacagagccucgggcugagcuggggggcugaggcugcaguugggggucugaccucuccggugcacaggacugcuuccgggugucgaugugccccacuucccggguugcuucugcacuuaguguucacguuuacuuaaguaauuagauagcuucuuagcgagagggaagugggaauggagcagaacuggaauuugaaauacuaccaccuucccagcugcuucgaaaacuaaucaacgaggccucuuugugcucagcuacugaauuuaaaaaaaaaugguaucaagaaguuacaagccaggaugggagcauucuguugugauugugcacagcguggguuacaaaguggaguucuggaaguuuuaccccuccuaggggaauuccauuccccaucuccccaccuacuacuccuuugcagcuucaggguccugcauuuguuggggugggguauuuugcauuagaguuggagauuuugccuauccagggcauggcuaugggugccgggacugagagacaggaaggaagcauuggagagccaaccuagauaaggguaacuaguaacccucugcuguggccaguauuuacccaaugcugagaaaaaguccucauuuucgguuuauuuuuauggauuuaagcugucuaccaaguaguuaaaaaguagaccaggaauggccuuguagaguaaaaugugcuucuugaaauucuuugcuugcaggcaggcagaucaauaaucaccauagguaaaacagaaaaaauaaugcauuuaaaaaaaaacagagagaaaugaugcugugacuguuuuguuauuuuaccucuuuuuggggggcagaccucuugaaugggcucuuuauuguaacucucucuucccaauugagcuccccacggugccguuguaucuuuuuacagccccuaacaacucacaccaguaacacaauuaccuccagauauuuacaacaagaaauuacuuuucuauuuucuccacucacccaaaagacuuuuuuuuuuuuuccuuugggaaagguagggagguguucguacgggagcagccucggggaccccugcacugggucagggcuuaugaagcuagaagcgucccucuguucccuuugugaguugguggguuguugguacauuugguuggaagcuguguugcugguuagggagacucgguuuugcuccuuggguucgaggaaagcuggagaauagaagccauuguuugccgucugucggcuuugucgaccacgcucacccccuccuguucguacuuuuuaaagcagugaggcgagguagacagggugugucacaguacaguuaaaggggugaagaucuaaacgccaaaagagaaguuaaucacaauaagugagguuugggauaaaaaguugggcuugccccuuucaaagucccagaaagcugggagguagauggagagggggccauugggaaguuuuuuugguguagggagaggaguagaagauaaaggguaagcagaguguuggguucugggggucuugugaaguuccuuaaggaaggagggaguguggcccugcagcccucccaaacugcuccagccuaugcucuccggcaccaggaaguuccaagguucccuuccccuggucuccaaacuucagguauuccucuccccucacaccccuucaaccucagcucuuggccucuacuccuuacuccacuguuccuccuguuucccccuuccccuuuuccugguucuuuauauuuuugcaaagugggauccgaacuugcuagauuuuccaauucucccaagccagaccagagcagccucuuuuaaaggauggagacuucuguggcagaugccgcugaaaauguggguguaaugcugggacuuagaguuugaugacaguuugacugagcccuagaugcauguguuuuuccugagagugaggcucagagagcccauggacguaugcuguugaaccacagcuugauauaccuuuuucuccuucuguuuugucuuagggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34841 - RNA, 27392 nt, Homo sapiens
gcacuuagucaacaaauggcacgugggagaaguuggugaguguuuggugaggacucuucagggcuuuucacaagaacccucuguacacaaaguaaguggcguguuuacucgggccucuccagccagagcugugccucugcuccgcugcgcaccgcggcuuccgaaaggagaaaggagagaagaaagggcggggagagcgggguggaggauuuggacaggcccuggaggcuugggcuggggaggccucuggccucguuuaguucucggcccggcaaccuccucucggccuaggcuucgccgcggccuccgcagcuggaauggagcugccaggacccagugacgcucccgccccuuuccucuucuuccaaggggccaggugggcuggggugcggccgccgcugugcucugugucuuggggccccggcugggauggggugggggcgggcgggggcggggcggcaggccacgcuguccuggaguuggcaagaaaggacagcacagaaacuugcacccuccgaggacugggagucccgaguccagcuuagggggagugggggcgcgacccccaacccagaaaccuucacuugaccgcucaaguucgcggcagcagggcgggccgcgccgaaucucggcgugcgcggagcggggagaugcaggcgagcgccagagcccgggcucgggggcccugcgccggggagaggagccgggacccaccggcggagccgaaaacaaguguauucauauucaaacaaacggaccaauugcaccaggcggggagagggagcauccaaucggcuggcgcgaggccccggcgcugcuuugcauaaagcaauauuuugugugagagcgagcggugcauuugcauguugcggagugauuaguggguuugaaaagggaaccguggcucggccucauuucccgcucugguucaggcgcaggaggaaguguuuugcuggaggaugaugacagaggucaggcuucgcuaaugggccagugaggagcgguggaggcgaggccgggcgccggcacacacacauuaacacacuugagccaucaccaaucagcauaggugugcuggcugcagccacuucccucacccacacucuuuaucucucacucuccagccgcugacagcccauuuuauugucaaucucugucuccuucccaggaaucugagaauugcucucacacaccaacccagcaacauccguggagaaaacucucaccagcaacuccuuuaaaacaccgucauuucaaaccauuguggucuucaagcaacaacagcagcacaaaaaaccccaaccaaacaaaacucuugacagaagcugugacaaccagaaaggaugccucauaaaggugaguccgcuucuuucuucucgcuuuauuuuuauugcaauauucagacaggucucccccuuccuccccccuuccuuccuccccucucgccgguccccucccccacugcuacgccgggagaguugggccggagaaguuuccacgcaggagcccaaacuuucuacuuccagcgaaagcccgcgucggagggcgacugccggcgagcgggagcggcgcagggcucggggcgggcggccagcucagccccagcgccagcgccagcgccagcgcgggcugagcucgcgggaagaagggagacuccaggcgcgacagcagccgcggcuccuagccccagcgucgcccaaugcucccgacccgcgggaaaagacgaagaggcucuguggugcccaaggcccuggaacggccgcagagagcaaccgcugccggcugcuuuguccagcccgaggcccagcgaacgcgcagagagcgggcgcuccgaggacucgccgagggagcgccgagggaaccugcucgccgcgucuccgcccgcccgccggcccucgggcuuugugccgcacugggcuccggcgcagaagagucagccggcacucgagcgccgaggggggcaccgcgcccgccaccagcccgaguggagucagucggcaaggcagccgcacgcuggagguagagggaagagcgagcuagcgcgagccgggaaggaagccaccaggccaaggcgguggaacgcgcgcuccgagggagcucagagccgagcgggaggacugucagcuuccacccagcccccgggcucuugcccccaacuccacuggagcgcugagcucggaacuugaaaacucucugcuccccaggcuucccccgacucucaucucccuugccuugcggaggcuggggcucuucccuguucuccggcccccugcgcuugguggguauuuuuccuuguuuuccucugauccagucucaccagguguugggauuucagcaaguuuugaggugcagaguugguuugcuuuuuuguuuguuuuacuccgaauccccuuauguuuuucuugguaaggccuugaaaauaaaucuguaugaaagcauuggccuucccccucgucugaucacuucuucucccggcuaauuagucggaguaauuugagagcuuucgauucuaagaucccaggaggaaaagugucuuuucaaaguucauaaaguuguugccucuuuccuugugcagauuuucucagucucccugcgccauaauagcccugaauuuuagcaaguguaauugggggaaauggaguugaauuucaaguggaaaugcuuucuuuuucgagugcuaaaaccuggcucuucauucaugagcgauuucuagaaaguuuaaaaacaaagugaacgugguuucuuucuuucuuccuuuuuauuuuucuuauacucucccaagcucccuaagccauucuggacguuuaacucgaacuugggaagguuuuagaaggggcugggagcagaaaaugaaaugaaaggcaaagagcuugagccuggcgaguuuacugaagagaaauaauaguuguugcgguugacauuacauuuuuuauagccagugaccuuugcaaaagcgugaaggcaguuugauuaguuguuaucuuauuuggcccuagagaguaaaacuuugucaucauaauugcuaauuacucuuuuggcugggggcgggaggaccgagagcucuccccuuuaccucaguuaaagaguuuggggauggaauuugagaauuaaguaauuaaaaaaagaacagcauuugaaaacugaggcuuguguuggggacagagaggugggggcagugaccacucucuugugguccaaggcuggggcgacuccaaaaugucuggagacuccuucguucaggaugugguucuauggccccagcgaggccguacagagccucgggcugagcuggggggcugaggcugcaguugggggucugaccucuccggugcacaggacugcuuccgggugucgaugugccccacuucccggguugcuucugcacuuaguguucacguuuacuuaaguaauuagauagcuucuuagcgagagggaagugggaauggagcagaacuggaauuugaaauacuaccaccuucccagcugcuucgaaaacuaaucaacgaggccucuuugugcucagcuacugaauuuaaaaaaaaaugguaucaagaaguuacaagccaggaugggagcauucuguugugauugugcacagcguggguuacaaaguggaguucuggaaguuuuaccccuccuaggggaauuccauuccccaucuccccaccuacuacuccuuugcagcuucaggguccugcauuuguuggggugggguauuuugcauuagaguuggagauuuugccuauccagggcauggcuaugggugccgggacugagagacaggaaggaagcauuggagagccaaccuagauaaggguaacuaguaacccucugcuguggccaguauuuacccaaugcugagaaaaaguccucauuuucgguuuauuuuuauggauuuaagcugucuaccaaguaguuaaaaaguagaccaggaauggccuuguagaguaaaaugugcuucuugaaauucuuugcuugcaggcaggcagaucaauaaucaccauagguaaaacagaaaaaauaaugcauuuaaaaaaaaacagagagaaaugaugcugugacuguuuuguuauuuuaccucuuuuuggggggcagaccucuugaaugggcucuuuauuguaacucucucuucccaauugagcuccccacggugccguuguaucuuuuuacagccccuaacaacucacaccaguaacacaauuaccuccagauauuuacaacaagaaauuacuuuucuauuuucuccacucacccaaaagacuuuuuuuuuuuuuccuuugggaaagguagggagguguucguacgggagcagccucggggaccccugcacugggucagggcuuaugaagcuagaagcgucccucuguucccuuugugaguugguggguuguugguacauuugguuggaagcuguguugcugguuagggagacucgguuuugcuccuuggguucgaggaaagcuggagaauagaagccauuguuugccgucugucggcuuugucgaccacgcucacccccuccuguucguacuuuuuaaagcagugaggcgagguagacagggugugucacaguacaguuaaaggggugaagaucuaaacgccaaaagagaaguuaaucacaauaagugagguuugggauaaaaaguugggcuugccccuuucaaagucccagaaagcugggagguagauggagagggggccauugggaaguuuuuuugguguagggagaggaguagaagauaaaggguaagcagaguguuggguucugggggucuugugaaguuccuuaaggaaggagggaguguggcccugcagcccucccaaacugcuccagccuaugcucuccggcaccaggaaguuccaagguucccuuccccuggucuccaaacuucagguauuccucuccccucacaccccuucaaccucagcucuuggccucuacuccuuacuccacuguuccuccuguuucccccuuccccuuuuccugguucuuuauauuuuugcaaagugggauccgaacuugcuagauuuuccaauucucccaagccagaccagagcagccucuuuuaaaggauggagacuucuguggcagaugccgcugaaaauguggguguaaugcugggacuuagaguuugaugacaguuugacugagcccuagaugcauguguuuuuccugagagugaggcucagagagcccauggacguaugcuguugaaccacagcuugauauaccuuuuucuccuucuguuuugucuuagggggaagacuuuaacuaggggcgcgcagaugugugaggccuuuuauugugagaguggacagacauccgagauuucaggcaaguucugugguggcugcuuugggcucaaaacccacaaacagucaaaacaaacuauuucaguaugcuucuucacuauaguucagauagaagaaaauaaaucaaaauuggggcaucgcuucuacugauuaaaggguuaacugcuaaagaauguaggggaaacagauuggggauauuccaguacuuuguuucaagccccaaaggguagauuuuguaugcacugcagggcagagcugagugacccucagaucgccccaagagguugaguggaucaauuccuaaagaacggagauucuccuguccuagccccagguccaccucgguugggaguucaggccuaccugaugcagcugcccgaggauuaacuccuauuuucuugcuaacagagccccauauucgagccccguggaaucccgcggcccccagccagagccagcaugcagaacaguaagugccucuggucuuucugggacuucgggcucggggugcgcggacccgagggucaggggaggacacagggacucgcgacgcccgcgcuggcccggccgccgaccgacugaggcccggggaccugcggcggcugcuccccgcuccgcgcccggcagcccgggaggggagggcguuugcuuggcucuucucgauacuggagaagcaggggcugggcccuuaagaacagcccgcccgaguuuucgaagcugcgguagagaaaccccaucccccccaaauccuguaacucacacccccucucgccccugcccgggcucugaccccggagagaggggcugggcugaucagggcggggcgaagucuucuccuaguugagcgagaaggaggccccuuugggcuuagccaagacugaaagucuccaccaacccggcgggguugggggcuucucuccccaagucacucucagggcagcuccuccccuccucaccccacuacgggccuagaagggauggggagaggagcccccaggccugcagcaggguaggggugguaaacucgcuguuacagggcgcgggagagagcacgguuuacugggucugguaaggaggugcccaggaauuggaaaaucccugcccuggcaacugcaauugcuuggguccugauagucccaggcccagagcgcuuuugauacuuauggcccuuguaccucccugcuuuccucugcccagaccccguggggucccacccaccuuccuguucguggugggugcugguacgcggcagggcuagucuagagcuccgaccugggagccuggaggcccagcgaaaccaggcccgguuugagguuacgguugaggcacacggcgucggggcucaacugaacucaaaguguggaaaggcccgggucuuccagcagccugcccuggccgaaccacacaggcuuaaggaggguccccagcaccuuauccaucuguuuuggaaacgccggucgcccccuggugcuuccggggcugguaagcgcguagcugaggaaagggcacaaagguggcgagcuuugcgggaguaguugugcagaaccugccggaccccagggcuuggccgguaggcucgccuucggcggcugggcucuccccuuggagcucagacuccccagccgcaggcugucucucgggcgggccccagccagggcgcgcagcccugagcguuugucgcugcggcccggcuggcaggccccgaggggcgcggggucgcgggccggccggcagggcuuugugccgcucguucccgggugugcgcgaggcgcggagcauccaaauugacaccauauguuuuccuauuaguugcuucgcggucgaguucuaggcgcauaaucaucgccagugggcgagagcgccagcagucccuagggaagggacacaaugauugaggcuuaaccucugaaggggaauuuggagcugcgcuuucucucugccauuucgaugcugggaguggcgcucuggcccuggcgucuccugggcaagcaccagccggcgguaucugcggagguggcuggcacguuguuauuuuuugaaaugagugaggagggaggucuagauuuaggcggccuuacgcgcccgccuuggcauuagcagacugggaauugccguggcuaugcccgaaguuuggaaagucucucucggucucuuucugggacagccuuucuuuuuccgggaagcuuccugugccuagagguggggcucuguagcuggagggguagauggaacuugcgaagcaaaggaaggcaauaaaaggaaguuaggagaaaccggaaacgugggccaggccuugcucuguuggagaagcgguguccccgcaaagucccugcuugcgcuggucccggccggagcccagaucccccaaacgccugucacuucucaucgaguugaggcuccggcccccacccgcgccuuggugagggcccccccucagccccaagccuucggcuacccugaaaacgcggcuccccucgaaggggaaacaagugcaguucaaucucgucugagugaucuacaaauaaggacggaaagggucguuuuaucacggucccguuugucgugacgaugcaauuucccggagcggagcacugucacaaagugacaaggcugccacaagcgccccgacugaucuuuucaauuagccuuccaugcaugauccggagcgacuuccgccuauuuccagaaauuaagcucaaacuugacgugcagcuaguuuuauuuuaaagacaaaugucagagaggcucaucauauuuuccccccucuucuauauuuggagcuuauuuauugcuaagaagcucaggcuccuggcgucaauuuaucaguaggcuccaaggagaagagaggagaggagaggagagcugaacagggagccacgucuuuuccugggagggcugcuaucuaagucggggcugcagguuggagauuuuuaaggaaguggaaauuggcaauuggcuuugugugucugugguuuuuggggagggggacuacaaagaggggcuaacucccucucccuauucucuaagguuggaccacagggaugagguugugagauacaaagauaaaggagggauggggaacacuaugaugugguauuuuucuuuucuguuuuuucuuuuugauaauaucuauccuuggcuaaggggagggcggaguucagcggcggaaauaaagcgagcaguggcuggugcgaaccgacucccggcucuaagccuuacuugcgguggccggacuugucuguggcugaagccgagcccgggcucugacucucacgucugcacuggaggugcggaaaccuggacugggguucaccagccacauacuggcugcucugguuguucucuccucuuccuucuucuauucuaaccaaacaaaacccaacucgaugcuugugccaggccuuggccaguuuggacggugauggaaacauuucuggauuuuagcgucuaagggagcacucaagggcuguaagguuugcuaucacugucccaacacugcagagaccuugaagguucagugugggaucuguagaacccaugguuugcggugacacucagaggggaucuuugggagauuuauagagccgguucuuagcgcuuuguggguucagaggcuggcugcaguguuuaugaagaggggcagugggcuggggacacugcugggguuauggcuguagugagguccauguguacuuguuccuuggcaugugucugacucuguguugcugcugcaguacagugggcaggggcacgguugcuuggacugggcugcccgaugucuggcauggcuggugguccuguuguccuuuauuugaucgauagcagggaacugaccgccgagguuggcacagguuggcagggggaugaggaugcauugugguugucuccuccuccucuccuucuuccucuuccccuuccuccucuccuuucuguucuuguucucccucaucuuccucuuccuucuucucccucuucuuccucuucacucugcucucuucucuucuuuuccccuuuccucuccucucccuuuccucaggucacagcggagugaaucagcucgguggugucuuugucaacgggcggccacugccggacuccacccggcagaagauuguagagcuagcucacagcggggcccggccgugcgacauuucccgaauucugcaggugauccucccggcgccgccccacucgccgcccccgcggcccuccacucucaacgcccucucuucauuucuuacuguaaacgaugcuaauuauggacccccccacccucacccaccccaguccccaguccccccacccacuccccugccuucccacuuuccccucuccuuccaccauccuucccuaucucuuucaaccugggucaguuacauaagauaacucaucugcuucagaaaaauauugugugcggauuuuuuuaaaaaaaucuuucucuuuuuauuugguaaagacauucauugugggaacaguuuaugaaccguaauaagcugaguuauauaaaccggcauaauuucauucugcucuccccagcccaugcuuaccucagcuuuugagguauuuguuuauucuucauguuuaugaauaauauauauugauuuuaaaaggcaaaugcuauuuacuccucccuaacucacauuuacucaauugaguauuuuuuaaagaagaagaaguaaaaaaaucaguuuauuuuuuaccuuuguucuuuaaaacauaacgccacuuuaagcaaggucagcacaaaaauaaauuuaucuacuucguuuugaugcaucuucaggcaguguuuaagaaaaguuuuuuuuuuaaaaaaagcuuuuaaauucguuuuuuaguucaaauuguuugaaaguaucaucauauuuguaguuuuuagggcuacaaauguaauuuuaagaaaaaaagcucucuacaguaaguucucauaccauugaagguauauuuuuguguuauagacccaugcagaugcaaaaguccaagugcuggacaaucaaaacguaagcuugucauuguuuaaugcauacuuaaacaauuuuauuuuugucuugaaauuauuaauaaugugguuuucuguccacuuccccuaugcagguguccaacggaugugugaguaaaauucugggcagguauuacgagacuggcuccaucagacccagggcaaucggugguaguaaaccgagaguagcgacuccagaaguuguaagcaaaauagcccaguauaagcgggagugcccguccaucuuugcuugggaaauccgagacagauuacuguccgagggggucuguaccaacgauaacauaccaagcguaaguucauugagaacaucugcccucccugcccuaagcccaaugcucucuccucuuuaccuccucccacccucucucuccacugucucuuagucuguguccucucccugcuccacauuugucuccuuuguaccugggggaacagagaggaaugcccugacuuuucuuugacugucuggaaaaugggagucaaguguggggagucauucacuucauuugcaugcugcaaaacagagggcggaggcaccagggaaaggcacuugaaugaagaaggaaaaugagaaccagauuguaacuucguccuaauccaccugccagaacuuuccuucaggugucacacauccauuuccauccuaauauuaaacaauauaaugaaagaaagcuuuacaacaagucuaaauaguuuuuauuuucgggcagucuuuuaacaaagcaaagcaaccgugugaguuaggucaccagagacaccaagcaauggugaaggacccccuccgcccaauucucuauccaacuaaauuuccaugcccaaagugauagcuaucauuuuuuccacgguguaucugcaaauccacccacugucccgggguggcugggagcuuuuuaacggguugagaguugcuuuuuaagguugugggugagcugagaugggugacugugucuucaggagacacuaccauuugguuugauuuugguuugauuugcaggugucaucaauaaacagaguucuucgcaaccuggcuagcgaaaagcaacagaugggcgcagacggcauguaugauaaacuaaggauguugaacgggcagaccggaagcuggggcacccgcccugguugguauccggggacuucggugccagggcaaccuacgcaagguaaaacccaagcagccauccacgcagcucuccauaugugcaucccuuugccuguccccuacucucccaaccauuuccucucagggcuuccaugcuuggggaaugucaugggugagacugcauuugaaggccugggacacaucgaccacauuguauguaggugguguuuguugaaccauuuuguuggccugggaaugugaggguuguguaugucaggagcgguaugaagguggcuggugggugcguguguguguuugugggcagcacugugugcauaagaacgagcugcguggugcacuauucaaauuugacauuagaaugcagggagagcccccuuguagaagugugacaagauaacgcacugacagacugcgagguuaacauaauuguauccuguugcuuuuugcuguaauugacaaauuaugugacuaugaguagggugcacaugaaaaggugagcagggagaugcagggcgagucggggauggggcauuggaagugguggucucccaacuaaaaccaccccacuauccuugccccucccccguucgccccucugggucccacuuucucacucucuguggguggcgacuauguggaaguggugaggugaagauacugugagcaggacggcgggaugccgggagccgcucuggucugggaggagagaugggaccugaaacaccccagguucugugagaagggcuggaggaagaagagcgggggaugggggggguggggcggaggggagggucaguuggcuccccuccgcuccccuccacaccccgagguagcuuggucaagaauaggaaacaguuuacuccgaagauuaaucgguauuuguuguccucgugacaaggagauaauaugcgggauaaugggacguggcgucucacucccaggagcacaacggagccgaggggcucggggccaggggcggcgcgcgggacugcgaggaggcugccggcgcauccgugagcucucggaccggcuccggaugcccggcgccuccauggagucgggcgagggaagggaaaaucgguaacaguaugcgaaauaucugguacaaaggaugcuucugucacucgcaagaauuuguuaugggaacaauccugucgcucuguaauugcucauuagagaacguuuuguuucucauuaaggcgacaugaauaagcgucuaguugaaggagacagcuguagaaauguuccacaagagaccucuggacacgauucggcaccaauugccaauuagacaugucaguuuuaagagcagaaaacaauauaggacggacacugggaagauagggagcaaagcgcucgcuucuuguuucccagcgcggccgcucggccggcggaggccuccugacgcgcggggcccgggcuccccugggcgaccccgcccgcacgggccccgaacccgccgccuccgcgagcucagagggcccccaggcccgcucccgccucuggugagacuagcgauugaccccaccgaguguaggcaaccccaucccugccugacuuuugaaaccguaggauucccacuuguagacacuggacacacccaagugacacccgaacuucgcacucacgagcguccaccccuccgcccccagcaaucugagguccuggugaucccuccccugacaagagucuggcccacuuaguccgagaagucuuggggagggacucagggcacgguggccuaggccugggagggcugagcccagagccuccacuccgggcucuccccggugcgugggcucccaugagcuuggggcgcaggauacaccccccuuccgcuucuuggaguugggcagaagccgaggacagcagcuuccaccagagguggcgcccgauucgggcggauuuucgucgccggcagucugagggcgggaagugagagucaaaucagcuaggguccgccugugaugguuggggccggagguggagcuaguccaggggcuuuucacuuuaacgcgccuaguugcuagaaaauucugggucaacuggcaaucaccacccccccacccgcaagugagguuuuuggggggugauugucaccucaggcacaggaccgucgccccuaguugcguggggaggacacgugggccaaacgaagcacagaguugccggcguggggguagcgggcaccgguggugagcuucgcuucacguucccggggaauccucagacuuuuuggugcuaagagggucccccucccucccuagcccccuuucccagcccaggaagccuuucuuggguuuuaaagaguccauacuccaaaagcauaaggcggggguuaggucucagagggagacaaauaugguuuccaucugaucaacgccaugcggcggugaauaaaaucgcgacgacgugggcugacaacaacaagagacaacucuauccagccccaauucuccggcgauuuggugguuuuagggaucacggagacacuuuuucuuaucuccuccccucaccccacccccaccccccauaauacccaagcccucuauaggauuuagucagccucucuuucaacagaugcuacaauguuuugauccgcgcuccagagcugaaaaggugccgcaaccggguugcuaucuuuucuugcuuguuuuccgccucacugauuaagacacuaagaaacuaaggaaugauuuuauuucccagcaacucucucucugucucucucucucucucucucucucaccuccuuccaggaaacaaauccuauucccaucgucagaugguccuggggcugggauaaugggaggcgcuuucacucgcuuucucacggauuaggcuggaaggugaacggcacccacugaaggccccugcuuugcgcggcuccgagggggcgccuuuugaagaagauaucuuaauuguccaccacuuagguuuaucgugggggugggggagucgagauccaacuucuaguuuuauuuuguuaaaagcuuuaagaguggaaggcaaauccacuaaaguggggggaaauguacccauuuuauguaagagcagccgcuaggucaccgccuggcugcaaacaguugccacuucuaaaguaaugaacugucuccgugccgcucuccccgcgggguagagaagggauccugcagcgacagguuucuuuuugcuguggaauuccaauccccgcuucccaucuuuuuuuuuuuuuuuuuuuuuuccagauuuaaaauugagcucuacugucccugcugacuuuucucucuuaagugucaguucuggaggcagcacagggccuggcggcgaucgcgugcugccuguguaaacccguguguauguuugugugagacagaacauggauaagaaugugaaucuccauguuuuaaaauuaagaaaaugucaaagaggcaaaugagagcagagcaugcuaucggcgggguucuucggaggcagauucgggcaacuuuguuuaauuggcgagaucgaaugugccagaaaagggaccgagauggggccccuaggaaggcaugggcaugaguggccauggggagaugggcauuguguucuccucagugucccccaccccauaccagaugugcacagauuuuugucuguuuuccaaaagcaauaacccuccggccuuucuaguuggccaaaaggagcuauuuccagucuuccuucuucaccaaacccgaaaauaaagcgagggguggggguggucgcuucauuucuucccuugaaaaacgcuuugaaaaguccccggaaacuuggggcaguaaauuagcacagacgcuugugcccgcacacgugagcggagcgcgucucccucagcuaaguagcccuccucgacccccaccuuucugauggagugcaaagacccagaguccagauggggcucaguuacuaauauucucuggcccucauccuccuuuuccucucucucccacucuuguucggcccucgugucucuuuuuccucucagcauucuuuucuguccuuuuuuaaaaauaccuuucuagccucuauguuuuuugagccuucuuuuccccuccaucgcccucuuuuucccuccaucgcccucugucuuuccccuaacccaggccccccaauccuucccccuugcuuccacccccaccgcugguuuccauccugccuccccuccaucuccucuauguaggaacccagcccugguccccguccacucucccugccuccccccaugcugggcccuggcccccccauccacccuccauccccccagccaagcgcccuaaauagcacggaggcgcccgcucuucggacagugauuaaugauagcagagcagagggguuaacacacuucacugaaaagucuguugacugggcuucuuguaacacaauguggcccgcugcacgccucaagagaauccuuuuguuguccgcgcucauuguagccucaaaauucugcccacgaaaguuugccaacgcuccugccccaggaguuuaauaguuucccuuacucgcggggcauugugcagcgcugaaaagcagccccucgcuauucaaguguugguggucaucucaauagaucuccaagggcccauaugguggccagugccgaugaauccgccuguuuaaaugggggagaaaguugggguuuuaaaacauuucaaaguuccugaaaagaucccacuagauccugucacaauucccugaacucuuugaaggcgcagccuauugucuccugguuauaaauaauauuccuggccaagucgauucccaccaaggcgcuccuaggggccccuccaccccgccucuggccaaguuuugaggauagggagguggguagcccaugcugguaucccuugggggucauuucaggaccccagacccaggacccagccuguaguggcccuggaggcccagucagaguuuaggcaauccugcuucccuucacuguggccuuacaggcaaggugcaagccgggagccagcuagcccaagugcacaucuugcccuccaggcagcaagggaaaaccauaaaacuuucccccuguauaaugauagaaguuacauucaaagugguggaaaugcccuaauuaaaaauguaccacuuaaaugauaugccaaagauucagcugcagcauagaauauuuagcuaguuagugaacucucuacuauuucuuuuuuaaaauuacacguuaaaaauuuaaaagaaaucuuacuuuucucuggugcaacacauuacaaagaauggacaguccuuuuaucuaaauauaaaauuccauuuucagcaauuauagccuguucuuggugaugauauaauuacagcugugcucguaauaggugucaaggcgaagcgcacucauacaauaguugaauaaaacugcagaacaaugcgagcacuucuaaauucacaaccuuuaaaugaaauugacugugcagaauucaaauaaaaacuagauaaauauuuuuuaaaaaagauuacaagcuugguuugguuucuuaauagcauuuucuacaaaccuaucaacaucuaauugauuagauaggaauuacugauuauagaucaacugaaaucuugaacaucacucuucuauuuucccaacacagccauagguaaagagauucuguagggaguggagugaggcauuuggggaguugggguuacuuauaaaagaucauuuuaauuggaaacuucagugcuuauuuuuucauucaagaaaugccacuuaguguguguauuauaaagucucaucuugauaaaaacaaagaaaaugguggucagguaacuaacaucgcaaauguauuuuuuuaaaagaaggcugacaguuaccuugggaauguuuuggugaggcugucgggauauaaugcucuuggaguuuaagacuacaccaggccccuuuuggaggcuccaaguuaauccaaauuucucuuaccauccuauucuuuuuguuccagauggcugccagcaacaggaaggagggggagagaauaccaacuccaucaguuccaacggagaagauucagaugaggcucaaaugcgacuucagcugaagcggaagcugcaaagaaauagaacauccuuuacccaagagcaaauugaggcccuggagaaaggugauagaguuuuucaaaguagagaagcaguaaaucaaaguaaaugccacaucuucaguacaaagagcuaaauuuagccagggcccuuugcauagaagaaugaaaagauuuccuuuuuucugucuuuuuauuucucugggcaucuuuucagugugugugugugugugugugugugugugugugugugugugugugugugugugugugugguguguguguguguguuucuucuuuucaucuaccaguaauucaaagacuaaaugucugacuuauaaggaaaaaugaugauuuggcuauuucaggccacagaaaggucacugaaugccauuccaaagaaaauuuaacuugguucuggugggaaaguucuuccaaguacagucaacacuagaagcauuuuaaagggaauugguuggagguaaugggaguggggaggugggaaccaguuugaugcacaguuuggucaacauauuuuguguaguucuggcacaauauggaaaaucaacuuacucuuucagaguuugagagaacccauuauccagauguguuugcccgagaaagacuagcagccaaaauagaucuaccugaagcaagaauacagguaccgagagacugugcaguuucacacuuugugauucauaccauuugucuuuccuagagacagaggugcuuguacagaguacuauuuauuuauaggacuaauauaauaaaaagguucagucugcuaaaugcucugcugccaugggcguggggagggcagcaguggaggugccaagguggggcugggcucgacguagacacagugcuaaccugucccaccugauuuccagguaugguuuucuaaucgaagggccaaauggagaagagaagaaaaacugaggaaucagagaagacaggccagcaacacaccuagucauauuccuaucagcaguaguuucagcaccagugucuaccaaccaauuccacaacccaccacaccggguaauuugaaauacuaauacuacgaaucaaugucuuuaaaccuguuugcuccgggcucugacucucacucugacuacugucauuucucuugcccucaguuuccuccuucacaucuggcuccauguugggccgaacagacacagcccucacaaacaccuacagcgcucugccgccuaugcccagcuucaccauggcaaauaaccugccuaugcaaguaagugcggcuggugguggccugcauaacccaggccccagagaagugaggaguggcucagggccugcggaccucauuggcugugucugcacccuugagagcuuuucgcacuacagugauuggcuugaccagucaagucggagacagucaaucccaucacuuuuaagugauugacucauuaauucaugcccuaaaaaaaugaguaauaaaaaucuguccaguuuugucagguugaucugccuuuuauuauacuguuaccuugauaauguuggguggugguggggcauguuuuggguaccagggagccuugcaccagaaaguggaaauaaugcuggcacauuaucagauagcagauuaguaguuuaaaauuuggguuuauauuaauguguuuguaugcuaaauauagaaucugugcacgcauuuggggcauuacuuuggguauaugugauaaacuagugagaaagaaaaaaggaucagaaaugggauucauauuuacauggugagauauacauaauauaaugagaaugcuaguuuucugucuguaucuacaauaagaaaaggcauagcagguauuugcuggaaauuuagugugucuuugcugugaauggugugacgaguuuguggcccuccuagcugccugggaagcuugaugcuauucacuugguaugacagccugccucuccucuuaguucugucccaaauaucuauuagccccuacauuuagagguccugcacuagguucacccuuuaugauguaaguuggauaaggcagaugguuuguacuagaccuuuguugcuggauggauucuugauaggaaaaaugucugucuucugguaggccuuucccagugguuuuccuagaacuccuguuugugcaacaauuagagauauuagaugguacgauauuggccagcaugagccucugcuggaaacaguucuggggcuacacugauuguuuauucuccauugaacauuuuuugcuggauuucaaauccaaauaacagcaaaauaaauguuucacagucuucagacuaauauaggagcagcuagauaagcaacuucagaggaauuauucacauguuuauuuuuauugcaucuggauauuguuggccauagugcaauugauguaaauuaagggauuaacagcccauuaguugguguugcuauaacugcguuggaauuuuccagaagucagguugccuagaggaacucauugcaggaauuagaaacaaaugcaagcugaaauucuggcaggcccucaaggccuguuugccucuuugaacuugauguuagcauucaucaucugacuuuaauaaggccacagagugucucguucaguuucauguauuauaacaacauccagguuucugugaagauagcaaaauguguaugugagaaaauaauaagacgaacaaguagaugcugcaauuauauuagggcuguuuccacauacagagcgguauggggaaucaaucuauuucaaacacugacuuuuaaaaauuacauaauuuguauaauucaaaaaguacaugcauucauuaagcauaaagaaaaucaaaaugaucaauaacuuuacucuucagagaaaacuacucuuugaauuuuggagugggugagcccgauugucuauccauuuauucauucucuugaccaaaaucaucauuuuacaaauggugggugucuuccucuggaccuucucugauaugcuucccucucugagcauauggauuuuggaaauuaaacauuucuccaguuugcagagaagagaaaugauaguauacuguacuaucaucugaccugcuuguucccgacacacuucuuuuaauucaucccaaguuugcugccauggcauaguaccaugagagcucaugaggcguuuuguuaggagaaagguuuaccuccucagugcugccauuccgaacaguucgaggguagcaacaguuuucuaguuauaagucagucugggcuuuugggucuguuaggaagucaugguuaauucucaggauggaggucguuauauuuacuaacacuucugaucacuuuaacuuggggucauuacagaucugcuucuucaaagaaucuuuaaucccaucagugaaagguucccaaggucccugaaccauacuuuacugagagcuccucccacugcucucugucccaaagcuugagauaugggcucugggggucauaggguucccaaauaaauccagauuugcagggagaggggauguguuuugaugaagguccucaugcuauagguucuucaaagaugcuagcagagguuagagacaaaaauccuauuaauuuauggauaguggcaaccaucuagcuggacaguugucagaaccuaaagugcuuuagaggcuugauacauaggcagcuuucuucuagcuguggccaguggaaggacuagcucgaggcccaaucuuagauuuaucauauggaauuccaguacuucacgugaaggcaucuuuaaugaucagacuuguuggcagaguuccucgggaggagggagccuggggcuguggcugugugauguguuccucaguaaccacagguuugccucucuccucacagcccccaguccccagccagaccuccucauacuccugcaugcugcccaccagcccuucggugaaugggcggaguuaugauaccuacacccccccacauaugcagacacacaugaacagucagccaaugggcaccucgggcaccacuucaacaggugagccacugcuuucugcaggcugcacagaggcgaucucucuucacuagaaguuuacccaaacagaaucuccuggucuuaugggagggcguguuuaacuccuugcuuuccuugucccugggggauggggauugaaaagggaaauucaguuaagcuaauuaguaacuuuacaccauauagacaaaaacuaaaauuguuuuuccugaauuuggucacaaaaguuguguaugaagacaaggccugagacugcaaguuuucugaggacagauuauuagacgaagcucaguagggggcccacugagcuguaggugcgugcuuguugaaaugcuucuugcccucauagcuccucuagaccuuuugcuggaaauaaaaagugacacauugguuuuccagagacagcuuuauuguaaaaguuccaaacaugcaaacaaacagaggauuuuuuuuuucuuuuccuuuggauuggggugggggguacuugggauccaauagguauauauacauauauugucuaguuucugaaggugcuacuuuuauuuguaacaauugaagugauuuuaauacaguaaaaaauguuagaaaguauuaguuuuuuuuuuuuuuuuuuuuuuuguaaaccuauaaauuuguauuccaugucuguuucucaaagggaauaucuacauggcuauuucuuucauccacuucuaggacucauuuccccuggugugucaguuccaguucaaguucccggaagugaaccugauaugucucaauacuggccaagauuacaguaaaaaaaaaaaaaaaaaaaaaaaggaaaggaaauauuguguuaauucagucagugacuauggggacacaacaguugagcuuucaggaaagaaagaaaaauggcuguuagagccgcuucaguucuacaauuguguccuguauuguaccacuggggaaggaauggacuugaaacaaggaccuuuguauacagaaggcacgauaucaguuggaacaaaucuucauuuugguauccaaacuuuuauucauuuugguguauuauuuguaaaugggcauuuguauguuauaaugaaaaaaagaacaauguagacuggauggauguuugaucuguguuggucaugaaguuguuuuuuuuuuuuuuaaaaagaaaaccaugaucaacaagcuuugccacgaauuuaagaguuuuaucaagauauaucgaauacuucuacccaucuguucauaguuuauggacugauguuccaaguuuguaucauuccuuugcauauaauuaaaccuggaacaacaugcacuagauuuaugucagaaauaucuguugguuuuccaaagguuguuaacagaugaaguuuaugugcaaaaaaggguaagauauaaauucaaggaagaaaaaaaguugauagcuaaaagguagagugugucuucgauauaauccaauuuguuuuaugucaaaauguaaguauuugucuucccuagaaauccucagaaugauuucuauaauaaaguuaauuucauuuauauuugacaagaauauagauguuuuauacacauuuucaugcaaucauacguuucuuuuuuggccagcaaaaguuaauuguucuuagauauaguuguauuacuguucacgguccaaucauuuugugcaucuagaguucauuccuaaucaauuaaaagugcuugcaagaguuuuaaacuuaaguguuuugaaguuguucacaacuacauaucaaaauuaaccauuguugauuguaaaaaaccaugccaaagccuuuguauuuccuuuauuauacaguuuucuuuuuaaccuuauagugugguguuacaaauuuuauuuccauguuagaucaacauucuaaaccaaugguuacuuucacacacacucuguuuuacauccugaugauccuuaaaaaauaauccuuauagauaccauaaaucaaaaacguguuagaaaaaaauuccacuuacagcaggguguagaucugugcccauuuauacccacaacauauauacaaaaugguaacauuucccaguuagccauuuaauucuaaagcucaaagucuagaaauaauuuaaaaaugcaacaagcgauuagcuaggaauuguuuuuugaauuaggacuggcauuuucaaucugggcagauuuccauugucagccuauuucaacaaugauuucacugaaguauauucaaaaguagauuucuuaaaggagacuuucugaaagcuguugccuuuuucaaauaggcccucucccuuuucugucucccuccccuuugcacaagaggcaucauuucccauugaaccacuacagcuguucccauuugaaucuugcuuucugugcgguuguggaugguuggaggguggaggggggauguugcaugucaaggaauaaugagcacagacacaucaacagacaacaacaaagcagacugugacuggccggugggaauuaaaggccuucagucauuggcagcuuaagccaaacauucccaaaucuaugaagcagggcccauuguuggucaguuguuauuugcaaugaagcacaguucugaucauguuuaaaguggaggcacgcagggcaggagugcuugagcccaagcaaaggauggaaaaaaauaagccuuuguuggguaaaaaaggacugucugagacuuucauuuguucugugcaacauauaagucaauacagauaagucuuccucugcaaacuucacuaaaaagccuggggguucuggcagucuagauuaaaaugcuugcacaugcagaaaccucuggggacaaagacacacuuccacugaauuauacucugcuuuaaaaaaauccccaaaagcaaaugaucagaaauguagaaauuaauggaaggauuuaaacaugaccuucucguucaauaucuacuguuuuuuaguuaaggaauuacuugugaacagauaauugagauucauugcuccggcaugaaauauacuaauaauuuuauuccaccagaguugcugcacauuuggagacaccuuccuaaguugcaguuuuuguaugugugcauguaguuuuguucagugucagccugcacugcacagcagcacauuucugcaggggagugagcacacauacgcacuguugguacaauugccggugcagacauuucuaccuccugacauuuugcagccuacauucccugagggcugugugcugagggaacugucagagaagggcuaugugggagugcaugccacagcugcuggcuggcuuacuucuuccuucucgcuggcuguaauuuccaccacggucaggcagccaguuccggcccacgguucuguuguguagacagcagagacuuuggagacccggaugucgcacgccaggugcaagaggugggaaugggagaaaaggagugacgugggagcggagggucuguaugugugcacuugggcacguauaugugugcucugaaggucaggauugccagggcaaaguagcacagucugguauagucugaagaagcggcugcucagcugcagaagcccucugguccggcaggaugggaacggcugccuugccuucugcccacacccuagggacaugagcuguccuuccaaacagagcuccaggcacucucuuggggacagcauggcaggcucugugugguagcagugccugggaguuggccuuuuacucauuguugaaauaauuuuuguuuauuauuuauuuaacgauacauauauuuauauauuuaucaaugggguaucugcagggauguuuugacaccaucuuccaggauggagauuauuugugaagacuucaguagaaucccaggacuaaacgucuaaauuuuuucuccaaacuugacugacuugggaaaaccaggugaauagaauaagagcugaauguuuuaaguaauaaacguucaaacugcucuaaguaaaaaaaugcauuuuacugcaaugaauuucuagaauauuuuucccccaaagcuaugccuccuaacccuuaaauggugaacaacugguuucuugcuacagcucacugccauuucuucuuacuaucaucacuagguuuccuaagauucacucauacaguauuauuugaagauucagcuuuguucugugaaugucaucuuaggauugugucuauauucuuuugcuuauuucuuuuuacucugggccucucauacuaguaagauuuuaaaaagccuuuucuucucuguauguuuggcucaccaaggcgaaauauauauucuucucuuuuucauuucucaagaauaaaccucaucugcuuuuuuguuuuucuguguuuuggcuugguacugaaugacucaacugcucgguuuuaaaguucaaaguguaaguacuuaggguuaguacugcuuauuucaauaauguugacggugacuaucuuuggaaagcaguaacaugcugucuuagaaaugacauuaauaaugggcuuaaacaaaugaauagggggguccccccacucuccuuuuguaugccuaugugugucugauuuguuaaaagauggacagggaauugauugcagagugucgcuuccuucuaaaguaguuuuauuuugucuacuguuaguauuuaaagauccuggagguggacauaaggaauaaauggaagagaaaaguagauauuguaugguggcuacuaaaaggaaauucaaaaagucuuagaacccgagcaccugagcaaacugcaguagucaaaauauuuaucucauguuaaagaaaggcaaaucuaguguaagaaaugaguaccauauaggguuuugaaguucauauacuagaaacacuuaaaagauaucauuucagauauuacguuuggcauuguucuuaaguauuuauaucuuugagucaagcugauaauuaaaaaaaaucuguuaauggaguguauauuucauaauguaucaaaauggugucuauaccuaagguagcauuauugaagagagauauguuuauguaguaaguuauuaacauaaugaguaacaaauaauguuuccagaagaaaggaaaacacauuuucagagugcguuuuuaucagaggaagacaaaaauacacaccccucuccaguagcuuauuuuuacaaagccggcccagugaauuagaaaaacaaagcacuuggauaugauuuuuggaaagcccagguacacuuauuauucaaaaugcacuuuuacugaguuugaaaaguuucuuuuauauuuaaaauaaggguucaaauaugcauauucaauuuuuauaguaguuaucuauuugcaaagcauauauuaacuaguaauuggcuguuaauuuuauagacaugguagccagggaaguauaucaaugaccuauuaaguauuuugacaagcaauuuacauaucugaugaccucguaucucuuuuucagcaagucaaaugcuauguaauuguuccauuguguguuguauaaaaugaaucaacacgguaagaaaaagguuagaguuauuaaaauaauaaacugacuaaaauacucauuugaauuuauucagaauguucauaaugcuuucaaaggacauagcagagcuuuuguggaguauccgcacaacauuauuuauuaucuauggacuaaaucaauuuuuugaaguugcuuuaaaauuuaaaagcaccuuugcuuaauauaaagcccuuuaauuuuaacugacagaucaauucugaaacuuuauuuugaaaagaaaauggggaagaaucugugucuuuagaauuaaaagaaaugaaaaaaauaaacccgacauucuaaaaaaauagaauaagaaaccugauuuuuaguacuaaugaaauagcgggugacaaaauaguugucuuuuugauuuugaucacaaaaaauaaacugguagugacaggauaugauggagagauuugacauccuggcaaaucacugucauugauucaauuauucuaauucugaauaaaagcuguauacagua

SEQ ID NO: 34842 - RNA, 2380 nt, Homo sapiens
acaaacaggcgccggacgcggagccgccaggaagcgcgggagggggggcgggcccgagggggggccgggccgcuugguaaccccucccuguccgggccucgccgcucaguacgggggcggggcuagccggcugacccccuggccuacucccggccuccggcuccaggcccuucccggauccccgcccccggauucccaggggacggggaagggagcgcccgccccgauaucuccgccccccagccccuaaccccucaggguugagcggaccaaccccaccacuuccgcgaggggcaggggcggggucacaaaacgggcccucggccuaggggcggaguuucucguaaggggcaaggccaaggcaucuuguauuggggcugacaggggggcggguuauuagggcugaggaugggaggaugcucaggguauuggggucaggguggcauuagcccagcucaagccgggccgggcugacucagcauccugccccagccagcuuccaucccugacaccucugcauucccuugggcagagaugggagauggcgccgguguugccccuggugcugccccugcagccccgcauccgccuggcacaagggcucuggcuccucuccuggcugcuggcgcuggcugguggcgucauccuccucuguagugggcaccuccugguccagcuaaggcaccuuggcaccuuccuggcucccuccugucaguucccuguccugccccaggcugcccuggcagcgggcgcgguggcucugggcacaggacuaguggguguaggagccagccgggcaagucugaaugcagcucuauacccucccuggcgagggguccugggcccgcugcugguggcuggcacggcuggugggggggggcuccuggucgucggccucgggcuagcccuggcuuugccugggagucuggaugaggcgcuggaggagggccuggugacugccuuggcucacuacaaggacacagaggugccugggcacugucaggccaaaaggcugguggaugagcugcaacugagguaccacugcugcgggcgccacggguacaaggauugguuugggguccagugggucagcagccguuaccuggaucccggugaccgggauguggcugagugagugauuugcgucucccuuccuccuccuccuccucccuggacaggcucccuccugcugccuugaauccccaccucgcucagaggggcaauaaguagaacauaguggcugagagacugguuacagcucugccauuuauuagcugugaaacccagggcauguuaccaaaccacccugggcccauuccuucaccuguaaaauggaaauaauaguacuuaucugauagaguuguugugaagaugugaauuaugcuuggcuggcacauaguacagcagucaguaaauguuuuacuauucuuuuucccuucugaacaccugugcccuucagucccucccccaggccucuaucuccagacauccuaaccccucugucccucccuuugcagccggauccagagcaauguagaaggccuauaccugacugauggggucccuuucuccuguugcaacccccacucaccccggccuugccugcaaaaccgucuuucagacuccuacgcccacccccuguucgauccccgacaacccaaccaaaaccucugggcccaagggugccaugaggugcugcuggagcacuugcaggacuuggcaggcacacuggguagcaugcuggcugucaccuuccuacugcaggugagucagcaaagcaucugacaccuccucccacccgggacuccucccugccuccaacccugggccucuuggaaccgcugacucucccugacucuuuccccuugcuucccccacaggcucuggugcuccuuggccugcgguaccugcaaacagcacuggaggggcuuggaggggucauugaugcgggaggagagacccagggcuaucucuuucccagugggcugaaagauaugcugaaaacagcauggcuacagggagggguugccugcaggccagcaccugaggaggccccaccaggagaagcaccucccaaggaggaucuaucugaggccuagaggccuggagcuuggggugaggaagagggagggauggacaagucugaaaaccucacaacuccuuaccaaggcuccagguuggggggaucguaggauuagaggggcuaaggauagucagcgagcuggacugggguaagaaagaaaaccagauguccuagggccuagcccuuguagucagaaccaccagggaacagcaaagaacagagugaugggaaagugacaugagaaggccuggaggcugauucugauauagacucaauaaaguuuuuggauggaagcaa

SEQ ID NO: 34843 - RNA, 4376 nt, Homo sapiens
aauacgccuggcauccaaguccacccacuccggacuuuggccuuagcaguaguuagugugggaggcugggaagacugggagcagucucuuaaacaaaagcaaaagaauaagcuucgggcgcuguaguaccugccagcuuucgccacaggagguaaguggauacugggagcugggggaacugagaagacuagccagauauuacauguauugccaacucaaaacuuucagcuuuuaacaugcuuccucacacauuauccccuuugauccuccacaacucugagguggaccuggugggucuuagccccacuugguagaugagaaaauagguugagagagacagugagaugcucaguaucacacagcaaaccucuuggcccuauacaucauuccaaacacaagacccagguugcauauagaagguucagugucccugguuuagaaggagagguggugugaggcaagcaagaagaugccucugcugcacuccagccugggcgacagagugagacuccaucucaaaaaaaaaaaaaaaaaaaaaaagaugccucugcuccauacagcaggucuguacacaggaucuggcucaugugguuuuaguuaaguuagccacaaauacagggucugcccacaucuuugcuuugaacagaugagccaugguuggccaauuaucugccaaccagauaauuucucaauaugcucacaccagaugcuuccagcuagggaggguauuaggggaaagggcuugagggccacaguaaacuggacaaguuuuucugcccagccuaggcugccaccuguaggucacuugggcuccagcuauguggcugccucuucugcugggugccuuacucugggcagugcugugguugcucagggaccggcagagccugcccgccagcaaugccuuugucuucaucaccggcugugacucaggcuuugggcgccuucuggcacugcagcuggaccagagaggcuuccgaguccuggccagcugccugacccccuccggggccgaggaccugcagcggguggccuccucccgccuccacaccacccuguuggauaucacugauccccagagcguccagcaggcagccaaguggguggagaugcacguuaaggaagcagguaaguaugguagaccaccaggaauauggugugggguguccugauccccacagucaccccaggagucaccugcaagggcugugguaagcuaaagggacaauuugaggagaagcaguuuucagaugcucccaggaagaagagggagcugugggagugccucaccuacccccagcauccuuuucaucuccccacagggcuuuuuggucuggugaauaaugcugguguggcugguaucaucggacccacaccauggcugacccgggacgauuuccagcgggugcugaaugugaacacaaugggucccaucggggucacccuugcccugcugccucugcugcagcaagcccggggccgggugaucaacaucaccagcguccugggucgccuggcagccaauggugggggcuacugugucuccaaauuuggccuggaggccuucucugacagccugaggugagggguacagggcucuggguuccaggacuaacagcagcccacucaacaaacgugggccagcagaggugguuaagauacagcacauuggaauaguuaagaagagacaguuuagggcuagacuucauggguucaaugaagucuacccuuauguaagcuuugugaccauaaguagauuacuucucuuuacccauuuuuaacguguuuguuuuuuguuuuuugagauggagucuugcucugucgccaggcuggagugcaguggcgcgaucuuggcucaccacaauuuccacccccgggguucaagcgauucuccugccucagccucccgaguagcugggacuacaggcaugcgccaccaugccuggcuuauuuuuguauuuuuaguagagacaggguuucacuauguuggccagguuggucucaaacuccugaccucgugauccgcccaccucagccucccaaagugcugggauuacaggugugagccaccacgcccggccuugccucucgucuuuaaacaauaagguucaaaguuccgugggagcacaaaggagacaugaugaggacaacgggaguagggccugaguuuuuuuuuguuuuuuuuuuuuuaagcguuuugcucuuguugccuaggcuggagugcaauggcgagaucucagcucacugcaaccccugccucucagguucaugugauucuccugccucagccucccgauuagcugggcuuacaggcacgugccaccacucccagcuaauuuuuuuguauuuuuaguagagauggaguuauaccauguuggccaggcugguuuugaacuccugaccucaggugauccacccgacccggccucccaaagugcugggauuacaggcaugagccaccacacacggcccaaggccugaguucuuagcaggaguauaaggcgccuaagcuuagucuaccuucuaaggaagccugcguuugucaccaucacucagcaaauaaccugaaugucuccugucucucagccuuaauuuuucaggcagcaucaugggacacauacuuuuaguuuugagacaaggccuugcucucacccaggguggagugcaguggugcagucacggcccacugaacuucaaacuccuaggcucaagcagcucaagcgauauccgccucagccuccugaguagcugagaccacaggcgcgugccagcaugccuggcuaguauuuuuuuacagauggggucuugcuguggugaccagacuugucuccaacucccggccucaagcgaugcuuccgccugggccucccaaaguguugggauuauaggugugagccacugcauacuggaacacauacuuuauacuugaauuuuuuuuuauccccuucccuccugcuccuuaccuauacuuggauuucuacaucugugccagggcagugggauguauccccacuuuccccaucagcuuacccuccagcaaauacgagacuauacccuucaauauccagcacucagggcucaaccauguguuuugggagcaagggaaugggguuccucuaggucaggaaucggcaaacucaguacucaagccagaucuggccagcugccuacaagcugauaaugguuuuuuuuauuuuuaaaugguuacauuguaaacuguuauauaaguaccugauaauaucauuaauuuuguuucuuggccugccaugcuuaaaauauuaacucucuggcccuuuaagaaaaaaacgugcugaccccugcucuagaucaaagaaaacaaaccucaaaaauacuuuccucccucuaccccacuugacccuugucccggggcaguaggcaucuccgucaaaacucuugucccuggucugugguaacuuucucagcuccccaacccaugucccucaaaguccccucccuauagggcaagaacccagcaacuucgcucugccccgacucuaggcgggauguagcucauuuugggauacgagucuccaucguggagccuggcuucuuccgaaccccugugaccaaccuggagagucuggagaaaacccugcaggccugcugggcacggcugccuccugccacacaggcccacuaugggggggccuuccucaccaagugugaguagccaggcccacacaggggcacaugaagggaaacaaguaccagaaaggccaguccugcauaagccugcuaggagguggguggggcacccagggcaggguugagggugaacaggauguuacaagagugcccaggccauguggaaccugcccacuccccacacugaggaggggacugagggugacaagcccagggccccagaagacaguaccuaagaugggcuggagugaggaagggaaacugauugcaaccaccuauggggcugcagaccugaaaaugcaacagcgcaucaugaaccugaucugugacccggaccuaaccaaggugagccgaugccuggagcaugcccugacugcucgacacccccgaacccgcuacagcccagguugggaugccaagcugcucuggcugccugccuccuaccugccagccagccugguggaugcugugcucaccuggguccuucccaagccugcccaagcagucuacugaauccagccuuccagcaagagauuguuuuucaaggacaaggacuuugauuuauuucugcccccacccugguacugccuggugccugccacaaaauaagcacuaacaaaaguguauuguuuaaaaaauaaaaagaaggugggcagaaaugugcccaguggaaggcugaccccauuuaagugccaacuacuccaaaccga

SEQ ID NO: 34844 - RNA, 4376 nt, Homo sapiens; identical to SEQ ID NO: 34843

SEQ ID NO: 34845 - RNA, 32566 nt, Homo sapiens
gggcacaagcaauccucccuucucagcuuccugaguggccaggacuacagguaagugccaccaugccagacuaauuuucaaaauuuuuguagagacaguaucucacuguguuguagagacagugucucacuauguugcuuaggcuugucuugaacuccugaucucaaaugauccaccugccuuggccuccuaaagcauuaggauaacagucaugaaccacugugcccagcuuuuuuaaaaauuuaauauauauauauuuuuuaaauggagaugagaucucauuauguugcccaggcuggucucaaacuccugagcucaagugauucucccaccuuagggucccaaagugcuaggauuacacacaugagccaccaugccuggccugugcucaguuuuuuaaguuuuuuucuauuaaccauuuuuauagccugugaaugucagauauuuaccuaagcaagaaauuuaaaguuaaauacauggguauuuuguugauaacucagaagguuuagcuguauuucuuaaaccaacaauauuaaauuagucuuacuuauaaaaaaaaucacacaaagauuauuuugguuuuggcuggguucauaguuuuuuaccuuugugccaaauccugacccuguaaaauauuuaauaagacaaguauaaaucugaccauaaaucuaggcaaauauguauguugacaauuuugaagacauuuuaauauuuauuuuacuaauaauuuuaaagccaguuuauuuauuaaagaauuacuuaagucaugugaacuuggaaaaccuuugggcuuacuaauuuaugagugcucauuuaucuauaagucaauuggguaucauguagauacaacauauaacauauuacauguauauauguaaacacaucuaaacacacauauauaugcacaaauagagaucuuauaccuuuauuuuuugauuugucuuuugaaacagggccucacucuguugcccaggguagagagcagugguaugaccauggcucacugcagccuggaccucccaggcucaagugauucucccaccucagccuccugaguaccugggacuacaggugcgugccgccaugcccagcuaacuuaaaaaaguuuuuuuuuuguagagucagagucucacuauguugccagggcuggucuugagcuccugggcgcaaaugauccuccuaccuuggccucccaaagugcugggacugcuggcaugagucaccucaucuggcccuuauaguuuucauuuuagaauuuuagucaugagauaguaauacaaacucaccaguuuauaaaagauaguuggaucuaaauuauuuuuggaaaaaauugggaccuguuaguucacauggcuaaauuuuauuugucccaauagguaaucuaaugaaggcugugagccaaaauuuuuggguaagguaguucgauggcaguuuuauuuuaaaaaucuuuuauccuuuuauucaguuucaaaugaguuuagaguuagguuuuuaauguuaacauuuuagcuugaacuggcugaaucguauaagaaaaacaaaauuucuaagucuucuuaaguuaguaauacuauaaacagugagcuuuaucucaacacaaguagaaaagucaguaguuucaaaguaggcagaaaaaauauauagagguagacagagaacuuagacgauccuacauguuaacucuguaguucuggguggaccacuugaguucuaaucugucuauuauuuuaagaugugcacaacaaugggccauaauauguaucuagcuggagucucagaaaacccaguaugucuuuuuuuauuuuuccgagacagaguuucacucuguugcccaggcuggagugcaguggcaugaucacagcucauugcaaccucucucuccuggucucaagugaucccccaacuucagccucccuaauagcugggacuacaggugcauaccaccgugccuggcuaauuuuugcauuuuuuggguagagaugggguuuugccauguugcccaggcuggucucaaacuccuagacucaaguguucuucccaccucagcaucccaaagugcugggauuacaggcgugagccacugugcuuggccuggcaugucuuaauguuugagaaucucauuuuuaaaauauuaaucucucaguuuagaaaaacuguuggauucguauuuuuaugaucucaguaguucuauuuucauucugcaguuguuuuguuuguuccccuuguuuuaaauuuaaauauauuucccccuuuugagggaaggaaauguguguauugugaaauucuaaaaaaucugugccuaagagguguaugggagccaggagaacaaacaggaagagcugaguucugauuacggggguagaaggaggaggagcagcuagaggcaaaaaggagaaagccuccuaaaucauuaaaauuuucaaaucguuucacauaucuuuuuuaccucuugaauugaggcauuuuuaaaauaauuuuuuuagaagcuuguagguguuauuggaaguaaaucuuccauucaauuugucuguaucuaaaaccagcuuuuuuucaacugugugugcaaauaaauuaucuuaggcauuuucggaacagcuccauuuuggccacugcugcuuauaaccacccuggguuaggggaucuacugcuuaucuaggcacuugcaaguggaaggaugguaaguauuauaccuaaaacucagcaggugucuuagagugcacuucccauuuuagcuuugugugaggacaaguuauggaguagaguaagagugcccucaugcgacuggaaaaggaaaaagcuaaggaaaggucucaccccaaaucaccagggaaacaauuuacaaagcuucuauuuuacccugcccuaguauuuaacaaaagcccuuaucuugaauucauagcagcagcucucguucugagacagucauuguaccacguagccaaggaggaaaccagcuuuaauaaaccagaacaucaaccaagacaggaacuucauugauuucaggaggaacucaucuguagcacucagcaggggcaucuaaguccaggaacacaauggauuuugugcuggcacaugcacaaagguuggaagcaggucuagguaguccagggaggucacucugaaauccugucagcuaugccauuuuguugauggaaauuaaggcuguugaggcagaaauaaauugauaaagguuuauuggaagccaaaugugaggaucaaucugggaagacacgccaauaaagcuggguguauuccaaagucugucguuagaaguuggaaugauuuuauaagaaaguuuagaagaagggauggagacucuucauacuggaguuguccuuuuucauugaauggcacaauacagagguuacaguccuuggcuacagaugacaacauacaaguuaaaauguccauguuuaagacaaucaguaacacuucaugauucagaaacaaaucaguguccuuuucagugucaguagguuacauauuaauguguacgucaacaguuugagaaauuuucaauaagauuugagagacucaucguaagauucuuuacucagaaaugcuauguaagccaugaaucauaagacuugccccagguaggcuaauuuggaagacugccaaacgugaccuguagguuaucacaacuaaaugcaaugugggguccugaauucaauccuggaccagaaauaggacauuagugagaaaacuggugaaauuagaauaaagccauuaguuuaguuagugguguuguaccaauguuaauuuccugguuuugaucauuguucuaagguuauuuaaaauguugacauuuggggaagcugagugaaaaguaugcaggaauuuuuuguauuauuuuugcaauuuuuuguaauauuucaaaauaagauguuuuaaaagacacauuugaucaaccaugacagaggaaaggcugaauuaucuuuuuauuuucccuagggaaaaugauauuuacaaaauaauuuuuauaggaggaggcacucaaaaaguauacagccaaaaauauaagaaaaaaauaucauuaacuaugucaagcaguuaauuaguaaagauaucaggugcaguggcaugugccuauaguuccaguuacuugggaggaugagguagaaagaucccuuuagccuagacguucugggcuuguaguguauugugccaaucagguguccacauuaaguucagcaucaauauagugaccuccugggagcaggggaccaccagguuaccuaagaaggagagaacuggcccaggucagaaacagagcaagucaaaauacaggcgcugaucagucgcaagauagugccuaugaacagccacuacacuccagccugggcaacauagcaaugcacgucucuaauuuuaaaaauaaaauaaaaauauaaugucauuuucuggauuuugugauauuuguagugugaacccagaaaauuugugacaggucucaguuaauuuagaaaguuuauuuuccaagguugaggacguguccccacgacacagccuucggagggccugacaacauauguccaagguggucagaacacaguuugguuuuauacauucuagggagacacgggacaucaaucaacauauggaaaaugaacaucgguuuggucuggaaaggagggacagcucgaagcauggaaugggcuuccaggucacaggaagaugagacacaaacaggggcauucuuuugaguuucuguuuagccuuuucaaaggaggcaaucagauacgcauuuaucuuagugagcagagggaugacuuugaauagaaugggaagcagguuugcccuaaacaguucccagcuugaauuuucccuuuggcuuugugauuuugggggccgagaucuuuuccuuucacauuuucuccacccuuuaaaaaaaaucuucuggagaaagcauuuuagaagaaaaugagucucuggucccagcuuuuuucuaaucucucuugguuaggaugguucguuccuagacagguagguccuaaguuauuagcaaagcucauuuuuagaagguugugaagucucauguccuaugcagagaaauuagggggaggaagggauacaaacaacaauaaacaaaagaaaaauccuggaaaauugauauaggccacauuacucuguaguccauacaucaguaggcagguaugaaagcgguuuauguauguaaauagguugcuguuauuuucuucugaaguuuaaguugucuagcuucaguuugcagagcuuuacgaaagcacaacuuaguuuuuuagugacuccaaauuaggaaaaauggggaaaaaagaaggaaaacaauugaaaacauuauuuugaagacuuguagccaacaaaaauuagaauucaguccaaacuguagaaaacaauaaaaauugcaaaacauuaggcaagacuaaaaucuaacaauagguguacuacacuuuuugaaacaaucuuuucucucuccaguuucccauuuuuacuaaagacaaauuaugguaggacuuguuugcuuuauuauacuuggccuaauuauuuguauacagagcagcaagaauauauauauauuuuuugagauggagucucacucugcugcccaggcuggagugcaguggcgugaucucagcucacugcaaccuccaccuccuggguucaagugauucuccugccucagcuucccaaguagcugggauuacagguaugugcuuucacacccagcuaauuuuuauauuuuuaguagagaugggauuucaccauguuggccaggcugguaagaauaauuauuuuuuacauaggcuuuuaaauuggcuuugaugaaacuguguucuguagaaagaaucucagauaagacuucuuuaaagcugagcccagccguggauuugugcuaucaaauaccuaugaauugaguuaaccucuccucuugagguuccaagguaaacuuggggcuccugggccugucagaaagugacauucuuuaccuaccacagaucaggaacccuguacaggggcuguguagauaaagguaagaggccaauuuuuccaaggggcuaucuugguuccagaagucaaguuugauuccaagggaaagcacaccauuccagucaaagucuugauaaaauaaccaguuucuccaauuguguccuguuacaaauggaaacagauucuuacugcacuuacguaaauagcuguauuguuauaaguuacaaauacucacaaauaauuuccaaauucuggagaaauuaggcagagagacacaaauaugccccaaguuuuguucaugggaguauacuuuagucaauugcuaaaagcuguaaauagcuuaaaagaaaaguuuucuugacucugaaaaacaaaaaaaaggaucagcaacguuuuaagcaaaaaguuaaaaauauuacuuuagucuucuaucaguuuaguuuaugcaguuaauccuguucugcuugauauucgugaacacuucagcucuccaugagaguccugaaaguuuuuuccucuauucuaagguuacaaucuccaaaguuaucagaaaccugcauuuaagaacaccuguuagaguucuauagcugauuauaaaaccaccuucuaaggaggaccaaaacaagacaacaauugucuguggaugaugaaagguuuuagggcagccauaaagaaacaauugacaaggaaauuuguuaucucuguggcauaugauaauuuaacauaacaauuauaauuauuacugauaauguacacuaagucauaccaaaauuacaggaguuucccaugauuuuggaacacauaccaguaacauauuuauacaaauacagcccaaagaaaaccaaacaccauuucauauuugacuaugcuuccuguauaauuuuuauaccaaauaagccaaauaugucauuuucggacucuagggaaccuauuaauaauaccuuuuuuuuuuuuuuuuugagagggagucucauucugucgccaagcuggagugcaguggugcaaucuuggcucacggcaaccucugccccucagguucaagugauucuccugccucagccucacgaguagcugggacuacaggcaugcgccaccacacccagcuaauuuuuguauuuuuaguaaagaugggguuucaccacguuggccaggauggucucgaucuuuugaccucaugauccgcuggccuuggcuucccaaagugcugggauuacaggugugagccacugugccaggcccaacaauaucuuaaaggauuaauuaggucagaaaaagacauaauuuauaguuugauuuuggaaaguuugucaaauaucaaagguuuaaaacacuugauaucacaaaauagaauuaauaggucauugugaaauaaguuauucauuuaaccaaagugauaacucaaggauuuccccaaaaaaggugaaaaccuucauucuuugagagaggagacuuaauuuuccaaacaauaagcccuaauaaaaacagcaugaagccaauuaaauucauuuuucaaaauuuuauaaacaaucuauaacauuuuaaucuugaccauaagauauaacuuucauaagccuuucauaaccuuuauaaccuuuaggaguugguuaaugcuucaagaaaaccuuguuaaucugacacaggggcccauaugcuggucuugcaucagugugccuuugacauuaaugauuaacauguagagaaacagaacuuguuuuaucucuuaaaauuggcccucacaaucucacaugcccaucucuucugugauagucccugggccuugaggaguuuaauagcuuuaauuucuggcccuguguuucaggaauacaguuuauuuugauuggcaucuucuaccaggccugaagauggggggcuuuaauggcugucaguguuuaaaaaauuagcaggacuuugauguccuuuuuagaccaaggcaucaaagcccuguaacucaaugucacaaguacuuuaaaagagcauaaagagugugaaaggaaauaucuugggcccccaaaaucacuaaggaaaucucaagcuggaaacugcuuagggcaaaccugccuuccauucuauuuagucacuccucugcucacugagauagauacauaucuaauuugccuccuuuggaaaggcuaaucagaaacucaaaagaauguaaccguuuguuuacuaucuauuugugaccuggaagcucccuccccacuuagagucuuccugccuuuguuuuaaguuguuccaccuuuccagacugaaccaauguacuucuuacauauauugauugaugucucaugucucccuaaauguauaaaaccaagcuguucccugaccacuuuggguacaugucaucaggacuuccugaggcugugucaugggcucguccucaaacuuggcaaaauaaacuuucuaaauuaacugagaccugucugagauuuucuggguucacaagagagauacacagauguaguaaccuuaauuuaaaaaaaguuuuaaucuuuuuuuccuaagcaaaccaaaacuuaauaauaauaugacaacuugaucauauaaaaguuuuugguuuuguuuguuuuauaaauccgcuuauugugacuuacauagaccuuuugugacaugcuuggacuuuccaguuugucuugaacaucccuccuucuuaaauaaccagucaugucauuuuacucuaggacuaaauuuaccacacaauauucuuuuucauaugaaauuauuucucuuuaagcuuucuuacaaaaaaaaucuuuauuuuuauaacuuucuuuacaucucuuuuauuuccugguuccuuuuaccuuguuuuauacaugaucuuuaaauaagcuuugaauuagacaaaaauuuuucacuuuuuuuuaaaggacacacuuuuuuuuuuagaaagaacguuuuccuacaauuauauuuuuauuagaaaauacccaaauaaugaaauaucuauuaucuaauuuaauauaacuuuagauucuaaauuaugaugaaugugucuacaaguauuuauucuauuacauuuaccuaauuauuuuauuuucauuguuuaccuagauuauuuaugaaaacugugauagucaucauuuaaaauuauggaaccaccauugcaaaauuauaacugagacagugaaaaagauuuaacuuaacuggccccaucuugcuuuuaaccuucaaacuguccuuguucauuccugggcauaggccaaacaaauuuugagaggaacuuaguuuauaguuuagcuuugaaacaaagacgauaacaaaccuuacuuccuguggacuagaccaccuaaagccacaaaauuaaaguuaugguaaucuuacuaaauuuaagguuuagcuauuuuuauuaaaccaauaucaaugucuuauuuauuaaagauuacacaagcagagaucauucuguuuuggucugaguuuauaguuuucuaaucccuaugccaaauuuugacaccuuauaguguuuggcaguaauaaguaugaaauugcuugauuaauaaaugcaaacaaaaauguaugcuggcaauucuuaagacauuucuaauauuacuuuaccaauaauuuuaaagcuagcuuauuuauuaaauauuuuacuuaaguuacaugaacuugaaaaaggauuugacuagucuuccuuuuucugauaaaguauuugaugauuuaagugcuuuucuuuuucuuuaagccaauuaauuagagcucuuuuauauauuuucaguagugaaacauuguguacacaacacauaaaugcauugacauauuagucaugccaauagaaguacaucuuauagauucauaaagaccuuuuuucuuuccuaucuuagacuuccagauucuugauaaccuguuucacaacacuaggcaguucucagcuaaauagccuuaaauuuucauauuaaaggaaacaacucaggugaaaagucaaauagcaaaauuuacaccauaagguacaaagagaaaaagucugaugguucuagagggagauugaagauggaugucaaaucaaacacaaaauuacagaaaucuaucauaggauuguauaaggagacaaauuuuauuuagauagggacuaccuaucuuuuuuuuugagacggaguuuugcucuuguugcccaggcugaagugcaauggugcgaucuaggcucacugcaaccuccuccucccagguucaagugauucuccugccucagcccccugaguaguugggauuacagacaugugccaccacacccagcuaauuuuuguauuuuuaguagagacacgguuucaccauguuggccaggcuggucuugaacuccugaccucacgugauccacacaccuugaccucccaaaguguugggauuacaggcgugaaccaccacacccggccugggacuaccugucuuuuaacuggaucucugagcucugggaggagcccacacugaauccugggucuccaaaaagggagaauuauuuugagguuaaaccaugugaugcuuuuauagugcacuuaaaaauuuuguuguuguuguuuuuuguuuuuuaauaaagacauuucuaagugucuaagcuacauucuuccuuaaaaaucccagaguggccucuguugcaauagcuauuaaugaagaaaacagaauucagucaacugagaagaaaaaacuugcaaaaaaaaaaaaaaaaaaaaaaaagacaagguuuugggugagaaaaaaacaaaacaaaaacaugaaggccuuuuaaauacaaacacaccuuggauguuagcuuuuaauuaagcugacuuuuaaccauugagcucauuuuaaaaaaucuuuuaaaaucucauuacuauauuucaucuaggacaaauugcugcuauuucagaaguaccaaguaucaaaccagaaaggguuugauuuaggaaccaaaccuaggcuguugugauagggaaaaaaagaaggcagaacuuuagcuauugaacuacagggugaggugacagccauugcuuucaguuggcagcuagcaaaaagguggccuuguuaugaaaauaaagccccuuuaguaaucaaaauaaaaaaauguucccuucucuuuuuuuuuucuuuugcuggccauuuuucuccuacaccacccuuuuuugugugugggaauuuaaccacuucagaggacuuauuccccauaauuuggaacuuuccuuuggauuugaucaaguuggauagaauugaugaaacccaacaggaaaaagacugaaacaacaauaaaaacagaaauaaacaauggcacaacuuauaugaucacugagcacucuaaugguaagcagaaauuaaaaccagcuuuuuguuaacuuuagccaagacaaaaccucaauucagcuacauaccuagggaugggucucaggcugaaaacaacucucuaccauccuagaagcaggaaaaacaaacaaacaaacaaacaaacaaaaaacaaaacaaaaaaaaaccucauuuucccuauuggaagugagcucaaacuccauaaaggaguuaccugcuuuccaucgucauggaagcagaaaaacuugccuuucuuguugaaagcaaguaaaacuccaaaaaaaaaaaaaaaaaaaaaaaaaaagaggggauguacagcaaaauaagcuuuagaucuugaccaaauuuugggacaucagggauucucuggaggggauauucccagaccucagcaaauuguccuguugguuugagccauaaaguuagcucaugcugguaccaggcacugauaggagauuugucaaaggucaggggcaucuccauugagaauccuuuugugguuaacaaaauguaaacccagaaaauuugagacaggucucaguuaauuuguaaaguuuauuuugccaagguugagggcgcguacccaagacacagccucaggagguccugacgacauguguccaggauggucagagcacaguuugguuuuauacauucuagggauacgugagacaucaaucaacauauguaaaaugaacaucgguuuggucuggaaaggagggacaacucgaagcagggagggggcuuccaagucacagguaggugagagaaaaacagcugcauucuuuugaguuucuguuuagccuuuucaaagaggcaaccagauaugcauuuaucuuaaugaggagagguaugacuuugaauagaaugggaggcagguuugcccuaaacaguucccagcuugaauuuucccuuuagcuuagugauuuugggggcccaaaauguuuccuuucacaguagcaacuauuagauuuaaaaaaauuguaauuuccuauuuacuuuuuucuuguaauuaacuucuugcuuuacuuuugagacagggucuugcuccgucucccaggcuggagugcaguggugugaucacagaucccugcagccuccaccuucagggcucaaguucuccuccugccucagccucuugaguagcagggacuguaggagugcacuccauggccagcuaauuuuuuuuucauuuuuuuaguagagcugagaucugauuauguugcucuuggucucaaacuccuugccucaauaaauccuccugccuuggccucccaaaaugcugggauuacaggugugagccucugugcccagcuuuguuuuauuuuuguaccuaauauuuacucauaguuuuauauucuuuuuauuaaaaagaguucccuagccuuucagaaggaacugccgucuuccaguuauucuccaaaaugaggaacacuaagggaaagaggagggacaccaauauauguucucuaggccuuuuagaaaacauggaguuguuccuuuggccacaaccaugcaaaucuacaagaaagguuauguugcagacaucaagggaaugggaacuguucaaaaaugccccacacauguuaucaugguauuagggacugaaaugggauauaaguugaaaagagacuaagggauuuuugaaauuaaauguuaggcaauuuuuaaaaauaaaagagggccaauaagcccaggccuuacaccugcacuguggugaggugcucaagauugcagaggcaaaccugugcaaagcuucugccaacucaaggcauucacugaaugccccacacauguuaccacggcaaaacuggaagagccuaucaacaguguucuuggacacaaacaaauuaaaggcaagauucuugcugagagaauuaauguguuuauugagcauauuaagcagucuaagggccaagauaacuuccugaagcauguaaaggaaaaggaucagaaaaagaaggaagcaaaagagaaaaguaccugaagugccagccuucuccacuuugugaagcucacuuugugagaaccaauggaaagaagccuaaguugcuuggaaccuauucccuacgaauucauagcauaauagccguuaaaaaauaaaagggggggagcccccuaaauugaauagacuucaggcccuacaauauccagaucuacuucugaugauguuuuauuucauaagcugggcaguaagucaugcugaguauucuuuaaaugauucucuauauuauuugguuuacuccaaacagaaaauagcaaaacauuuugucuaagaggcauuucuuuaucuguccuuguccugauguuggaugccuaugacuucaccgauugcuguaagcccuugaguuggcagaagcuuugcacagcuuugcccccugccauccugagcaccucaccacagugcaggcguaaggccugggcuuauuggcccucuuuuauuuaaaaaaauuucccaacauuuaauugcaaaaaucccuuaguuucauuucuacuuuacucuauuucaguccccaaugccaaguucguucuuuuuguaaguaucuucugaaggagugacucaccauuuacuucuauuggaauccaaauuuugcaauacucacgaaguugcaaauaauuaaauuaggauaucuuagaaucucauaaccagggagagauuacuguaaacucaaccauauucaccacuauuuauugcaugucugcuucaugcaaaccuugguuccaugugcugggggaacacaaauguagagcuuauuucugucccugagcugaugagauaagaaguugccuagaggccgggggcaguggcuuacgccuguaaucccagcacuuugggaggccgaggcgggcggaucacgaggucaagagauagagaccauccuggcuaacauggugaaaccccgucucuacuaaaaauacaaaaaaaauuagccgggggugguagccggugccuguagucccagcuacucuggagacugaggcaggagaauggcgugaaccugggaggcggagcuugcagugggccgagaucacgccacugcacuccagccuggacgacagagugagacuccgucucaaaaaaaaaaaaaagaaaagaaaaaagaaauugccuaacuaaguuauaagucaaaccgcugugacugcuguacagaaaaggcaaauauaguguaugggagcaagagaagugaaugauugauuaggauaggugaaagcugcagagaggagauauauuuaaguuggaccuuaaacacaauaaaagauuucuucagcugaaaaaaaauuccauuuauguuagaaaguuuuuaaaaaagugaauauggcaauuuauaaaaaauuuucauuuugaaauguuacgcuucuugauuuuccaugacagaaaguguguguacacacguguuuguguguaugucugcauguguacuuccauugcauuuuaaucugaacauuuucaaacauuuguaauaguuuaaagaauuuuacaggcugagugugguggcucacacuuguaaucucagcacuuugggaggccaaggccagcauacgacuugaggccaggaauucgagaccagccugguuaacauggugaaaccccaucucuacugaaaauacaaaaauuagccagaugugguggcaggcaccuguggguccagcuauucaggaggcugaggcaggagaauugcuugggcccgggagguggaguuugcagugagccgcuaucacaccacugcacuccagccugagugacagagugagucucugucaaaaaaaaaaaaaaaagaauuuuaaaauaaauauccauauauccauaaccuagauucuacauuaacauuuuacuauaccaguuuuaucacauauauaaaacaaauauagugaaaugccuguuuuacuuccuucuaucaaucuacuuuauuuuauuaacauacuucaaacuaaauuacagacaucgguacccuuccccuuuaaaaacuucagcauguauauauaucauucauuaacuagaguucaauauuuauuuaguuuuuuuuccuuuggauguaaaauuuguauacagugaaaggcacaagucuuaaguauauauuugcuguuuugacaaaggcauagacucauguaacccaaaguccuguugagagauagaacauuuccaucaccucagaaagccacucaguggagguguguuuuugaaguauauguguacacagaucccagccauuguagacuaauggagugauuagagguaaacagaauuaagcugggagaagguaaaguuucuaaggacagaaggauuaguagauggccagcauccuaggcccugagaggauauuaauaacuugcuguggacaguaagcagguuagcuuggcuacagcugagugaaaggcaugggauacuaaguaaaacauuacuguccucuaauccuuuucaauacuacauacaccaggguuauccuuuaggccuacauucuggagggcagugguucccaaacgggggugauuuugccccauagugaacagcuggcaaugccaggagacauuuuugguugucacaaggggauaguagugcuccaggcaucucaguggguagaggccagggaugcugguaaaaauccuccuuuacucggaacagccacucacaggaaagaauuauaaggcucaaaaugucaauaggcugggcgugguggcucacaccuauaaucccagcacuuugagagaccaagguggaaggaucacacgagccuaggaauucacgaccagcaugggcaacacagugagacccugucucuauuuuuuuuuaaaugucaauagugccugcugugaauuaagaguaaggguugcugaucccuugaaaaaucaacggaaguuacauacuagcagcaaaaauucuuuuucuuugagaaagacaguguguuuauuuuagcuuuuaaaaucaagaaaaaggaacaacaagucauuauuauugguuaaaacaaauacaaaaaaaugugcuuccauuuugguuugcuguuuggggucagggcaugggaagaggcagcaaguuccucauggcuggaaaaggaaauaacuguggugcuguacgggcuccuuagggaaguugggcagggcuugcaguagaaagauggaaucugucaucucccaccugucucaucuggcuuccaaaauaugugauuugaagaauagggaagaggagaaggaggaagggaggaagagaaagagaaguuuacaguuuucccucucacucuauuuuguaagaggcuccauucuuaguaggguauccaggacagggauaaccaggagaccaguacaguaugagcugcuagaugauuuaugaccaaaggucaaaucagcaagcagcuucccagcucugcuucauagcaugugaucuccacacaucccugccucaguguuagcccugggaggauggcugauccgggaaccugaccugugauugauucacucacggugaggcuagaagaggauccuucucaaagguguugcaagugaugagugcucugucaucacugaacuucaggccuauuccuacacugguuccucugguguuuucaucucuuucucucugugacuuaugccuauaucugucccagauugaaaaucccuaaagagcagguauccuauuggucccuggcuuuuuugauguugauuacaaugaugaagugggugaugauuauggcuuugcuuaugugccaaagcauguuuaagaaugucucgauaccaguuugagaaauagcuuuauuugugauacugcaaugauuaauuuaacaaagauaaacauguaaguuguugcaaaaugauacgguuuucaacagaaauuaaggccauuggggcagagauaaauugauaaaaguuuauuggaagccaaaugugagaauuuauccaguaagauacaccaacaaaguugggcauguuccaacaucuguuacaaguuggaaugcuuuuauaagacuguuuaggagaaggaagggggacuccucauaucggaguuauccuuuuccauuggaggguacaauacagagguuacaaucauugccuauggaugacagcguacaggcuaaaauguuuuaugcacaagacaaucaguaaaaacaaaucagcagagcuuuaugauuuagaaagaaaacaaugucccuuucaaugucaguauuaaucaguaaccugacaauuaauaaauacauaguuugaggaacucgcaauagaauuugagugccucacgauaagauucuuuacucagagacaggauguaagccaucagucuuaagaccuuuuccaagcaguucauuuggaagccugugaaauguguccugcagguuaucagggucuuuuugcugaaaaguuuauuuauuuuuucuuuucuuuuuuuuagagacagggucuugcucuguugcccaggcuggaguguaguggcaugaucauggcucaaugcagccucaaccuccugggcucaagugauccuccugccucagccucccaaguagcugggaccacaggugugugccaccaggccagcuaauuuuuaguuuuccuuuuuguagagacggggucucacuauguugcccagguuggucuugaacuucuggucucacgugauccuccugccucgguuucccaaagugcaggaauuacagauguaagccacagugcccaaccaaaauuuaauguuuauuuacuuaaguuuuuuauuuauucuguuucuuaauuauuuauucuuuuuuuacagcuguauacuaucuauuauguggcuuuacuauugauggacauuuaggagguuuccaaacuucugcuauaauauacaaugcuauaaugguaaccuuauaaauacauggaagucgaauguuuaggugaaugagugcaugcacagcuuuacuagacauuacaacacuucucucuauggaggcuuuaacaauggacucucccacgagcaaugcaucagcauuauuucuucacaugcuugccaguggaucauacuacaaucuuuuugaccuuuggcaaucugauaagugaaaaguggcucccaguauaauuuuaauuugcaucucucauaugagugagggugaagagccacuuguauuuccuuuuuuguaaacugcuauuucaauuggguuguuauuccuuuucuuacugauuuguaagaguucuuuaucuacuaaaucaauuagucucuugucuucaaagccuguuaugaauauuuccccccaguuucucauuuaucuugccuuguguaugaugguuuuugucaugcucauuuuuuaaguuuuaguuuucaguuuccugucuuacuagaaaggucuuaccacucuaaaaauguguccagugguucuucuuaauacuucagugguuucauuucucauacuuacgucuuugagguauucgaauuuuggaaggaucaaguuugcuuuuucccagcuggauaccuaggugccacaauacuuuguuaauuaaaucaucugucccuuccacugauuugaaauggcauuuucaucauaucuaaaugcccauguguauuugggucuauuucuugccuuuccauucuguucuauugauuugucugccuauucaccuaccuguacuuaguaguaugguuuagcauuuugguacaacuuaucaaugauaugaugguggccuuuggauuauaauauuuaacauuuuauuuuagcaaaguguuuguguauuuucauaauucuagaugccuuaugguccuucuaauaucuucucuccagaggacuguaugcuguucuuaaggacucucugcuuccuggacaagcucaagcuaaggugaguaccaucuucuuaaaugcaaggaucuuagauuugagucaagaagugucugcugggaaugaucugaucacuccuuguucuguuggucagguccauggguuuccccaggggcagaaacugugucuuccuaguauguugcacaauuccuggugcagagaaacacucaguaaauguguguugaggaugaacugaugaaugaggacaugaacaccugccugccacagaagucuuucaugcauggguguuccuggaggcuccucuggcuucacaggaagggacagaacugggaaauuauuccugggguccugucccagcuccuugucuauucuucuguccaagagaggaacacagagcgaggaagggcaaugaaucccacuuacccuucucccaucucacacacauccagaggcacgauccuagcucacuucaaccuugaccucugagcucaagugauccucccuacucagccucccgaguagcuaggauuacaggcacgcaccaccacacccagauaauuuuuuguagagacagggucucacuaaguugccuaagcucagucuugaacuucuggccucaagggaucccccuaccuugggcucuuuaccagcauuuucuuguauuucuccucaucuucaauagcauucaacugaaacaucacccacguucaucaucucucccuuuucuacaccauggccuugaguaaagcaagugagauagcaagggagauacgaaucagaacagcuaaccauaacagcugacucuuauauacuguuuagcauaugccaguuucguuuuccaccaauguaauaauugaacacuuagaacaaguggggauauauauauauauauauauauauauguauaacacauauauauauaaaaccauauauuauauauauaaucauacccauuguacaagugagaaaacugaguuaacagagagguuuaguaacuugcccagggccguggagcuuuuaaauagauucagcgcuagaguccaugcacuuaaacaccauaccuuuccuuguaauaugcaugugcguguguuaacuucauugaaguaaaauauaaaaugcagaaaagugcacaagucgaaagcauacgacucagcagauuuucauaaagugagcacacccauguacuagcacccagaugaaagagcagagcacucucagcccuccaggaguuccagucaucucccuccccagucacugcccccuccucccuaagguuaacugcucuucugacgucucucuccauucuucugggaguuuccuucccauccuauuuuaauccacucauauuuuaagcaucaugggguuuguggcuaaaguuagaaauauucuauauauuccaucuugcaguagagguggcagugguugggagaacacauuuccuagagaagagaaacaauugaggaugggggguuuaggggguacuugcuuuaguuuccccacauucucuuugccaguaaaccuaaguaagcuucaaaccuugacuccauccccuccccaccaggacuacaucucccagcaggcugugcucugacagcucuuggauuuaaauaggauucugggcucugcucagagucaggcugcugcucagcacccaggacggagaggagcagagaagcagcagaagcagccaagagcuggagccagaccaggaaccugagccagagcugggguugaagcuggagcagcagcaaaagcaacagcagcuacagaaguuggaacgaugcuggucaccuugggacugcucaccuccuucuucucguuccuguauaugguagcuccauccaucagguuugucuuaauucagcaacucaaacaaucguuuacaaagaccugcacuggaagccgguucucagcugcugaaagaagagaaagggaaggaggcugacagaggagaaagucagggcaggaaaagcaggaaggaaggggguguuguggauaccaugguggaaaaccagaaggaagcaucugcggccgggcagagguggggcugaguucuggccccaccugagcucuggggagaguucuacugccagcggaaggcugcauggaugacucugucaaguagcucaacaaacaccuuaggugggaguccuugcguuuucauuuuauuccuuugggugucucugaagaacucggagacucugucccuauucaggguggcccugcuggcuugucaugcuguuaaguaccagguaguuugggaaagaaacaaacucuucugccuuugagacuacccucaauuaauguuuugggauggcuuuuuugcugugggauuucuagaggugucaaauaaaaguguguucugaguggagaauuuuuaaauuucucuuuuuuaauuuuugcucugucaccccaggguggagugcauugguguagucauaggucacugcagccuugaacucuugggcucaagcaacccuccugccucagccucccaaguaguugggaauauaggcaggugccacuacacccagcuacuuuuuaaauuuuuuguggagaugggggucucacuauguugcccaggcuggucucaaacuccugggcuuaagcgaccaucccacguuggccucccaagauguugggauuacaggcaugagccacugggcucagccuaaaaaauuucuuaugauaaaggagguuaaauggaccuaccaaggacaguguuauucuagguucuccauagagaucuggguucaagucccacuucugccaccacuaugugacaugaaccucccugagccucaguuuucucuacuguaauguggaaauaauacuggagaaguugagaggauuaaaauaaauuacauauggaaagugccuagacuaguaauuggcagucagaugaugugcaggaaauguuaguucugccccuccguauucuguuuuaggaccugugaagucaacuucauguaaaagagugcucucugcacagaggucugaacaaaggagguuuucucucuguuugccaucggccagaaugaaaucucuaauacaauggcugaaagccucggaaaugacccacucccuaaaacuggagaggcagccuaagaucaguaccuguguaugccaucccccagagugcuaagagcaguaccugugugugccaccccccacagagugcuguucaucaguuacucaugaugaugguuacugaauauugacuccgcuaauguuuaucaugcauauguuuugaauguagguuagaggggaaagcuuuccucuggaaccucuagagauaagagcuagauguauuuauuaucuaacaaggaaagucuccauuggcccugacuccagcauuuacucuguuugcuaauaugauuauuuguggcuucugggcaagugaucuucccaccugcaccgauaaacaggcgacuaccuugccccauggaaaaauguuguccuaugaagguuagcuuuuaugagucuccugacugcaacuuaaagauacccuucuuugaggcuggauagaguuuuuuuuuuuuuuuuuaacguaucuuagugugagcucgugaaggaugguacgugaugcucuuguuucccuugccgauaggaaguucuuugcugguggaguguguagaacaaaugugcagcuuccuggcaagguaguggugaucacuggcgccaacacgggcauuggcaaggagacggccagagagcucgcuagccgagguaaguguuuccccuuuagucuccaaagggccaugccucccacccuucuucccacuggggccucuguccauauugcuuuguguuuccuccuaggcuugggggcucugacuagaaauucaaggaaccugggauucaaguccaacugugacaccaacuuacacuguggccuccaauaaacugcuucuuuccuauucccucucuauuaaauaaaauaaggaaaacgaugucuguguauagccaagucaguuauucuaaaaggagauacuaagugacauuaaauaucagaauguaaaaccugggaaccagguucccagccugggauuaaacugacagcaagaagacugaacaguacuacugugaaaagcccgaaguggcaauauguucacucuaccguugaaggauggcugggagaaugaaugcucugucccccagucccaagcucacuuacuauaccuccuuuauagccuaggauaugaacauacugcucuuuuuuugucuuggacccaggagcccgagucuauauugccugcagagauguacugaagggggagucugcugccagugaaauccgaguggauacaaagaacucccaggugcuggugcggaaauuggaccuauccgacaccaaaucuauccgagccuuugcugagggcuuucuggcaggugagguccugauggguagguagaaaagcaggaaauuggguaugggaguggcugcuccacccuagaccaucuauggcccuuacaucagaaccaucauccaccccacuagacagguucugccacaugaaccagcaggacagggaauuggcaagaggaugguggguagauagacugggcaggauccuuaucaucuuuucgccucagcaaugggaaugucggagguguuagcucccugucugggcuugcaccuuggcaucaagguguggccacaaugccacucucuucuuucauccugagaaucaaccuuguguggccauaggcaugagaugaaguugugcugcuggcaaguucuucuggaucuuggaaaaugaccagcuucuaccacggacuaugaaauccaugagggacauccugggaccaugucuggcuuguguuaccacuggauuccuagugcccagcagagugcaccuggcucagagucgguaguuaguacacauuugcugaauaaaugaaugaacaauguccaggaagauaugaguaacuaaaauuacucauuagaaacccagugacaaugcuuauuggaugucacugagauagguccaaaugaaggauaguuauugagugcugaggcaauaccuuguuuuaaaaggaaggggcagagcaagugacuccuaucaaaauguuaccccaacaaagacaacuaaugaacaaagggaaagggcaauuaugcaggucuguuacaggcagcuaggggacuccuugcuaaccauaggaucucuuugguugugcccuauagaggaaaagcagcuccauauucugaucaacaaugcgggaguaaugauguguccauauuccaagacagcugauggcuuugaaacccaccugggagucaaccaccuggguaaguaucuuugggugacuaaaaaaugagguacacccacuaucuuuucuuuaggaagaugacacuguguaaauguggagaauguccaggggccuucauagagccuaggaauuccaauagacuagacccauuggcuuguuguucacuguaccucuccugaucagucuaaaaaagugagaucuuccuacccauaccauuaagaagccccaaauuucaggaaauaccagggagaagaaugucauucuuggauggggcaguggcaguacaaggcuugccaggcagggccagaccugggguuaugcaggcaucugggcuuggcuggaggggucacaucuacaugauggccaaccaagccauggguugguccacggagguaggcaauccuugagaacuugaguacgaggcagggugggguucagcguucaaggcaaagacuuuagggaggagagcauggagcauguuuucugauccuaagcaaauguuaucuucccugacuguucuauccuucugccuauacacaaguguaccugggucccuaguuaugcgaucauggccagagugggaguuggaagccagcaggugggucaagggcagagguacaaaguaauauaauuaaguaugauugccuuacuuguagucuagcucuggcucuugcuuugaggaauccacaaacucagaccaaacugaccauuagaguuacucauggcaucaaaauugguucacacccagaagauagugagcuaacacugaaguccucuuggcucccacaugcugagccugggcugucauuccacuuucaaucuucccugcuggcucuccucacaggccacuuccuccucaccuaccugcuccuggagcggcuaaaggugucugccccugcacgggugguuaauguguccucgguggcucaccacauuggcaagauucccuuccacgaccuccagagcgagaagcgcuacagcagggguuuugccuauugccacagcaagcuggccaaugugcuuuuuacucgugagcuggccaagaggcuccaagguaagucuggagaaagaggaauagcaaaaaugguccucagaccaaauuagagguccacagcaacuugggaagucaggcugucaaacaugcacgugucaguaauaucucuguggacuaaggagaaugaaauuaugaauggaauaaaaacagagugcuugcccccagggagcuuaaaaucaaauagggguuaagaaccucaaaaaguuaccuuguauuugugucacaucuuaucucuuaucucauuugauuuucacaguagcuuuuugcaacagacagaggcuuuuuguuuuuuuuguuuuuuuuuuuuugagacuugaguuucgcucuugucgcccaggcuggagugcaguagugcgaucuuggcucacugcgaccucugccuccuggguucaagugauucuccugcaucagccucuugaguaguugggauuacaagcacgcaauaucacgccuggcuaauuuuguauuuuuagaagagacgagcuuucaccauguuguccagguuggucucaaacuccugaccucaggugaucuggcagaagaggccuuugguaacagguauuauuacuccuaguuuauagagcagagcugagguccaaggaaauggccagcuaaagaguauauggcaggugagggcaucagaaccggaaugugggugcucagcuuuaaaccuagggugcuuccuucugggugccauuugcugagguccacauggugaucugagcuacagagcugccacugccuggacucagggaguuagggcuggauuucagaccccuggguccaaguucuugcucuaccacaugcuagccgcauguggauguggauguggaugugccccuuuaaccuccccugacuucaucuucucagcuguaaaaucaggucaggcugguucuuauuccuuaaugauucugugcucuccuggagcacugggugagcugcuggcucugacaucugcggaucuagggguccauuuguuacagugaauaagccagaguuugggaacaaugaucuucacuuccagaaugccuacaguagaagaagacgguaaucauaaaaauaaacaauaacuauuacaauaauaauugagagguuuaugugugccauguacuacacaucuuaacucauuuaauacuugcaacauuccugugaggugggugcuauuauuuucccccacucuaaauaugaaaagacaggcacugacagauuaagaaauuugcccaaggaagguuccuagcugagccaggauucaaaugcagacaguccauuccauguuuuuaacuuuacaucagaguucagaccuuggcccugcacccugccagguauaaccuuaggcaauuuacuuaaacuuucugugacuuaguuuucuuuguuguaaauggguaucauaacauaauauucuauuuuacaagccucuuuaagaauuaaaugaaauaauacauuuaaagcauguuguauggcccuggcacauaauugguacugaaaaauagugaccgcaccagggauaucuugugggggggggguguuaaucccccacaaucugcaucaccaucccucaaucuauaccucaugaaaugugcuugccaggcaaaugcagcucaaaauaaaguccuacccaccaccuuccaaucagaucgcuaccccuaaacuccuccuuuagaaaugauaaagauaccacugucaaugauugauacuacucacuacauguugucauguuuauuaguaguacuaaagccacaguauaaaaacgacauugaaauagaaggaccucgaaccaggcacuccuuuuggaacauagaaggcugagaaggcuauagaucuuucugaaagaucaauucauuccuguucaaauuccgccuggccaggagugguaccugcugaauccugggguuauguuuccugagucccuccuucucacuuguguauuuugcugcaggagauaagcuguuuuccugggcucagagugugucccugaucuaauugugcccucuuugucccaggcaccggggucaccaccuacgcagugcacccaggcgucguccgcucugagcugguccggcacuccucccugcucugccugcucuggcggcucuucucccccuuugucaagacggcacgggagggggcgcagaccagccugcacugcgcccuggcugagggccuggagccccugaguggcaaguacuucaggugugugaaggcaaugcgguucucuccaccaccugugugcaugggaggugccggacucgcugggcuguucauccugagaagcugaguuugugccugaugaugcaauccagguuuggguugggccugcaaacagaaugccguugcuuuguuaaggaaacuuacaguacaaacuuauguguugggaagaguugcuuuucuggcuuuauuuuauacucgugugccgcuuuuccaugaaaacuuugcagcuuucugaaagcuuuuaaagaagacugucgcuguugguuaugccauggagaucuggaucguuuuucuccuucuuuaagcuuuuggcucacuugauucaugaauuuuuaaauaccaauuagcacaaagugcuaggggaacguccucucucuucggugugaacucugucccucaaugcugccaagauuggcacuaucuguugaaauauagaaguagaaauuuuagugcugaaucuuaucaugaacucaaugagcaacuagagucugggaguaaagggaagcccagggugaaaucucuuucccauuccaugacagaauccagcccugucugcucuguugucccgcuuuguucaaggcuuuucaucagugcaguauuuauuccgugaagcacuggaaauagucuuagugucugaugagaggggaauggauaagugauaauagcuaauguugcuugaguuuuuauaauguguuugguacucaguucugaguguguaauguguauuaauucauauaaucaucacaacccugcgaggcagguaauauuaccccaaguuuucacaugaaacugaggcgcaagauaauuaagaaacuugcucaaagucauauagcuuauaagugguagaucugggauuuacgcccuggcaaucuggcucuagagcugugccauucaguaugguagccacuagccacauguugcuauugagcacuugaaauauggcuaguccagauugagaugcacuguaaguguacagugcauaccagauuuuugaagacauacagguugagcaucacaaaucugaaaauucggaguccggaauauuucaguaagcauuuccuuugaguugcauguugcugcuaaaaauguuuuggauuucagaguauuucggguuuuagauuuuugggguuugagaugcucagcugguaaguacaaugcaaauauuucauaauucaaauaaauguaaaauccuaaauacuucugaucccaagcauuuuuuuuugagauggauuuucacucuugucacucaggcuggagggcaauggcuugaucuuggcucacugcaacuucagccuccuggguucaagcgauucuccugacucagccuccugaguagcugggauuacaggugcccgccaccacaccugacuaguuuuuguauuuuuagucgagaugggcuuucaccauguuggccaggcuggucuugaacuccugacgucaguugauccaccugccuuggccuccuaaagugcugggauuacaggcgugagccaccgcgcccagccccaagcauuucugauaagggaugcucaaccuauaguauaaaaaaagaaguguaaguuaucucauuuuauauuuuuaaaugagauaaaagauaucucauuuuuuauauugauugcaugcuaaaaugauuuugcuauuuguggguuaaauaaaguacauauuuauuaacucaauaaaugaauguguaauuaaauguuacuaaauaaauuucaccaauuucuuuuuacauuuuaaauguagcugcuagaaaauucaaaaugacauauguggcucacaauuguguuucucaucauauuucuuucuuucuuuuuuuuuuuuuuuuuuuuuuuuggagacauagucucacucuguugcccaggcuggagugcaauggcaugaucuuggcucacugcaaccuccaccuccuggguucaagggauccuccugccucagccucccgaguagcugggauuacaggugcaugccacgacgcccagcuaguuuuuguauuucuaguagagauggaguuuugccauguugaccaggcuggucuugaacuccugaccucaagugauccgcccaccucagccucccaaagugcugggauugcaggcgugagccacugcgccuggucuucccaucauauuucuauuggacaguugcuacucuagagucugaguguuuaacauugcugccuuaaauauguaauaaaauauacagucauuaaauaucauauuuuaauauaauauguaauuaauauaaaaauguuagugauauaauguuguaaggaaaaaacuggaauacaaaacuauaugauuuuuuauacauagagaacagucuggagggauaaccagccacugggcaguagugguuacuuccagggaguuuuagggagagccaagcagagugugaaggaugauuuuuaucuuuuuauucuagguguuuuuuuauuauuuaaaaauuuugccaggugcaguggcucaugcauguaaucccagcacuuugggaggcugagguggguggaucacuugaggucaggaguugagaccagccuggccaacgugguguaaccccaucucuacuaaaaauacaaaaaauuagcugaucauguuggugggugccuguaaucccagccacucaggaggcugaggcaggagaaucacuugaaccugggaggcggaggcugcaguaagccgagaucacuccacugcacuccagccugggcgacagaaugagacucugucucaaaaaaaaaaaaaaaaaaaaaaauuuaaggcuggguguggcggcucaugccuguagucccaguacuuugggaggccaaggcaggaggauugcuugagcucgggaauuccauaccagccuggacaacaaagugagacccccaucucuacuaaaaaucaaaaaauuagcccagcauuguggugcaugccuguagucccagcuacucgggaggcuaaggugggaggauggcuucagccugggaggucaaggcugcaugauagugccacugcacuccagccugggugaugaagugagacccuaucucaaaaaaaaaaaaaaaauccuccucaaacuagauacaguaugaucccgguuuuauguaagagagaaagagagagagagacuauaucucuauuuauauccaaacaaagcaaaaaaaaaaaaaagacuguacagaaagcaacuaaaugauagacuuuucuuuuuuuugagacggaguuucggucuugucgcccaggcuggauuucaguggcgugaucuccacucacugcaaccucugccuccuggguucaagccauucuccugcaucagccucccaaguagcugggauuacgggugcccaccaccacacccggcuaauuguuuuuuguauuuuuaguagaggcaggguuucgccuuguuggccaggcugcucuugaacuccugaccucaggugauccacccaccucagccucccaaaguccugggauuacaggugugagccaccgugcccagccgugauaggcuuuucuucuuuuaucagcacugcauguuccgaauguuuuacaggacuuuuauaauuagaaaaaaggaacauuaaaaacaaaaaacauggggggagcggggagggauagcauuaggagauauaccuaaugcuaaaugacgaguucaugggugcagcacaccaacauggcacauguauacauauguaacaaaccugcacguugugcacauguacccuaaaacuuaaaguauaauaauaauaaaauuaaaaaaaacaaaaaaaaacaugaugagaacuguguucugcucccacccccuaucccucuaguccucagggccccugcucauuccaaagcaaaucuggagggcuuggucugggguucaugguaugcaagugcaucuguccccagaauucaagaggccugugaacuuggaugggaaaauaacuucaucuuuaauuuaaccuccaacugagauuuggcauuuucuucaauuacgaauguaggcacugaacuguaguaguaguagugauaccugugacuuugucaccaauagaauuauaaauauuuuuauaucacauugcaguuguugcagauauccuagaaugucacuucugcucgccacuacuuugaaauccuuugauuauuagaccugguacuagaucuuguuauagaauauauuaauaaauaagccuguguauuacuauaucacaaauuuguuuuuaaaauauuuuuggagugcauuuuguauaauuaguuucuuugagucuggcauauauuguauuuuauucauuuagaaacauucugagaaagggaccauaaagauuuccagacugcuaauucucauuccuggaauuuacugucuuucucugcccuccagugacugcaagaggaccugggugucuccaagggcccgaaauaacaaaacagcugagcgccuauggaaugucagcugugagcuucuaggaauccggugggaguagcugguggaagagcugcagcuuuaucaggcccaauccaugccauaaugaacagggaccaaggagaaggccaacccuaaaggauuguccucuuggccagcuggugcugcgaauccugccugcucugauccucuugacccuucugggaauguuugcacaccugacacucuugugagacuggcuuauggcaugaguuguggacaccuauagaguguucuucucuaagaccuggaaagucagcaacccucugggggcagcaggacugggcagaucccaggcugggcauggggguggcagaagagcccgagaaauugggucaguucccucaucagcaccagaggcucagcugaggcaagaagagcaccaucacugccuauuucuaggggcuauacacuccaacucuugguugaucucuuucuuuuuaaaaauauuugccaccacccuggagucuagaccaacacacaaagauccuggcuaacccuggccuauuuagauuccuuccucucaccuggaccuucccauuucaaucaugcagaugguuucuuuuuguaaagaguuccguuugccuuucaauuuuuagagaaaauaaagacugcauucaucuca

SEQ ID NO: 34846 - RNA, 7710 nt, Homo sapiens
cccgggagaaaucuccucaagccagagccugugcugugaggggcuucgggaccuuggggcagcuccugaguucagacagaguucaggaagggagacaggggcacagagagacagagguucauggacugaggcaaaggcugggccaggcucagcaacccaggccucccgcaggcaggcagaggcugcccuguaacccauggagaccagaccaacagcucugaugagcuccacaguggcugcagcugcgccugcagcuggggcugccuccaggaaggagucuccaggcagauggggccugggggaggaucccacagguauggcuucuccuggagguaggguugggucugggcccuuggggagcaggguaagggccagagguucgcagggaccauggaaggagccagaacaacucagacccagccccgccggcugugggcaagggugggguagccuguggguaaacccagaauccuagaaacacgguggggcggggauggggguugggggcgggcaggcugcagagccaggacaggacagccuagccgauggggaaggaaagaacagagaagcgcccuuagggcuuaacagcacagaggucccuaguggcguugacaagaauguuucugugggaugauggagccugaagccacccacagagaagggaugggagcugggaaaguggagcuagggcucggacucuugcugaaaauuggccauugagggaggagagagggcaaggaaugggggugggggcugggguguggaugcacagugagggagacacuucuccagauggaagagucacgcguggguucguucaaaugcgggugagcggggccugaggacugggaaagggacccgagggaaggaggggagcgugcagcccugccccggcccagcccugcccuggcccagcccugcccccugccccucaggcgugagccccucgcuccagugccgcgugugcggagacagcagcagcgggaagcacuauggcaucuaugccugcaacggcugcagcggcuucuucaagaggagcguacggcggaggcucaucuacaggugagugcggugggcccugcugggcgucugccccugagggguucuggaggggugagggggugcucaggggaagaggggcuugggcaaaaauguccaagcccauggcucagggcaugggagggacacugaccccuggggucuccucuucaccugcaggugccaggugggggcagggaugugccccguggacaaggcccaccgcaaccagugccaggccugccggcugaagaagugccugcaggcggggaugaaccaggacggugaggcgggggcuggcccggggggaggugacaagaaaugggcagcgggacuggcgugucguccugacccuuccugccuccccagccgugcagaacgagcgccagccgcgaagcacagcccagguccaccuggacagcauggaguccaacacugagucccggccggagucccugguggcucccccggccccggcagggcgcagcccacggggccccacacccaugucugcagccagagcccugggccaccacuucauggccagccuuauaacagcugaaaccugugcuaagcuggagccagaggauggugagugggagagcagcugagggcacagcagggcuuggcuucccgggucacagcagggcugcagcgccuugccuugauccucccucccccggggcuccaaguacucccugccaccucccgagaagcaggcgcuaagaucacaaccuccuccuccaacagcugaugagaauauugaugucaccagcaaugacccugaguuccccuccucuccauacuccucuuccucccccugcggccuggacagcauccaugagaccucggcucgccuacucuucauggccgucaagugggccaagaaccugccuguguucuccagccugcccuuccgggaucagguaccuaccggccugccugcuggggagcuaggcugggcuggggucaggcggcccacucgagucaaccagacagggcacacacauccccacgccaguaugaaugcacacagcuuggauggugauggcuggggacacacauaccucugauucagcgauggcuggggugcaucucagggauggugacggugggggugcaugcaucucuggcacagggaugauggucggggugcacaccuaggagaugaugauggcuagggaccuacagggcccagggucuucuuaaguucuggaagacccucaggcccugcagacauucuguggguaacaagugaccugcacacccugaacaggcugaguggcugacucuaggcccccuuggagcacaagugccuacgacuucagggcuugcauuuuaguucaaucucuccagcucugggccaucccucucggcuucuaaugggcaagcagaucuuucaggaaaaccaggaggagaggcaugaggaggguuugaggcccucagccagucugugugcugggguggagcaacucagaagagucaggccacaccacuugaauacacucaacuuaggacacucaugaggcaugucucugaggcugcccaacuuccaauggcucugggcguuccuaaaugucccagcugcagcucuggauggaacccagugucucagaugauaggcagcugagccggauggugccaaaucccagagcucugagccucuggcugaugucaggagagcauucucgggucccaggacagcacuuccauuccuugggugccugagaugguggcagaggcuccagacugagccagagaagcugugugucugccauaacaggcaccccugucugagcacaggugauccugcuggaagaggcguggagugaacucuuucuccucggggccauccaguggucucugccucuggacagcuguccucugcuggcaccgcccgaggccucugcugccgguggugcccagggccggcucacgcuggccagcauggagacgcguguccugcaggaaacuaucucucgguuccgggcauuggcgguggacccccacggaguuugccugcaugaaggccuugguccucuucaagccagguaacugagucucugcccaaaccuugagugggaauucuggugacuuccaucugccucucacucucccuccacuacccccaugugugcagauguguguaggccucuauccuggggggugggaggagaguggugaggcuggacucccuucuccuuggggccacuccugguugacugugaggggacagggcaggcugggagccccugggagacccugagccccagccggagccccugguggcuccucugggccuggcagagcccaccccacagggccccagguccaugucugcagccagaacccugggccaccacuucauggccagccuuauaacagccguaaaccugugcuaagcucacuggugcugcuucuccccagagacgcggggccugaaggauccugagcacguagaggccuugcaggaccagucccaagugaugcugagccagcacagcaaggcccaccaccccagccagcccgugaggugaccugagcaugcgcccacccacucaucugucccugaccucuaaccuuucucugccucucccacacucucccagagcucacugauuagacagcacaagggucucaguucaacagcauacagccaacaucuauggugucccaggcacagugccaggccccgggaguggggaccaagauguacauaagacaaagcuacugccuucuagagacaaccggcagugaccucacugaagacaaaaacugcccuagccagguacugaggguugcaugaaucugcaggagacagagauccccuugcaugggaaacauaaagcagaauugggagggacuuuguggagacagggcuggacuugaaaggaagaagaagucuaaaagaaaacaucauuugcaaagggagagaggggcaagcaugauauguuguuagaacaggagcccacuuugaagguauaacagguuccugccagugagaaauggggagaauaagccagaaaaguacccuaggaccagcccguucaggacuuugaaugccagccaaaggccacgucugacuugggaggcagagggcagcuacugcagguuuccgagcagagggucauacacagggcuggaccucacgcagacuggcauggccauggguccagaggauacuacugggaaggggauggcagcuacugccaccuuccagaugguuccauggaguucugaucuuugggcauggccaggggaagcagaagggagacucuaggaguugaaaugggucagacccgguguuugggugaagguaaggaaugagggaagaggagcucuuugggagaagacauuguuaaaaauauaaaaaggaaagccaggaggaaagacgguuuugagggaagaugauaagguguuuuguaggugcacugagcauccuguagagaugccaagcacauggauggcccuggcuagguuugggggagaguugcugcaggcugaguguggcugcgcgaggguggggcaggagccggugcucugggacuacgcuguuuggcccagcacaggcagaugucauggagccucagcaagguuggaacauuuggccuucaggcaucuacuggcuauuuuagaccauguuaucugcaaucuuuggggcucccggcaguuucuuucugaagaagcaagcuaauaugggcauccuugcaucaccucuaauccaagaaaugauuacaaggagaaaagguaauuuccuuuuaagaaaagccacaguauacaaaguauaugccauauagcacaggaagauuugugcugcuuaugagcauagggagaacgcugcuacuacuaagacuugacuuagcaucugaagagugggauucagagacauucagaaaccagcagccuuucucugccaaguuucuguuggaaccaacucccagagauguccuggcauauugguuaugcgucaaauuucaaaaugcugauuaagauuuccuaugucccuuuuauagcgguucauugccuacuacaagggaauugagcaugaagauagugguuugggguucucuaauccagcauauuauuucaguuuuuaaaaacugcaacacccaggaagaaacacaauuaccaucgcccccugauaugcacacagacaccaaagcgaaguuccacgaaguaauuccuacccuuagcuuuuacaauuuaccugauguuucucuuuucuuuuuuugaaaaggcugauugugacccccugaauuuaauuucagacccacuaggugaggcaauaccugcaguuuggaaaaaacauucuuuaacugacuuuauaguuauuucuucuuccucccacucuaauuuagaucagaaaaacagaagcagggaaggcagaugggagggguauacgacuugcucagugcugcucacuuggcacuagcaagagaaaggaaggccuuagguuggcaaagcaaguccagcagaucacugagugguggggaagucuuccccgaaauucacggugagaggagcaugggacugcccaauguggaguagccuccuugaugcuggguguugacccuggccaucagaccuacccagggaagguuuaguucccccaucugucucuuggggcuucaccauccgucuuuuguguugcggacuccugucuuagcaaauacuuuuuuuuuuuuuuuuuuuuugagacggagucucucucugucacccaggcuggagcgcaguggcgugaucucgguucacugcaagcuccaccuccuggguucacgccauucuccugccucagccucccgaguagcugggacuacaggcgcccaccaccacgcccggcuaauuuuuuguauuuuuaguagagacgggguuucaccgcauuagccaggauggucucgaucuccugaccucguguuccgcccgccucggccucccaaagugcugggauuacaggcgugagccaccacgcucagccagcaaauaguucuuauuuaaaacaauaaauauuuuuuucaaugacuaucucagucaccaaaauuauccuucaacuucaggacauuuucaguaauggcuaucaucauccuaggugguauacagacaggaauuuguauucuuacaaacaauucuuaucuacuaaaaacuaaucauauaauuauaauacuuauauaugagauuaauaauaauauuuucauauacaggugcuccuugacuuaugaugggguuacaucuggauaaacccauuguuaaguugaagcuacuguaaguugaagaugaauuuucauacauaacccaucuuaagucaaggagcauacugaaugcuuaucacuuucacaccaugauaaagucgaaccaucuguauagaguuaauauaaacuucacuuuauaaucuuuacauauaauaaacaauauuuacucauuauuuucauugcacuccuaaacuaaauagaggguggcggcucacaaugggucgagguagguggaggcaacuccucugguuaaugcggcuuuucuuuuuucuuuuuuuuuuuuuuugagacggagucuugcucuguagccgaggcuggagugcaguagcgggaucucggcucacuguaagcuccgccucccggguucaugccauucuccugccucagccucccgaguagcugggacuacaggugcccgccaccacgcccggcuaauuuuuuguauauuuaguagagacgggguuucaccauguuagccaggauggucucgaucuccugaccuugugauccgcccgccucagccucccaaagugcugggauuacgggcgugagccaccacgccuggccugaauguggcuuuuccucgaaauuccuccugacccacucuggggaccucaucucuccucuccuuccuccccucccuuuccugggagggcaccgccccagggacuagugcucagaagcuggucguaaaacugauggcguccucucuccuguucagguuugggaaauugcuccugcuccucccgucuuugagguuuaucacugcggaacgcaucgagcuccucuuuuuccgcaagaccauagggaauacuccaauggagaagcuccuuugugauauguucaaaaacuaguggggguggaggugaaauguuuccaagcacucuggaaaacaaucuacugaaacgaaacauuugccuacucuuugccccagcaauuccucguagguguguguacccagcagaaaugcccaccgaaagauauuguaagaauauucauagcagcuuuauucauaauagccccaaacuguauauugaugguaggaugaauuaacaaguugugguauauucauauaaugaaaaauaauuuaaaaagaaugaauuacggauacauguggcaacacagguaaacuucacagacauaaaaguugaaugaaagaagccaggccgaaguuccauuuaugcagaguucaggaacaggcaagacuaauugacaauaauagaaguuggaauagugguuacuucuggguggugggggauugauacagagggggcucaugggagcccucugguguaccagaaauguugauuuugaucugggcagugguuucacaaauguauucauacguaauaauucauugagcugugcacuuuauuuuguuagaccucaauaaaaaaguaaaaaaaaaaaacaaaaaaaaccagaa

SEQ ID NO: 34847 - RNA, 4383 nt, Homo sapiens
cccgggagaaaucuccucaagccagagccugugcugugaggggcuucgggaccuuggggcagcuccugaguucagacagaguucaggaagggagacaggggcacagagagacagagguucauggacugaggcaaaggcugggccaggcucagcaacccaggccucccgcaggcaggcagaggcugcccuguaacccauggagaccagaccaacagcucugaugagcuccacaguggcugcagcugcgccugcagcuggggcugccuccaggaaggagucuccaggcagauggggccugggggaggaucccacagguauggcuucuccuggagguaggguugggucugggcccuuggggagcaggguaagggccagagguucgcagggaccauggaaggagccagaacaacucagacccagccccgccggcugugggcaagggugggguagccuguggguaaacccagaauccuagaaacacgguggggcggggauggggguugggggcgggcaggcugcagagccaggacaggacagccuagccgauggggaaggaaagaacagagaagcgcccuuagggcuuaacagcacagaggucccuaguggcguugacaagaauguuucugugggaugauggagccugaagccacccacagagaagggaugggagcugggaaaguggagcuagggcucggacucuugcugaaaauuggccauugagggaggagagagggcaaggaaugggggugggggcugggguguggaugcacagugagggagacacuucuccagauggaagagucacgcguggguucguucaaaugcgggugagcggggccugaggacugggaaagggacccgagggaaggaggggagcgugcagcccugccccggcccagcccugcccuggcccagcccugcccccugccccucaggcgugagccccucgcuccagugccgcgugugcggagacagcagcagcgggaagcacuauggcaucuaugccugcaacggcugcagcggcuucuucaagaggagcguacggcggaggcucaucuacaggugagugcggugggcccugcugggcgucugccccugagggguucuggaggggugagggggugcucaggggaagaggggcuugggcaaaaauguccaagcccauggcucagggcaugggagggacacugaccccuggggucuccucuucaccugcaggugccaggugggggcagggaugugccccguggacaaggcccaccgcaaccagugccaggccugccggcugaagaagugccugcaggcggggaugaaccaggacggugaggcgggggcuggcccggggggaggugacaagaaaugggcagcgggacuggcgugucguccugacccuuccugccuccccagccgugcagaacgagcgccagccgcgaagcacagcccagguccaccuggacagcauggaguccaacacugagucccggccggagucccugguggcucccccggccccggcagggcgcagcccacggggccccacacccaugucugcagccagagcccugggccaccacuucauggccagccuuauaacagcugaaaccugugcuaagcuggagccagaggauggugagugggagagcagcugagggcacagcagggcuuggcuucccgggucacagcagggcugcagcgccuugccuugauccucccucccccggggcuccaaguacucccugccaccucccgagaagcaggcgcuaagaucacaaccuccuccuccaacagcugaugagaauauugaugucaccagcaaugacccugaguuccccuccucuccauacuccucuuccucccccugcggccuggacagcauccaugagaccucggcucgccuacucuucauggccgucaagugggccaagaaccugccuguguucuccagccugcccuuccgggaucagguaccuaccggccugccugcuggggagcuaggcugggcuggggucaggcggcccacucgagucaaccagacagggcacacacauccccacgccaguaugaaugcacacagcuuggauggugauggcuggggacacacauaccucugauucagcgauggcuggggugcaucucagggauggugacggugggggugcaugcaucucuggcacagggaugauggucggggugcacaccuaggagaugaugauggcuagggaccuacagggcccagggucuucuuaaguucuggaagacccucaggcccugcagacauucuguggguaacaagugaccugcacacccugaacaggcugaguggcugacucuaggcccccuuggagcacaagugccuacgacuucagggcuugcauuuuaguucaaucucuccagcucugggccaucccucucggcuucuaaugggcaagcagaucuuucaggaaaaccaggaggagaggcaugaggaggguuugaggcccucagccagucugugugcugggguggagcaacucagaagagucaggccacaccacuugaauacacucaacuuaggacacucaugaggcaugucucugaggcugcccaacuuccaauggcucugggcguuccuaaaugucccagcugcagcucuggauggaacccagugucucagaugauaggcagcugagccggauggugccaaaucccagagcucugagccucuggcugaugucaggagagcauucucgggucccaggacagcacuuccauuccuugggugccugagaugguggcagaggcuccagacugagccagagaagcugugugucugccauaacaggcaccccugucugagcacaggugauccugcuggaagaggcguggagugaacucuuucuccucggggccauccaguggucucugccucuggacagcuguccucugcuggcaccgcccgaggccucugcugccgguggugcccagggccggcucacgcuggccagcauggagacgcguguccugcaggaaacuaucucucgguuccgggcauuggcgguggacccccacggaguuugccugcaugaaggccuugguccucuucaagccagguaacugagucucugcccaaaccuugagugggaauucuggugacuuccaucugccucucacucucccuccacuacccccaugugugcagauguguguaggccucuauccuggggggugggaggagaguggugaggcuggacucccuucuccuuggggccacuccugguugacugugaggggacagggcaggcugggagccccugggagacccugagccccagccggagccccugguggcuccucugggccuggcagagcccaccccacagggccccagguccaugucugcagccagaacccugggccaccacuucauggccagccuuauaacagccguaaaccugugcuaagcucacuggugcugcuucuccccagagacgcggggccugaaggauccugagcacguagaggccuugcaggaccagucccaagugaugcugagccagcacagcaaggcccaccaccccagccagcccgugaggugaccugagcaugcgcccacccacucaucugucccugaccucuaaccuuucucugccucucccacacucucccagagcucacugauuagacagcacaagggucucaguucaacagcauacagccaacaucuauggugucccaggcacagugccaggccccgggaguggggaccaagauguacauaagacaaagcuacugccuucuagagacaaccggcagugaccucacugaagacaaaaacugcccuagccagguacugaggguugcaugaaucugcaggagacagagauccccuugcaugggaaacauaaagcagaauugggagggacuuuguggagacagggcuggacuugaaaggaagaagaagucuaaaagaaaacaucauuugcaaagggagagaggggcaagcaugauauguuguuagaacaggagcccacuuugaagguauaacagguuccugccagugagaaauggggagaauaagccagaaaaguacccuaggaccagcccguucaggacuuugaaugccagccaaaggccacgucugacuugggaggcagagggcagcuacugcagguuuccgagcagagggucauacacagggcuggaccucacgcagacuggcauggccauggguccagaggauacuacugggaaggggauggcagcuacugccaccuuccagaugguuccauggaguucugaucuuugggcauggccaggggaagcagaagggagacucuaggaguugaaaugggucagacccgguguuugggugaagguaaggaaugagggaagaggagcucuuug

SEQ ID NO: 34848 - RNA, 11825 nt, Homo sapiens
gagcccgauuuaacggaaacugugggcggugagaaguuccuuaugacacacuaaucccaaccugcugaccggaccacgccuccagcggagggaaccucuagagcuccaggacauucagguaccagguagccccaaggaggagcugccgaccuggcagguaagucaauaccuggggcuugccugggccagggagcccaggacuggggugaggacucaggggagcagggagaccacgucccaagaugccuguaaaacugaaaccaccuggccauucuccagguugagccagaccaauuugauggcagauuuagcaaauaaaaauacaggacacccaguuaaaugugaauuucagaugaacagcaaauacuuuuuuaguauuaaaaaaguucacauuuaggcucacgccuguaaucccagcacuuugggaggccgaggcaggcagaucaccugaggucaggaguucgagaccagccuggccaacauggugaaaccccaucuccacuaaaaauaccaaaaauuagccaggcgugcuggugggcaccuguaguuccagcuacucaggaggcuaaggcaggagaauugcuugaaccugggaggcagagguugcagugagcugagaucgcaccauugcacucuagccugggcgacaagaacaaaacuccaucucaaaaaaaaaaaaaaaaaaaaaguucacauuuaacugggcauucuguauuuaauugguaaucugagauggcagggaacagcaucagcauggugugagggauaggcauuuuuucauuguguacagcuuguaaaucaguauuuuuaaaacucaaaguuaauggcuugggcauauuuagaaaagaguugccgcacggacuugaacccuguauuccuaaaaucuaggaucuuguucugauggucugcacaacuggcuggggguguccagccacugucccucuugccugggcuccccagggcaguucugucagccucuccauuuccauuccuguuccagcaaaacccaacugauagcacagcagcauuucagccugucuaccucugugcccacauaccuggaugucuaccagccagaaagguggcuuagauuugguuccuguggguggauuauggcccccagaacuucccugugcuugcuggggguguggaguggaaagagcaggaaaugggggacccuccgauacucuauggggguccuccaagucucuuugugcaaguuaggguaauaaucaauauggagcuaagaaagagaaggggaacuaugcuuuagaacaggacacugugccaggagcauugcagaaauuauaugguuuucacgacaguucuuuuugguagguacuguuauuauccucaguuugcagaugaggaaacugagacccagaaagguuaaauaacuugcuagggucacacaagucauaacugacaaagccugauucaaacccaggucucccuaaccuuuaagguuucuaugacgccagcucuccuagggaguuugucuucagaugucuuggcucuaggugucaaaaaaagacuuggugucaggcaggcauagguucaagucccaacucugucacuuaccaacugugacuaggugauugaacugaccauggaaccuggucacaugcaggagcaggauggugaaggguucuugaaggcacuuaggcaggacauuuaggcaggagagaaaaccuggaaacagaagagcugucuccaaaaauacccacuggggaagcagguugucaugugggccaugaaugggaccuguucugguaaccaagcauugcuuauguguccauuacauuucauaacacuuccauccuacuuuacagggaacaaccaagacugggguuaaaucucacagccugcaaguggaagagaagaacuugaacccagguccaacuuuugcgccacagcaggcugccucuugguccugacaggaagucacaacuugggucugaguacugaucccuggcuauuuuuuggcuguguuaccuuggacaagucacuuauuccuccucccguuuccuccuauguaaaauggaaauaauaauguugacccugggucugagagaguggauuugaaaguacuuagugcaucacaaagcacagaacacacuuccagucucgugauuauguacuuauguaacuggucaucacccaucuugagaaugaaugcauuggggaaagggccauccacuaggcugcgaaguuucugagggacuccuucgggcuggagaaggauggccacaggagggaggagagauugccuuauccugcagugaucaugucauugagaacagagccagauucuuuuuuuccuggcagggccaacuuguuuuaacaucuaaggacugagcuauuugugucugugcccuuuguccaagcaguguuucccaaaguguagcccaagaaccaucucccucagagccaccaggaagugcuuuaaauugcagguuccuaggccacagccugcaccugcagagucagaaucauggagguugggacccaggcaccugcguuucuaacaaaugccucgggugauucugaugcaauugaaaguuugagauccacaguucugagacaauaacagaaugguuuuucuaaccccugcagcccugacuuccuauccuagggaaggggccggcuggagaggccaggacagagaaagcagaucccuucuuuuuccaaggacucugugucuuccauaggcaacaugucagaagggguaaguacccuguccuccagggcucuccuccacccaccuucccucucuucucucucuucccucucccucccuccuuacuucucuaucuuaugcucugcccgggaauauaggcacacacuucuauaaccccuguguggguccugaccccacaaaaggaggaggcuuaacaaugaccuugggcaaaagaacugaaggucugagcaggcccauuucccuggcuggcucaggcugaugcgguuggcuguuccucuuuuuccuuucucugcccaggugggcacguuccgcaugguaccugaagaggaacaggagcuccgugcccaacuggagcagcucacaaccaaggaccauggaccugucuuuggcccgugcagccagcugccccgccacaccuugcagaaggugagguggcugacagugcggagaggagcagccuagggaggcaacaugaggggaacaugacugcauucucucuccugugaaaaggguccagccucggcacuccagaucauccuggaccugauagacuggccgguucuaagguccuuccugguggucacggcuauggcagcaacuggguugaccagacacccagccaggccagcccaacccaagacuacagcccagagccucggaacuagggcccucuaaacuagacucaauaugagaagcauugguuuggaaauggccccggggaacaaggauccaacugcugccccugcuagacaggcaagagacuugaguuccagaaccagaccuacuuucagcuugcugugugaccuuaggcagauugcuuuccaucucugggucuugccuucuguaucuaugaaagacgguugguggacuagcucagaggugaucagauugugcucuguggaggcugacagagcugucuuagggcugcuggggaggaugagaaguggcugagcugagccugggcacccagcuuccaucucugcuuccuugggcaucucaagggaaaggugcuauuagcuccuucacacuuuacucccccuccuuucccuucccuccucaugcuguccaaggagagagcugccugaggcgcacggaggaguucuccugacccagcagaggggaggaaugugaggcucugggcaggaggcaggcugccaucugccagagagccguguuuuugaaaaaaucagaaucaagccugggaggcagcagagugaaaugauggaaagaggagucccagcuccacuccuuucucucugggugaccuugagcaagaauaucuucaccuuuaugagccucagucugcucaucugagagcuggggauaagaacaccuaccaugauggucuguggcaaagauuaaaaaacacagugcauuuaaaggacuuagcagguugcuaggcaaaggcucagugaguguaggcagucauuuuuagaaacuuuuagacuguuggccauauucugcaaauaugcgaauucucuccacacacaacagucucagguguugccagugcagaugcugccccuggggcagaaaagcaaagcugcggcugcagaccccugggcccccuuggcuggucuagcucuggcaggagacucaucaccuguguguccugccccucacccgcaccuaaguuuaacuucaugcacaccccacccuguucuaggccaaggaugagcugaacgagagagaggagacccgggaggaggcagugcgagagcugcaggagauggugcaggcgcaggcggccucgggggaggagcuggcgguggccguggcggagagggugcaagagaaggacagcggcuucuuccugcgcuucauccgcgcacggaaguucaacgugggccgugccuaugagcugcucagaggugaggccagugcuuggagggacggcccugggaagacgggaggccaugaggaugcuauccgcucucauccuggcacugaacaggccugcuuccauacugugggcaagucaguuucucugagccuccacauccuuaccuguaaaaugggucagcucugauaaugagcgaacgaaugaaugaaugaagugugucaggagcagauuucuggaggucugaguccucucaacucucucccagucuugggauucaaugaguaaaacuuggguaccccauuugggugacgaggggaggaauuuccccuccagacccccaccaugagaaccuaagcuuuggcucuggaaugcugcaggaagguggauagugccucucucagggcaguuaccuaagccucaugugcaguggaacugaagauggugucagaccugggaaugaaccccggggacagaaccgcucuggcacugcuggcuggaugaagacaggaugccucaagaaaucaucggccgguugcgguggcucacgccuguaaucccagcacuuugcgaggccaaggcgggcagaucaucugaagucggggguuugagaccagccugaccaacguggagaaaccccaucucuacuaaaaauacaaaacuagccgggcgugguggcgcaugccuguaaucucagcuacuggggaggcugaagcaggagaaucgcuugaacgcaggaggcagagguugcggugagcugagaucgugccauugcacuccagccugggcaacaagagcaaaacucuaucucaaaaaagaaagaaagaaaaaaaaaaagggggugguucccucaagaaaucgaaucuugggcacugguggacggaaauggggucugagugggcccucugcaggcuaaugauuuuccuuuuccuacuucuuccuucuccaaaugguaauucagggccaugcugugccaagaacuguuuuaggccaagggaugcaguggagacaaaacagacaaguucccugcccugguggaacucauauucuaaugguggaaacaauacauccaauaaauaaaguaaaauuauauaggguuaaauaaugguaaggaauaaggaaagaaauuaaggagguggauauaaagucuugaggggcugaaguuuuagauaaaguggccagggaagucccagugcaaagggaauuuugaagaaaaacccgaaggaaaugagauaucuguggggaagagcagccagggcagaggcaacagcaaagacaaaggccagggguugggaggugcccagaguguuccagagcagugagcaaguugauguggcagucucuuggcagaggugcccagguccucuaggggcucaaauuugguggugcaggccacagagguggggaacugcucaggauggguaaggaugguguuuguggaccguagaggugcugcuggaaucaggagcucuguguccugcuugggguuuggauuuuacuugggagcuucuccucagcccugugcacaccucaccacucagcuuauccugugcccagcugaaaaaucugugucuuguccccauggggaagaaaauaacaaguaaugauuauccucauauuuaagacuaugccucauguuugcccaagcuuaugaugauguuuacaccuugaaucucauuugauugccacaacaauuuggugagauaggccacuaucuagacuaucuagaauagauaggucaauaucgagaucccauuuuuuggagaggaaacauggggcucggauagguugaguagccagcucggucacacauaggaccuggcaggaggucaggucucugagucccacuaggagggaugggguagggaugggauggcucccugaggggguuccucugcucuccuuccuccaggcuaugugaauuuccggcugcaguacccugagcucuuugacagccuguccccagaggcuguccgcugcaccauugaagcuggcuacccugguguccucucuagucgggacaaguauggccgaguggucaugcucuucaacauugagaacuggcaaagucaagaaaucaccuuugaugagguuagugggggcucgccuggcucccacccugugggcuggguucccucccucaacccuggccucuacugggcccucauuccugguucuccaggaggcaaggucuguagagggggaaaggugggcagccaccugccaccuagcccuuuccaggcagggagagaauuccuaggaugugccagggcagcuggaaaacccaguagcuuugcagguggagcuugauggucaauaauacauggcucuuccuggguaucccugccaagugccaaguggggguaacagcugugugccaugagcugggggcugcccugccacaugcuaaaugcugagagcaacagagagaacagggauuaguggacuauaggcuggaagagauucuggaaagcacagguuccaaucuauuuaggagcccgaguucuuugugcucgcaaaauuguguacgcaauuuugcuugucugagccguuaagggggcugccccaaguuggggaauuaggguuugucuugggagaacuuuggcaugcgccacugagccugaaaaagauuccuuuaauuuaaaaaaaaaacugcuacaaacuuauuuuauuuuauuuauuuauuuuugagauggagucucgcucuggucacccaggcuggagugcaguggcaugaucuuagcucacugcaaccuccgccuccuggguucgagcgauccucaagccucagccuuccaaguagcugggauuacagacgcacgccaccaugcccagcuaauguuuguauuuuuaguagagacgggguuucaccauguuggccaggcuggucucaaacuccugagcucaagugauccgcccaccucggccucccaaagugcugggauuacaggcauaagacaccgcaccuggcccaaacuaauuuuagauaaugcuaucuaguugugccaacacaauuuauuaaaaaguccaucuuuuuucaaugacuugaaaugccaucuuuaucauguuuuauauuuucguaugugcuuggucuauuucuggacuuucuauucuguuccauuggucucuuuaucuauucauacuccaauaucauacuguuucgaugauagagauuuuguggcauguuuaaucuguuagggcuaguuuuguccuuagugaucugcuuuuuggggggcuuuucuagcuacuuuugcauguuuauuucccccuaugaucuucagaauuaauuugucuagcuuuaggagaaauauuaggaguauguuuuggggauaauauuaaacauaaauaacaagcuuggggagagcuggcuucuuucagaaugucacauuccuggccaguuguccuauccacaaaugugagaugccuucuguuuucuucaagccuacuuuugaguuuucaggaguguuuuaaagauuucuucauaagcuaugacugugcuacugcacuucaucuggggggacagagagagacucugcuucugaaaaauaaaaagguuuuaaaaauuuuuuccucacaacguugugcacauuuuucauuaaauuugucuuagguauuaauuuuguugucauugcuaaaaauggggcucuuucuuccauuauaucuucuaguugguuauuguuuguauaaaugaagguuauuguuuuuguuuuuuaauuguauaucccccuauuuuacugaacucuuuuaaaauuuauguuaguuuuauaauggauucucugggguuuucuaaguauacuauaauacuaucuguaaguagaggagauaguuuuucuucucccuuuccacuucuuaugccccugauuuuuuuuuuuuuaacaaauugauugcauugguuaguacuuucaauauagaauuaaaugguggcagagauggugaagucuuuaucuaauuccugaucuuaguaaggaugccucuaggguuuucccaucaaauaagacacuggcuguaggacugaaaugcacaccugccuaucuguguguauuaaggaagagacuuaaauauauguuuuuucuuauuacguaagugauaucuacucauuuuagaaaauacaaaaaauuggcugggcgcaguggcucaugccuguaaucccagcacuuugggaggccaagguggguggauugccugaagucaggaguucgaguccagccuggccaacauggugaaacccugucugucucuacuaaaaauacaaaaauuagccaggcaugguggcaggcaccuguaaucccagcuacuugggagacugaggcaggggaaucgcuugaaccugugaggcagagguugcagugagccaagaucgcaccacugcacuccagccugggugacagagcaagacuccaucucaaaaaaaaaauuacagacaaauuuaaaaucauuugcaauucuacuaccuagagagcucuacuauugacauccuuccaaucuuuucauacauguaugcacgcacauacacacacacacacacgcgcacacacacacacauuuuucuuuuuuuuuuuuuuuuugagacacaguuuugcucuugucgccuagguuggagagcaguggcgugaucucggcucacugcaaccucugccucucaaguucaagugauucuccugccucagccucccaaaguagcugggauuacaggugccugccaccaugcucagcugauuuuuuuguauuuuuaguugagaugggguuucaccauguuggccaggcuggucuugaauucuugaccucaggugauccaccugccucggccucccaaagugcugggauuauaggcgugagccaccgcacccagcccacacauuuuucuuacaauaaugggauuauauucuacaauaauauaucaugcacauuuuccuguauuauuagucuucuguauuguuuuuaauuguuccagaguauuccauggcauaaauguaccauaauuucaccaguucccauuguuggacauuuagguugucuccaauguucccacuauugcaagaguacugggauaaaccuucuggccucuaagcauggaugugacauuugaacuuguuuucuugguauacauucacagaaguggaauguccgagaucaaagccugcagcaaauuaccccagugaagaauguaccaauuagcucuccccucaggaccucaagccuuaauuauuguugcggguuagaucuuacagccuguucucucugugcccaagaucuugcaggcauauugcuucauccuggagaagcugcuggagaaugaggaaacucaaaucaauggcuucugcaucauugagaacuucaagggcuuuaccaugcagcaggcugcuagucuccggacuucagaucucaggaagaugguggacaugcuccaggugaggcuuagaguucugucgcacggcagccucccacagcuggggaggcugagaggcugggccuccuuucauggugcuugcagggaacugagaaguuggaccaccucgcgccauaaagagcagugacagccacagucccaaccauaagcaccugcauagugauugacaguuugccaaguauucccuuucauucuuccaucgacuccuugagagcauucucucccuccuucccugcuucauuuuucaaaccuggaaacgaaggcucagagauuuaagagacaucucgaggucacacagcaauaaagcggcagaggccagacuugaaccugcaucuucugaccuggaaucccauguugucuguccacauaugucgcacugccucucuuugaauguggauucaccccgagaaagggauuaucacuaacccucugauaacucacuccuauaugugcugacaugucaggaguccuuucuuagagccaucuuagaucugcucuguguauugggaaaggaggggugggagguggagguugugggaggggcugauggacaaugagggaugauaauacuguuccugucguuuguaauaguuugcagucccuucggcaggcaaguggguuugaaaaaacucaccaaaaggucaagcaaggcuacuuucauuucuuuuccuaauucccaguuuaauuugcaucagcagggagaggguugggucuuaugaaucuuggggcuuccuccgugcagucugggccacagugagccagggaucccuaguugcuggccuggaaauaggaccuucagugggcccuucuccagggcagcccugugaugcuggacaagucuguucuaugccaugaggagaggcagcagggaaugagugggagccucugaggucacuggggccauggggaacgggguaucucucugucaccgcaggauuccuucccagcccgguucaaagccauccacuucauccaccagccaugguacuucaccacgaccuacaauguggucaagcccuucuugaagagcaagcugcuugagagggugaguacgugggccgcccagacaaugagacaagagggcugaggguggggccucaccugagcccuccucacacucuaccaugguccugagcuauguggaucccacugacacccaacauggagaccugcggagagaggugucgccaggcaaagacugcacaugauggggcuuuguccuccugccccuuuccucccucaacccucauccuuagggcaccuccuccugcucaguucugucucccuugcuucccugcaggucuuuguccacggggaugaccuuucugguuucuaccaggagaucgaugagaacauccugcccucugacuucgggggcacgcugcccaaguaugauggcaaggccguugcugagcagcucuuuggcccccaggcccaagcugagaacacagccuucugaaaacaucuccugccagcugaacuguaguuagaaucucugggccucuccucaacuguccuggacccaaggcuaggaaagggcugcuugagaugacugugguccccccuuagacucccuaagcccgagugagcucaggugucacccuguucucaaguugggggauggguaauaaaggagggggaauucccuugaacaagaagaacuggggauaguuauauuuccaccugcccuugaagcuuuaagacagugauuuuuguguaagguuguauuucaaagacucgaauucauuuucucagucauuuccuuuguaacagaguuuuacgacuuagagucugugaaaacaggcaaggagcccggguuaaaauaucccccuauucgcccccaaaaugcaauaaaagaagauaaaagagagaggaua

SEQ ID NO: 34849 - RNA, 26636 nt, Homo sapiens
gauuuccgcccaauggagggcggucugagcuucgcucacgaaaggagccgggaggcgcuggcggcuccaagagucucugugucccuggcagcggaccucaucuucccucacgccggagccccgaucucugcgccccggcccgacccagcugcgcucuguccgucuaagacgcgcggaaacuacaacucccagagcucaucucgccgagauccggccccacgagucagguggcggaggucaggugacagcggacccgccucucccaaagucuagccgggcaggggaacgcggugcauuccugaccggcaccuggcgaggcucaugcgucccgugagggcgguuccucgagccugggggcgcucaggugagagcggacgcggccuccccuguuucccaggcggaccccuugaggcacagcaggucagcggggcagccugccggggguccagcgcccucagccgcggcgggcuccuuuccccgccaccagugcuggccucgcgacacgggacaacccccggguggaagggcccgagcgguggucagccgaggcaggggcagcgggcugccggggugggugccguucccagccccuuaccuucugcucaguugccgccugggucucgguuggggaauuugcagauugcuuuggagacgcugagagaaccuuugcgagagcgccgguugacgugcggagugcggggcuccgggggacugagcagcacgagaccccauccuccccuccggguuuucacacugggcgaagggaggacuccugagcucugccucuuccaguaacauugaggauuacuguguuuugugagagcucgcuaggcgcccuaagcaacagagguaaccacuuuauauccuuguuucucaaccucguuauuccuaccuacccccuucccauaaaauuuaauaccacuaguacgcuguguauuuguuucuguggccacaaaccauuguaauagcuagauuucuucacuaccaccccaagccaauuuuuuuuuuuuuuuugagauggagucugcagccucugucacccaggcuggagugcaguggcgcgaucucggcucacugcaaccuccgccuccgggguucaagcgauucuccuaccucagccuuccgaguagcugggacuacaggccugagccaccaugcccagcuaauuuuuguauuuuuaguagagauggggauucaccauguuggccaggcuggucucgaacuccugaccucaggugaugcgcucaccucggccucccaaagugcugggaugacaggcgugagccaccgcgcccagccuacccccagccaauuuuagucccacuugacaaugcgugcuuuacaucuccucauuuaaguccugugagguaguuaccaccuccuuguuuggcaccacaaggucgcauaaguaauaaauaggucaagccugucuccagugcacacagcccuugccacuauuuguguacccucuccaaaagcaggagacccagggaguuccaggucguagaacagaggacaggaccaacucauaccuggcagacaggagcugccacacuagaccccuagccccagguugcuccugggaagggacugaaugggugaggagccuucuugaaacaugugacaucugaaugaggccuggacaauaguuagaacuuacauaggaagggcacgccagacagagcccauugucaggagauacuucauuucuaucuuguagcuuucacaagccacuaguuguauguaauuaucaaucugguuuuuuuuuuguuuuuuuuuuuuaauuugagacggaguuucacucuuaucacucaggcuggagugcaauggugcaaucucggcucacugcaaccuccaccucccggguucaagcgauucuccugccucagccuccugaguagcugggacuacaggcacaugccaccacgccuggcuaauuuuuguauuuuuaguagagacggggauucaccauguuggccaggcuggucucgaacuccugacuucaagugauccaacugccucggccucccaaagugcuggaauuacacacacgagccacugcgcucagccuaaucugauguuuuuuaacauuuuaauugacuuaccucucaaugucguuuugucucugcuggcaucguuccuccaggggucucagccuuugaggcuugggaauguuugcugaccaagucugugaguuugagaagcugguuaggccugauucugcaucuaauuucuggagaaaaaccagacucuguccugggcaacaaacugaauccugaacuugaggccacagggcaggugugaggagcggagggcagcaagagugagagggaggccuguggucauuccauacacgcaggagggcaauuccuccaaggucaggggacagagcacagggauccagcgccaagagcaaggcccccagaggaggccagagaguagguacggggucauucccggccggugagaagggucucagaugaggcagaccugcagcaggcaaagagagaacccuggaggagacgggccaacagaggucagacagcuggagcagccagggagacuucuugaggaguguguaagggagauguccggagaugcuggaggccuuggggaaacugaaaucagagugggaacagggaugucuccacacagaccuuacccagagcuccccacagucugcaggaggcccgugagacuguguacugaggcagcacggagaccaagcuacagaaauccaugccggccuggcugcucuugacccacuguucaccugcugugucuuggguuuacaggaaugcagcuccccaucuuccacacuaaaccaaggacuugcucuggggcucaucccuccccgaguccuccuugugaaugaccccagccaguccuggaauggugacacuugucaaauaaagucuugacaggcgcgguggcuccuaccuguaaccccagcacuuugggaggcugaggcgggcggaucacucgaggucaggaguuugagaccaggcuggccaacauggugaaaccccaucucuacuaaaaauacaaaaguuagccgggcaugguggggggcaccuguaaucccagcuacucaggaggcugaggcacaagaauugcuugaacccaggggguggagguuucagugaacagaguucgcaccacugcacuccagccugggcaacagagcaagacucugucucaaaaaaaaaaaaauuuaaauauguauauuaaaaaaaaauguuuuuuuaagucuuaagggucaguuggugucaucagcccuuagacucuuaucccaggacaggaaaggaaauuaauuuccuugagguuuauagguucacaaugucaaauaucugaccacaguuuuaacaacuuuuggagaaaaagaaucucaagccaguaaaauugcauucuuucuuucugcuaacuaaguuuuuacaaaaagcaauugaagagggaaaaauucuggucuuuguucacuuccucaggggggcacuuuacacaacccauuuaucugcucggagcccguuuccccuguauaucaaagaaagauaaguccucucuagggugucccucugaggccgugaugcaaagcccugaggucacagcugucagguggcaguccuuuaugagccauccaugcuccagagggcagauugucuacagggagcugagcugauucaacauuccccugaacuucucucuugcuguuuuucuuccuaguucugagaaaucgagaaacaugauaaggaauuggcugacuauuuuuauccuuuuuccccugaagcucguagagaaaugugguaaguuuagaaaugacacgucaacuuuguaaagagggaaaugguggcuagaggaaggaguaaucugaucuguuuguugccaaggguuuagaaucauucagaccacaugucucugucugccucuuggccauguggccacuggggugguggagcagacccaggucugggauccagguguucugcaaagagccagauaguuccacauauaauuggccuucugcccugguaucucuguaccuuucuguaccaaagugaacagcugguucuuaaggucagacuaugcagcugauucucaaagucaaacgguagagcuccaacaaccugggauaauaucuuaaagacuggcucaggcuggagcaguggcucacgccuauaauuccagagcuuugggaggccaaggcaggaagaucucuugaggccaggaguuugagaccaaccugggcaacguagugaaaccccaugucuacuaaaaaauaauuuuuaaaaauuagccauaugcaguggcucgugccuauaguccuagcuacuugggaggcugaggcaggaagauugccugagcccaggaagucaaggcuacagugaguuaugaucacacuacugcacuccggccugggcaacagaguugagacccugacuuuaaaagaaaaaaaagaagaauggcuuaugccucugcccuguggaccucacagagagagucuuggguccugggaaacacuggggaagcagaagagguagccacccuguuguacccgguucugccaggcacagaucaccugaggagucugcccagcauccccuuguaagaugagaaaaccugucccuuagagaggggcugaggaacagggugcaacagcccagcagggcuaggggucaguuggaacacaggcugggauggaguuuacacguccuuguaggaggaaugaccuucagugcaggccucuuugaggcccgugcccuucuagcaauucucccacugcccaaaacaucucuggaauuccuuccauaaagagccauguuuagcacuucaaaggugccaggcccauucauuugauccucagcuugccucuugggucaaauacaaaaaucagauacauauauauauauauauauauauauauuuuuuuuuuuuuuuuuuuuuuuuugagacagagucucacucugucgcugaggcuggugugcaguggcacgaucucagcccacugcaaccuccaccucccggguucaagcaauucuccugccucagccucccuaguagcugggauuacaggcacccgcaacuacgcccagcuaguuuuuuguauuuuuaguagagaugggguuucaccauguuggccaggcugguuuugagcuccugaccucguggcucgccugccuuggccucccaaagugcugggauuacaggcaugagccaccgugccuggcccagauaccuuaaauucccauuucaagugaaccuugacaaacaauacaaauccugcagagguuuccccagagccuagcaccauugccguuaucuggccucuugcaucucugaggaaacauggucacgugaucaucucuuccagguuuguuaaacaaucaguaauguuuguagucacacuuuguggauaagcaauuuccgggaaaggcaggucuuucagacccuggaaccugguguuucuuaauacagacgucagaacccuguccccacccuguaggaucagacuuuguaagacugaggcuggagcaugugcgugugccugggagugugcgcgcgcguguauuugccugggccuguguguguguguguacccgggcgugugugugugugugugugccugggcgugugugugugugccugggugugugucugcgugcauguaugugugcccgggcgugugugugugugugugugugugcccagucgcucauacauacucuuuaaagccccauuaguaaugcuaacacgcuccccuaggagaaaaacaaaaaauccagcuaccaccacuccaguuaccuggaggggaagcaggcccagagaggguagaaggcuuccccaaagucacacagcuagaaaguaacaaagcugggaccugcauaggaucccugcugcaugagaucacuuugccuccuuuccugaaugccauuagaaaagaaugggccaggugcuguaguucacgccuguaaucccagcacuuugggaggccaagguggguggaucucuugaggucaggaguucgagaccagccuggccaacauggugaaaccccgucucuacuaaaaauacaaaauuagcugggcaugguggcgagcgccuguaagcccagcuacuuaggaggcugagguaggagaaucgcuugaacccgggaggcaggagguugcagugagcugagaucacgccacugcacuccagccugggugacagagcaauuccccaucucaaaaagaaaaaaggaaagaagaauggaagccaccauaaaaucaagucacuggaauugaaucuccaaccucauucugcccuugcuguuucuuucuucucuuugcuuuggguaguaauuaugaaggaccacagaugagaugauuggccuucagacuugucugucucugacuucucuggguggaaucuugaggcagugcagccucauggcaagaaccugggcuuuggacuagacaggccuaaguuugaaucuugcccucaccauuuucaagcugugugggcaagaaaccuuuccucuuagaaugcucaguuuccugaaauguaaaauaggaauaauaaugccuaccucggccuggcgcguuggcucacgccuguaaucccagcccuuugggaggccaaggaggguggaucacaaggucaggagaucgagacuauccuggcuaacauggugaaaucccgucucuaccaaaaauacaaaaaauuagucgggcgugguggcgggcgccuauagucccagcuacucgggaggcugagacaggagaauugcuugaacccgggaggcagagguugcagugagucgagaucgugccacugcacuccagccugggcgacagagcaagacucugucucaaaaacaaaaaaaaaugccuaccucucacuuuuguaauaauuagaaaaugggagcucgguguauagcagaguagcugguauuggguaggugcagagugggagagaggccuauaagaauuaauuuuaaaaaccuggccaagcaugguggcucauaccuguaaucccaacacuuugggaggccaaagagggaggaucacuugggcacaggaauuugacaccagcgugagcgacauagugagaccccaucucuacaaaaaaaaauuuuuuuuuaaacggauucucacucaguugcacaggcuggagugcaauguggcgugaucucaguucacugcaaccucugccucccggguucaagcgauucuagugccucagccucccaaguagcuggguuuguagacgugcgccaccacauccggcuaauuuuuguauuuucaguggagacagaguuucaccauguuggccagguuggucucaaacuccugaccucaagugaucugaccgccucagccucccaaagugcugggauuacaggcgugagccaccgcacccggccaaaaauuuuuuuuuaauuagcugggugugguggugcaugccuguguucguagcuacugaggugagaggcggcaguggugggaggauggcuugagccuggcggggucaaagcugcagugagccaugaucacucucuuuaggaggaacucaggaugguguugugacucauuuuguaaaucugauacaauguaaagauuuuagacuuggggggccagcuuccuaacugccucccaccuugggcuaaaaauauccugcaguuaucaugugaugauaauaauaguaacaauuauuuagcaucugggcuuuguggaaaacauguuacaaacauugcuacauuguaucuucaccaugacucauucagauaggucuugguauucuccccacuguacagauaaggaaauggaggcucagagaggguaaguaccuuacccauggucacacagcuaggaagugucagagccaggauggaacugcgugacuuuggagcccaauaucucaguugcugagcaccucaguuuucuguggugcuaaagaaggagggaauaaacauucucuggucugguucuuggaguguucacaaacuccuauuuuauuuuuuuauuuuauucuauuuuguugagacggagucucacucugucacccaggcuggagagcaguggcgcaaucucagcucacugcagcccccgcuuccuggguucaagugauucucuugccucagccucccgaguagcugggauuacaggcgccugccaucacgcccagcuaauuuuuuguauuuuuaguagagacaggguuucacuauguuagccaggauggucucuaucuccugaccucgugauccaccugccucggccucccaaaaugcugggauuacaggccugagccaccgcgcccggccuaauuuuuugucuuuuugguagagaugggguuucgccauauuggcuagucuggucuccaaauccugaccucaggugauccaccuaccucggccucccaaaguguuaggauuacaggugugagccgcugugcccggcccucaaccuccuauaugcaaagauuguaggagcucuguagccauguagaucucccacucaccuugaccuccacuaccucuggcagagcccuagggauccagagucuggcuggccgcccagcaucacuuucagcauccuguccugagcaguggcugguugugggacuugcuuaucuggcaugguccucagcucuaggcagaauugaacuggugguacaggaagucccagcuaugcaagcccagaagaaauccucagaaugaccucagaacagugagccugaaaaagaagggcagacucgccacagcggcuuccaggcucugaggcuccacauaaggaagggacugccuuuugccgcucugagcaccuuggccucugcaagggccaggggacauccuguucugaggagcccagccagccagcaggggacuggagauuguggacuguggggaccuacggacuugggacagagcuuccaucuguauucacaugugcugagcauggagaaggcagcucucagggucugagaggcucuggguagcagagccuggccuggcagggcaagcuucaggcugugaucuccuuagaggagacgagguuacagaggaagagaaacuaccagguaggaguauugaggcggagaaucagaggucaaauuggguaacuuuaaguuuccuuccgggccagguaugguggcucacaccuguagucccagcgcuuuggaaggccaaggcaggcagaucaccugaugucaggaguucaagaccagccuggccaacauggugaaaccucaucucuacuaaaaauacaaaaauuagccagacguggugcugcaugccuauaauuccagcuacuuggaaggcugagacaggagaaucacuugaacccaggaggcagagguugcagugagcaaagaucaugccacugcacuccagccugggcaacaaagcgagacucugucucaaaaaaaaaaaaaaaaaaaaguuuccuuccaacccaagcgucuaaaauuucagaucucaauucaucugccuuugaggggucugagugacagggucuggguggggggaacugggccuggggggucugagugacggggucugggucggggaaccgggcaugcuggcagccucugccguugcaaagacgcuccucaucacagucaugcaccugcuuccccgcccggccuagagucaugaccauaaccccaggcuguguguaacccugaaggcaaucaggcaggggaagugagauggcagguguggcaugagccuuccaguaccccugggagcagaggcugggacggggcugcacaaagaauacaggaagcacacaaagagaggcuuacucaguccggugcucugggcuaguuggccuugcaagaggguuuucuuucuuuuuuuuuuuuuuuugagauggagucucgcucuguugcccaggcuggaaugcaguagcgaucucagcucacugcaaccucugccuuccagguucaagcaguucucugccucagccuccaaaguagccgggacuacaggugcaugccaccaaacccagcuaauuuuuuguauuuuuaguagagacaggguuucaccauguuggccaggacggucuugauccucugaccucgugauccaccugccucggccucccaaaaggcugggauuacaggcaugagccaccacgccugcccaguuuucuuucuuuuuuuaagaaaauauucuguagaaacagagucuuucuguguugcccaggcugaucuccagcuccugggcucaagcaguccucccgccuuggccucccaaagcgccagguuucuaagcgugagccaccacgcccagccccacgaugguuuucuaagacccuaagacccagaucugcuucuucccucaucugggggccuguuugucaacuugauucugaguuaacagcuuaaugccaagaagaaaucucagagugaaacaacuauucacccuuccuccuccaguaccccgcagauagucagccccaggaaggggaccagugccagggugagcuggguugggaagggaccccaaagggcuccuuagaaacucauuagcugggcccaugugucucucugagagugcaggaaaggggcuggcccaguucuucaggaccauuuugacuucaugaacagaggagaccccugugcuuucaucugaagaggugguucacggcugccuuuuacgcucccaggucacgcuggaauuccccuguaaugauuuuugggcuccaugguucucuaacaaucucugguuaacucagccgcagacucucagagccugucaucgcagcgggaggaggacgcuccggcguuuccugcucaggccuguuuuccuccaucucugucucuggcagcagguggggaaggaagcuaaccagggccuguguuugcagucccaucacagaauagggcucgucagagagucagagcucaggaguucagaugucagggguuucggcccaguuuucugucacaggccugaacucugacccagugccucaugucauugauuuggguccuuccagagucaagcgucagccucacuguuccuccugucguaaagcuggagaacggcagcucgaccaacgucagccucacccugcgguaaguuccugggccuggcgcugugcucagcuccgcucaggccccgcagcugggucagggcugaccccuggcucagucuguucagauuucagaugcgcuauucuugccucuuaccuguaagacaagcccuagaaaaagggauggugcuagccccgggcugcaggaugggaucgcaaaggcugacccccacccugaguccucacuuucccuggcaggagaaggaaggggugcuucucccagagacgugcgucuuuuccccgcaugggaagaguccugugugaccgguguugaggccagauuucaaagcgauucuuucuaagacuaaguauuugaagagagcccugaaggucaaggggcagggagcugagcugcugguuggcacuucugagguugcuuucagaagcaggaguggccacgucgggugaaugccgcucaugcugggccuugucugggagucucacuugcugccaccugcuggcuuaggcacaaacgucgcgaccuaguccagucugugccagggaggcugccucugccuucucugcucuuagcugcuuuguccuucccuugccucccagccgugaggauucccugaugaagaagaccuagaacccucuccuucucucuuuaugccuuucccccuuccucgccucuccugcgagaucuggccugaaagcaaagcuuugguuccgaggccccuagcaggccugccauuccgcucccagcuccuucugucucugcacacccucccccugcaaaucuuacaagucaucucuuaccacaacuguccaggccccuggaguggccucccacugccuuucagauuaacuccaggccucuaaacccagggccagggcccagaagacggcuuccagccagcacaucugccuucucccgucagaugccucucccagcuuuccaaguccggacugcucccuccucauucccugccugagcccucuccuccuucagucaaaugcuggcccucacacaaggccccacucagacccgacucucugggaagccuuucccaccggagcagggagccacgguccugggccuccagaugccucauuugucauucacacccaccuugcuuucuucucuguucucacccuacccugaagggacagacaccuggucuccugauuaagacaggaaggccuacgggagcacgauuuccaccuggcuacccaucaggguggagcaccuagcauuuccuaagccuaacugcuugagaguugaaggccagaugugaaauccagaggguugguugagaucucacuguccagcuucucagcaguaauuagacucuuguccuccacaggccaccauuaaaugcaacccuggugaucacuuuugaaaucacauuucguuccaaaaauauuacuauccuugagcuccccgaugaaguaaguaaccaaucuuaacggauggguagggaaaugcuagguaacagaacacauuugaauuaagagcugguggaaacaggucuccuaggcggccccuguuccaucaaccuagaaaucugugauuuuggcuuuguuggugucuuuuggggaugaguaucacaugccauuagauggaauuaagaaggugauagugaggaaccugaggcaaaaaugguucugggaauguaaacguucuuaccgggagugguggcucacgccuguaaucccagcacucugggaggccaaggugagcgggucaccugagguaggaaguucgagaccagccugaucaacauggugaaaccccaucucuacuaaaguaaauacaaaaauuagccagucgugguggcaugcaccuguaauccaagccacuugggaggcugaggcaggaggaucacuugaacccaggaggcggagguuggggugagccuagauggccccacuacacuccagccugggugacagagugagacuccuucucaaaaaaaaaaaaaaaaaaaguucuuacaauuuucaaggccuggcugcucaaagggcauucaaggaccagagaauugggcuuccuuaggaacacagcaucucaggccccaucccaaaccuacugauucaaagucagcacacuagcaagauccccaaaugguuugaguccacauuaagguuugugaagccucauucugagacaccacugguugggugucguuuccaaaaaccagugccagaggccgugugaucuaauagcgaucauuacccauagcuuuaugcauguaucuauuuguguguacccugcucccaccuuacugagcauuugagccaguugcuauucaauuagauaaaaagcauccacagaggagguggcaaauaaggguuuaaauaacaagaugaacgcaagucacucagggcgcauaacuucuggagagcuauuguacaaccuggcgauauaguuaacaaucauguauuacugcaugccuaaaaacugcuaagagauagauccuaaauguucccaccacagcugggugcaguggcuugcaccuauaguccuagcuacucacguucguaacaacaacaaaaaaaagauaaguaucugagaugauggauauuaauuagcuugauuuagucauuucacaauguaugcauacaucaaagcaucacguuauauacugcaaauauauacacuuuuuauuugucaaugauaccuuaauaaagcugguggaagcaggaggagaagaaugcagggaugagaucaguagccaugaggcacaucaagaugggcugcaaaucagcucugagcccccuaggaagcaaacaggagugaaacacgaucagucuccagcaugugggaaccugugaucugaaaaauauagcaucgcuggcugcagagaugugcaccuguaaucccagcuacuugggaggcugaggcaggagaaucacuugagcccaggaacucaaggcugcagugagccaugacuguaccacugcccuccagccugaguguuggagcaagacucugucucuaaaaaauuaaaaauaaaaauaaaauguuuaaaaauaacagcauugcugagaggggaucucggaguguccagcuaagaggaccccgcaugagagggagcucuccccgcuggugagcaccuuguuagugccauuucccacaccuccccucuugcccagggugugaggccagcaugcagagccgguggguucccacagcacagcccucugauccacagauuaaauucugacucugggaggaacagaugcugauugcuucguuuagggccaaacaucgaagucaaagugucaucuuuuuauuuuuauguauucauuuauuuuuuauuuuauuuauuuguuuagagacagagcuucacucugucgcccagguuggaguaaaguggcgcaaucucagcucccugcaaccucugccuccuggguucaagcgauucuccugccucagccucccaaguagcugggauuauaggcgcccaccaccaggcccagcuaauuuuuguauuuuuaguagagaugggguuucaccauguugacuaggcuggucuugaacuccugaccugaggugauccacccgccacggccuccuaaagugcugggauuacaggugugagccacuggcccggccauugauugauugagacagagucucacuuuguagcccaggcuggagugcaauggcgcaaucucagcucaccgcaaccuccaccucccaaguuuaaucaauuauccugccccagccucccgaguagcugggauuacaggcacacaccaccacacccggcuaauuuuuguguuuuuaguagagaugggguuucaccauguuugccaggcuggucuugaacuccuggccucaggcgauccgcccaccucggccucccaaagugcugggauuacaggagccaccacgccuggccaaaguguccucuuuuuaaaaucaaaaaagauaccaaacaagccuuggcuguaggaguccuugaaccugaagcacaaacagauccagcaaauccauggugucagucaggguagcagugacccucggggccagcggaggcuggaggaagcaagcagggguuccgaggacuugggaauguuucauuucuucaucugggagcuggaugcauucagucuguagacauuucaucaagcugugauguguguacuucucuaccuauaugucauaguucaguuuuuaaaaaagucuucaacagugagaggcugggcaccgugggauuacaucuguaaucccagcacuuugggaggccgaggugggcggaucaccugaggucaggaguucaagaccagccuggccaacauggugaaaccccgucucuacuaaaaauacaaaaauuagccaggugguaguggugugcgccuauaaucccagcuacucaggaggcugaggcaggagaaucacuugaacccgggaggcagagguggcagugagcugagaucacgccacugcacuccagccugggugacagaaugagacccugucucaaaaaaaaagaaaagaaaagaaaagucuuuaacaaugagagucaaaccauuggugugagauggcauugaugggcaccaaccuaccuuuucaggcuccugccucacuggcccuuccccacccaacucucaccacuccccucuacuacccgugaugcuggaagccucugguuagaacaugggaguugaguggucuaggagccaggccugugagccuuggguaaggcacuucaccccaauauagcaccgucuccuuauucguagcuguacagugaauaauguuuacuugacagccuugugaagauuaaaagcacaaacaaguauaaaaugucuaggauugacugggcacgguggcucaugccuguaaucccagcacuucgggaggccgaggcaggcagaucaccugagguugggagcucaagaccagccuggccaacaugaugaaacccagucucuacuaaaaauacaaaaauuagccaagcgugguggcaaguaccuguaaucccagcuacuuaggaggcugaggcaggaaaaucacuugaacccgggaggcagagguugcagcgagccgaaaucaugccauugcacuccagccugggugacaugagcaaaacuccaucuaaaaaaauaaaaaaugucuaggauugucccuggcacauagaaagcacucagugaaagguagcgauuaucacuucauucugucuuguaucggucaaucgacugauuuucucccugccuaguuccagaagggauuuaguggccacuuaacaaauaugcaagcaacguugcaaggaauaucuguuaaaaauaagaaaaagugaguggcaggaaaauaaaagagccaggaguggcacauguuaugaagauguaccuugugagacguggacguaaguuggacuccaggcuuugcugcagccgcuauaccauuucaguuguccugccaaagccccugauuucugaugcuaagaacaagaaggcagugcuucaaggguccucauuaagaagccacugaaggaugugguagagcgccuguagucccagcuacucaggaggcugaggcgggaggaucgcuugagcccaggaguuggagugaucagugagcuauaguugcaccacugcacuacagccugagcuacagagcaagaccugccucucggaaggccgggcaugguggcucacgccuguaaucccaccacuuugggaggccgaagcggguggaucaccugaggucagaagaucgagaccagccuggccaacauggcgaaaccccaucucuacgaaaaauacaaaaaauuagcuggguaugguugugggcaccuguaaucccaacuacucaggaggcugaggcaggagaaucacuugaacccugggggcggagauugcagugagccaagaucaugccacugcauuccagacuggcaacagagugagauuccaucucaaaacauauauaauaauaggaaaccacugcagucuaaugagccagauccucacgguaccugcaauauggguggaguauuauccagggagcacagaagcuggggaccaggggagacagcuggguucaguaaggauaucauccugcuccccaucacugcagcaggauuuaagagucucaggaagcacugggugcgguggcucacaccuguaaucccagcacuuugggaggccaagguggguggaucacuugaggcugggaguuugagaccaggcugaccaacauggugaaaccccgucucuacuaaaaauacaaaaauuagccagacgugguggcacacgccuauaauuccagcuacucgggaggcugaggcgggagaaucgcuugaacccaggaggaggaguuugcagugagcugagaucgcgccauugcacuccagccugggcaacaagagcaaaacuccaucucgggggaaaaauaaagucucagcaggcaugcuugggagaucagauguuguaggcaggccuccggguacuuuccuugaagcagagcauuugccaaauauugcagagcagcaagggugaaaaugcccucuuugccaagugccucauguaugugccuccucugcuuugucacuuggcagccaggcuggcacagggcacacaugguuuuguggacaaggaggagcccagugaugauggaaguggaagugaugguauuguaguauagcaguggccccguuugccaugcaccaggcucugugcugucagcuuucugaacauccugucauucauggcagcccugaaggguagacacuuuuguuaacucguuuuacagaugagcaaacugagaucagagcuugaauaacuugcccaaggugacauguccaguaagaggacgagagccaucccuccuucccucagagauaagccaggggagggcaugaggacaaguccauagcucugcucagaaagucucacccaggccagguaugguggcucaugccuguaaucccagcacuuugggaggccgaggugggcggaucaccugaggucaggaguucgagaccagccuggccaacauagugaaaguccaucucuacuaaaaauucaaaaauuagcugggcaugguggcgcacaccuguaaucccagguacucgggacucaggagccuaaggcaggagaaccgcuugaacucgggaggcagagguugcagugagccgagaucacuccacuacacuccagccugggugacagagcgagacuccgucucaaaaaaaaaaaaaaaaaggaaagucucacucaggccaggcgcgguggcucacaucuauaaucccagcacuuugggaggcugaggcggguagauugcuugagcucaggaguucgagaccagccugggcagcauggcgaacaggagguucaaguuggcuggugggcgcagcgucucuccuuuugcuuaguaagcucuuggaaggugaggcugcggguggugcgucccuccguucccuagcguguugcauagagcuagaugccagcgggguccucgguaacuguacguggcaucggauugaaccucagucuuccuaacagguuguggugccuccuggagugacaaacuccucuuuucaagugacaucucaaaauguuggacaacuuacuguuuaucuacauggaaaucacuccaaucagaccggguaggcuggccucagggugugcgggccucacgugacaagaagggggccgugcugggcacgugggagucuccuucagaagcccagccucagcucaucccgguccccaaacuccuuuccagcccgaggauacgcuuucuugugauccgcagcagcgccauuagcaucauaaaccaggugauuggcuggaucuacuuuguggccugguccaucuccuucuacccucaggugaucaugaauuggaggcggaaaagguaacccccugggccguaugugcaggcucucucggggccccuaggagcagggcguuccagcaaggcugccgauagcgcagccuccaacguccccucuacccuucugucugccuacccuuuccagaaaguugucccagugcgaaggcucggagagccugggucggauucccgugcugggcguuucaucccuugcccagcucagccccucccugggaaagcaggaaaacagggaaaaggggcuccuuaguuuaguggagaaugggcgggggagggagggcaguccaucgugaaucuccucugcgcuggguccauccgacccuggaggauugcggcgucaaguccuguagucucggucuuugggacgaagcugucccaccuugacuugcaaagacacaagcuguccugcagucacccuggccacgucggccuccugggugauggcaagcagagagccgggagggagacgcuuucuuccgggggccuccugacuccccucuggagccaggacuugaggggcagggagaucuugggcaggggaggaagggaggagggaaguagcucuucaagagggcagggauuagguggcauccguggugguagcaggagggaccuaaggacaguacccugcuugagaagggccgaguccuccuuccccguggccugggagcccugucccucccauuccccacaguggugccaguccucaccccuggcccugccaugcccuuccacccccgccagcccucacccccugcccugccccuccaccccucgccaguccucgccccuggcccugccaugcccuuccacccccgccagcccucacccccugccaugccccuccacccccgccaguccuuacccacugcccugccccuccaccccccaccaguccucacccccugggguccucaccccugcccugccccuccaccccugccaguccucacccccugcccugccccaccaccccucgccaguccuuaccccccacccugcccugccccuccacccccgccaguccucacccucugcccugccccuccacccccgccaguccucacccucugcccugucccuccaccccugccagucuucacccccugcccugucuugucccuccacccccugcagugucauuggucugagcuucgacuucguggcucugaaccugacgggcuucguggccuacaguguauucaacaucggccuccucugggugcccuacaucaagguacggccuugccugcccuacaucucugcccacauggcgugguggcccggcugccccucaccacccagcuucucccacccaccaaacaggagcaguuucuccucaaauaccccaacggagugaaccccgugaacagcaacgacgucuucuucagccugcacgcgguuguccucacgcugaucaucaucgugcagugcugccuguaugaggugagaccagcccuggccccccacaggccaccccagccaacacccgccaccccaccucaccuuugacagaagacacggcagagccugggaaaggaaggguguguguucauucauccagguccugugcugggcauagaagacacccaugaguccaggcccucagagccccccaagucuggggugagggacucagggagaggcagugccuggacucaggcugagagccgugcacagaggagcacagacagcucauggaggagugcaaggcccugagcccugccagggaggagggaggagggcacagaagggaggagggaggagggcacagaagggaggagggcagaggaagacgcuugguugggcuccaaggaugagugaaguuccuauggaggaggggaggggccagggugggcuccuggaggggucaggucacagaggccaaggggcauuugagagggacccugagcaggcgggugcagcugggcuucagggugccaggagggggcccgcgugcaggcggagacaccuguauucagcuuuguugcuggaagccaugggugucggcagggcagggccccaccaaggcuggguccggggaccccugauaugacagcuuugcuuucccuucucucagggaguucccuucacacuguaaggccagcugggggcugucuggccccacccguaugaaccuucuaggcuuucuuagcuuuuggugugaagcgagagugaagguggcccacauugggcccguguucagggaaaggcaaggcgaggggacagauuccugagauccucaggcugcugccgggucgugggacgagucaguaccuggcugggagaggcaccaggccaccagaguuccgaccccacgucuccaagugagugcugagaggcgcccaguucugccaaguaggaacaaagcagacagagcuugagaguccaagcagccugaacaggaggcccuggcgaugagaaggugugguuggugcuggggauguccagcaccagcccaggugugaugcuuucugugguccacauguuccccugccacaaccccagugcagcccccaccuugcaggggcuccuucaaggccaggguccagccuccgugccccucucuaagcccgcccuauccggggccguccuugcucagccccggcguggccucuguguggguccacaucucugcccuccucucgcccccagcgcgguggccagcgcguguccuggccugccaucggcuuccuggugcucgcguggcucuucgcauuugucaccaugaucguggcugcagugggagugaccacguggcugcaguuucucuucugcuucuccuacaucaagcucgcagucacgcuggucaaguauuuuccacagguaccuccagggcccuguucacauggccgguggcaggagaggugagagcuacauggcccaggcccugcuccgguggggcagcuccugccggcgugaggaaacaggacggaaagccacagggagcccgggagcccagcgggagcggggcgguggggaggccagccugccgcucuucccccggggcuggaaucacaggagaucgcuagcggaggccccuuggaccccacgcuccccuaagcaucaggugugcgggugguuccccuucuccacaccccagccuuuccugaugccuuuggcucugcccucaccacugccuccauuuccacagcaggacacucuggagaggugaggugggaggagggagccccuucccgcgcagagcucagcccguccuaugagcauagccgguccucuucagauccggggacucaggguccagcacaucuugccccacagccugggacagggucagggcugaaguugcugcacccggggaccuagggccucauuuaacucaccccauucccaaagggagaagccuuguuccagugcccccagcccugggagccucguguucugugagcucaggagggccagcguucugacugggaggcaggacuggacucuuaggcugagcaggacuaaguucuguggccaaggagcccgggcguuccgggccaggccagccugcacagaggcuggggcgggacacggggcggcagugaggggauguggcugguugaacaguguugagcauguugaagcugggaagcuggggucaggucccgggagcuggggggggcuuccgaggaggggaagguuuggggaagugggccccagucccugagggugggagggauuggggccaagaaaccggggauggaggagcccagguuggagacguuuggaacugcuggaggggcagcagcaaguacggaagagggugagccgggacacagacagggacugacuagaggcucacugggaggccaccagagaggccaggaccugccucacggggggaaggaaaggucacagcagucagaggacccacagggcucugcagcaugggaggacguggggcacaggcagucagacuggggcgcauccccgcagacccgcccccccaaccagacccaggaagccccggccaggccuguggggggcguuaaccccgcucuacagacggggaaaccaaggcuaggagaacugucacuugcccaagacagcaggcuccggugauggagccaggauuccaaaccagaagucccacucccaccagucccuaagcacaugaaguccaggcugaguuuggggacagccuugccuggaggugagaagaagaaucauagcuacagggaaacuagcacagggccuuggccccagggauguggaggagacggggaaggccgcaucggccccgccucugcuggagcugugagguguggggggugcggggccuuugcuugcuguacaugcagaugagacgccuacccccaggaccacccaaacuguuccuuggcugaggccugucauagcccaaaggucaccguguccuuggagccaaggccccagugggaggaaugagaaccgcuuuuguuuggaggggcagucacgaggcgcaugaggcagccgcccagcccucaccgcccuccgucugucuguccgucugucuggcccaggccuacaugaacuuuuacuacaaaagcacugagggcuggagcauuggcaacgugcuccuggacuucaccgggggcagcuucagccuccugcagauguuccuccaguccuacaacaacggugagucagccagcgggcugcuggccacccugcggcuggggcaucgggcggggccagccuucccgggaccuuccagccagggcuccacccccaccugggauccaagccaauccagcccccaaggagagacccaccuaggggccuucguagcuggaggcuuugugguuuucugggacccccaccgcccaccaccccacaagcuccagcugccucaggagcugccaaccuaacaccagcuucugucccccggcugcuaacagaccaguggacgcugaucuucggagacccaaccaaguuuggacucggggucuucuccaucgucuucgacgucgucuucuucauccagcacuucuguuuguacagaaagagaccgggguaugaccagcugaacuagcacccagggacccaguguacccagccucuggccucgugcccugcuggggaaggccucacccagcgaaggccggagaagcgguugggcccuggcacacagggcuggcucagugugcggacagaggagaccacucugcuccuggggccagaggccauucaauagccugccuucguccgggccccuccugggccuccccggccaggcacguggcaccgucgccuugacaccgccaucucuuuucuuuaaggcuucaggcagcgcgcacaggcucuggcagccgucucaggcaggacugggcaccaagcuugcagccgaaggccuugccccaaacuaccagcguuucugcaagcagcuugaagggcugaccuugcagccgggugagccaagggcacuuugcugccaccgcugcauucccagagaucaagcagcccggugccguggccagugaacucagaggugcugguggacgggcuaggacuuugggguuaggccauggggcucuuucucugaaggccacuuuccugacguacucucuguacauaacucagcguccgugacugcaguaacagccagcccuacccagaguauuucugagccaugaggggcccaccagauugguucugaauuggauucaugcccagcgcauuagcauaguaacuccuuucagauuuuuuggagggacguuuggaaguggcuuacucucuucugcccucucuccuaccuccaccuucucagauuagccccaucugagcacauccagcugcuccuuacccagcaucuggaguacaggacauagcucucuccugcuaccagucugugccuuagaggucuguuaggccugccaaacggcgaccagcuccccuggagcgagggcaggccccuucccucucuuuccccagacaccuacuugagacucaccaauuucuggccuguucaggagccucagauaaguauuuguacuugagaccaccucacacaaucuguaugggcccaacccugaucucaaaccuccuucccucugcccaaagcuguccuuccuauggcaggaggggugggggucccaggacgugccucauacaugacuugagcuugucaguccacugaguuuccuucuacgagaucaacgcgaggggccuguaucuugaauuaaaaccuacucgcuuccuuucugcacucugugugcucgauacagaaggcaggugugcuggccuucagagccaggugcccugcuccccucguguaaggaagcgcauaagguugugaaggucacugacccgagagcgcugcgugcugaccccacacuucacuggggagcccucuuggguagcgcgagacgccuacccgcccagggccaggucagucucccaggcuccgugucuucacgguuaccagggcacgccacucaaucuggaugugagccgggguggaugagguucugaagggcacaccagcacugggagcgggggcagugggggucuuauucuccagacgcuuccucuaucuaguuguaacaaacgucaaagaaugucaggucuuguuucugcagagcagacuuuggccugacgggguccacagaccuguuucacuugcaacacccaguaaauguguuacugggugcccuacuuuaaaaaucagagauuucaaaugauugacuuuuccggcugagugcgguggcucacgccuguaaucccagcacuuugggaggccaaggcagauggaucaccugacaucaggaguucgagaccagccuagccaacauugcaaaaccccaucucuacuaaagauacaaaaauuagcugggcaugguggcgggcaccuguaaucccagcuacuugguuggcugaggcaggagaauuacuugaacccaggaggcggagguugcagugagcgaagaucacgccauugcacuccagccugggcaacaagaacgaaacuccaucucaaaaaaaaaaaaaaauuauugacuuuucuuuaaaaucugauuuggcagugcuagguagguccaggagugcuaacaccuucccagaggugguacgcagguagucaggugcucucugacucacccccaucuggccagaucacggcccccagcaacacgugggguugugucccucgcugggauacacggagugcccuuauaggcagggagucuuauaggcaggggucucucccaggcaccucugggugucccuacggccccucccaggugggagcugaggcuagguugcaaaaaggagguugggagcaaguaggggcuucacaguaacacccaagaaagcacacgcaccccagggucccaccccagugcucccagacacucccacagaugugguucuggucaggcgcagugcagcugcugcggcuccaccagccccgggcuuucaggcaggugggccugggaguaguugagcuuugucccagaacagugggggauggggccaucauuaaaaccacagcucuggccccaauaucccaccgccacccccaccccgauaucccagcccaugccucagcaaagcccccugugaauuccagcauuuuuauugagcgcaccacaucggggaggggcggcagugguuuccacgguaaccaaaguaaggcuugugcacuugcugagcuuccagaugcgaauuaguaaaagcuaaauucaaaaguagaaugggcaucuccaaagaguacgauaaaaacauuuuguaucaaacuugugauuaaaaaaauacaaaaguuaaaccca

SEQ ID NO: 34850 - RNA, 26636 nt, Homo sapiens; identical to SEQ ID NO: 34849

SEQ ID NO: 34851 - RNA, 11966 nt, Homo sapiens
auuaugcaacccgccuccccgcccgcccgguggagcuuccacucggcugcgggcuggagcggcggcgggcaggcgugcggaggacacuccugcgaccagguaggcaucucugcggccauccuggggccgaucuccgucccugagccggaccgcugccacuuccaaucugaugggcuacuuucggcccaggcagagggcacacugucguccuuaccgcuacccacccucucccugcccccaaggaccgaaguccuccucgaaaucuugcaccgggagucugcacuccugacccacucaucuuaccuccagcuuguccccaccuccccgucccagcuuucccggccccacagccgacucucagcgggcaugccccggucuucuugcucguuacucgaggggccccagguuugccccgguaccaggacccuauuaggcuuucagcgcuccccgugucucuguucuccagucccuggcccugcgccgccugugaugucagcccacuucggacuagaacaucccguucccagcgcugguuccugcuguuggccacaaccuucccuuuuccccuggcgcucagaaaaugcucaguaguaggggugugguuggacggggaguaggggaagaaagaucuguuggcuguugugugucuucugcccaaggcuugggguuggugggggggucuggccagaaaaguaggggacugaagagagaggauccucggguccuugacgauggcagguugccggcuucgguccuugugguggggaagcagcgcaggggcuaaagaaggaaagguuguguugucuugaccagaaugacugggauccaggcgagagucagguugaggggcuuuugcgccgagggcaguggccguugugcuucguccuggggaagccaggaccaacccugggauccuaauaggccgucccacuucuuacggccaccgagccauccugggacuggggauauguaagggaugcgugacccccccggccgcgcccaccagugugagagugggccguucccccacuuccgccgggaaaugggggaggggucgcuccucccgcccuccuguggucccuccagcaaccgcugagcucagcagcugacgucgguuucccuggcgaccguggcggcggcggaagcgcgugguggggccgcgcacgucggcgcgcaugugcagcggggguggcaccgcccccggauaaaauuagccuggaggccuaaauauaggaggcgaccagcucaccuccugcuccgaggccuuggaggcccaggcagaguggacaccuaaugggaacuugggaaugggaaguguccagguuuuugucuacagccgugguucucauugacugcucaggccaugguggcaggggaugugaaggaaggccccggagaaccuucucccgcuggcagucccccuaaggguacaggagacauccugacuccccauuggaagccccaggccuggguuccacucccaucaguccugcaggaggccaggcagggggaaggucugagugaagccagcaggugcucuggaguuaaaccagcuuucugcaagcccugcuuccuggucucccucuccagguacuggcugugaucgaacuucucaacccucagagacuuagaucuuccaccucacucccucagccaagccuccaggcccccucgugcauccgugguggccucucugccuucucuguucuguucuccccauggcccagacaugaguggcccccuagaaggggcugaugggggaggggaccccaggccuggggaaucauuuuguccugggggcgucccauccccugggcccccacagcaccggccuugcccaggccccagccuggccgaugacaccgaugccaacagcaaugguucaaguggcaaugaguccaacgggcaugagucuagaggcgcaucucagcggagcucacacagcuccuccucaggcaacggcaaggacucagcccugcuggagaccacugagagcagcaagagguguguauggauguguauguugggucuaggaauggucuugugagcaggcagagcugggugacaggccucgcacugcuggcccuaccuguaacugggccuguugcugucuccuagcacaaacucucagagcccauccccacccagcaguuccauugccuacagccuccugagugccagcucagagcaggacaacccguccaccaguggcugcagguacgucgggugaggcuggaggagaggucugggggcccaggccacacucugggacuaaugucuuuaucucuuucuucccugugggccccgcagcagugaacagucagcccgggcaaggacucagaaggaacucaugacagcacuucgagagcucaagcuucgacugccgccagagcgccggggcaagggccgcucugggacccuggccacgcugcaguacgcacuggccugugucaagcaggugcaggguaaguggugugucccaagagggaauggccugggccugggcucccguguugaggcagccuccuuacugaaugccucacugccuccacucugcagccaaccaggaauacuaccagcaguggagccuggaggagggcgagccuugcuccauggacauguccaccuauacccuggaggagcuggagcacaucacgucugaguacacacuucagaaccaggucagcggcggccuggccucugcaucccgacgcaccccuacuccuucucccacagcucuugaaucugcucuugcucucccccuccugccaggauaccuucucaguggcugucuccuuccugacgggccgaaucgucuacauuucggagcaggcagccguccugcugcguugcaagcgggacguguuccgggguacccgcuucucugagcuccuggcuccccaggaugugggagucuucuaugguuccacugcuccaucucgccugcccaccuggggcacaggggccucagcaggugaggugcccaagcgcuguggggaggcaugagcagucccaggaaauuccugcugugaggggccggggaacccagacuuucccuuaguggauucuucgcagccuagggaaggggcaggaagcugugcucacuccucuccugucugucccagguucaggccucagggacuuuacccaggagaaguccgucuucugccguaucagguaggugaggggaacuggagaagaccucugccuccuuuuuuuuuuguuuuuguuuuuguuuuugcuuuuugaaagggagucucacucugucacccaggcuggacugcgguggcacgaucucggcucacugcaaccuccgccucccagguucaagcgauucuccugccucagccucccaaguagcugggauuacaggcaugcgccaccacgcccagcuaauuuuuguauuuucaguagagacgggguuucaccauguuggccaggcuggucucgaacuccugaccucaggugauccgccugccuuggccucccaaagugcugggauuaaaggcgugagccaccgugcccggccuaccucugccuccuccugcccccuccccagcgucuuugcuguugucugcugugaccuuauuguuggaggaguggguggcucucuguugaaagucccuaaugcuccucucuccuuugcuagaggagguccugaccgggauccagggccucgguaccagccauuccgccuaaccccguaugugaccaagauccgggucucagauggggccccugcacagccgugcugccugcugauugcagagcgcauccauucggguuacgaaggugggcaggucagggcccuggccuggugggggcugggaggaaggacauuuccucauggccagacaugaauuugggaggcaugaaccacacccuuugaauuuuggaacaagaaaagcuauuguaaagaugaggauuugagcuccucuuagagguagaguugaauaaggugcccaagcuagaggagggcagagaagaaugccuugcuugcucucagucauguuacugauacagggcauaggauuggcccagaccaucuuugggcccauagugcccggggcagagcuguguggcagaucaucagccagccugggcccaggcagaguggagggcugaggaguugggcauucuggacgaaacccagugaccacacucucugugccucagcuccccggauacccccugacaagaggauuuucacuacgcggcacacacccagcugccucuuccaggauguggaugaaaggugaggauaggaccuagaggagacgagggcagccagggcugaggccacggccacucugaugccuccuucccguucagggcugccccccugcugggcuaccugccccaggaccuccugggggccccagugcuccuguuccugcauccugaggaccgaccccucaugcuggcuauccacaagaagagugaguuccucucgcccugcucgcccuucccacuguccugggcuuuugaguggcugcccuugugguugugucucuuggugccuuggucuccuggaucucuaguggcauggccucccucuuacucagcucucccucccuuugaccgcuccuccuuucccacuuccaucaguucugcaguuggcgggccagcccuuugaccacuccccuauccgcuucugugcccgcaacggggaguaugucaccauggacaccagcugggcuggcuuugugcaccccuggagccgcaagguagccuucguguugggccgccacaaaguacgcacguaagugggccaugcccccgagcuggcguuggggauagggcagugcggugggggacaggaccgggccagggcuggauucacucuucacucuacagggccccccugaaugaggacguguucacucccccggcccccagcccagcucccucccuggacacugauauccaggagcugucagagcagauccaccggcugcugcugcaggugagaguagcggagagggagccugggaggugagaaaaggugugggaagccgggucaagccaucuaaccugcccucucccugcugcagcccguccacagccccagccccacgggacucuguggagucggcgccgugacauccccaggcccucuccacagcccuggguccuccagugauagcaacgggggugaugcagaggggccugggccuccugcgccagugagugaccugcuccuaccucacccucuaaucgcccuuuccccucuccuucuuggaaccagcacugccagucccagagucuugcccgauccuccuuugcccucuccuuccugccuuuuccuucuuguccugcucccaucaaggcgucugugccuccccacugguaccuucuuguuuuauugugcccuuggccccugacacuggcgacacccccugguucugcucacuguggugcugugucccacaggugacuuuccagcagaucuguaaggaugugcaucuggugaagcaccagggccagcagcuuuuuauugagucucgggcccggccucagucccggccccgccucccuggugaguugaugaugaugugugggugaagagacagaccugggggguccccugaccuucacccccaacccauuugcuguuuuuuuccaugugagcuugagaaggcuauuuuccucuuucucucuuugccccagcuacaggcacguucaaggccaaggcccuucccugccaauccccagacccagagcuggaggcggguucugcucccguccaggccccacuagccuuggucccugaggaggccgagaggaaagaagccuccagcugcuccuaccagcagaucaacugccuggacagcauccucagguaaggccugccaggcaucuucuccaccucgggcucuaacccugcccaccccaagcccugcucugaugcccugugcuguguccauccccagguaccuggagagcugcaaccuccccagcaccacuaagcguaaaugugccuccuccuccuccuauaccaccuccucagccucugacgacgacaggcagaggacagguccagucucuguggggaccaagaaagguaaagauccaaugcacccugcucccacugccccguccuggccugguggcccugugucuuuucccuucugcuucugggcccucuugcucugcccugcucuccuccccagccuccuggucuccagacuguucccucuguucccuaccaccauccccuuccccuuuucccugggauccucucuccugacuucccaguggggguggggaugguaacuggcaccaucucucugcacagauccgccgucagcagcgcugucuggggagggggccaccccacggaaggagccaguggugggaggcacccugagcccgcucgcccuggccaauaaggcggagagugugguguccgucaccagucaguguagcuucagcuccaccaucguccaugugggagacaagaagcccccggagucggguauggguguggaauuggggggcagugcuugggcuccaccggucucccagcuagagcucccuccugccuuuccccuccccucuagggccugauggagagaaggaggccucccuugaccuggggcuuggggcuacugcuucuugcucuccccucccugccaggcuucucggcuuugcccuuccccuguucugcuucucguauuguuacugucaguugaaacacagagucugggauagaggguuugcccugaggugcugaccacacagggucugaaggcaaggaaaauugaacaucccugaagggucuuuggauauugaccuugaaaaucaugaggggcugggcaugguggcucaggccuguaaucccagcauuuugggaggcugagguaggaggaucaccugagaucaggagcucgagaucagccugggcaacauggugaaacccuguaucuacuaaaaaugcaaaaauuagccgggcgugguggcgcgcgccuguagucccagcuacucgggaggcugggacaggagaaucgcuugaacccaggggguggugguugcagugagcugagaucgcaccacugcacuccagcuugggagaaagagugagacuccaugucaaaaaaaaaaaaaaaaagaaacaagaaaaugugugagggaaggccaaggggugggcuucucuuccaaugagaguugugacggggucaucccaguagaguuccuggcagggaguggccacuggaggggccugaguaucgucucuucuucugggccagcuuugcauggagaggaggacccagggccagccguuggcagagaggugaccaagaaacguacauggagaccaggcuuggcuguggggcagagcugccagggguuggcuaggcuaucagacagggagggugugguauggauguguugaccccugaagugguucugaugaccuuucccuaucucacucuccucagacaucaucaugauggaggaccugccuggccuagccccaggcccagcccccagcccagcccccagccccacaguagccccugacccagccccagacgccuaccguccaguggggcugaccaaggccgugcugucccugcacacacagaaggaagagcaagccuuccucagccgcuuccgagaccugggcaggcugcguggacucgacagcucuuccacagcucccucagcccuuggcgagcgagguagccaccuggggccuccuggagccugcccucugcccagucuaggacuggauuguuggggggugggucuuaagggagguguuucugcuccagggacccaggcugguguugcuuccaccacuaggcccugccuagggacaggccccucgcuagcuucuccccacuaggaugggguuccgggcugcagccagaggagggcagccuggggggauggcacugggaugggcaggcagaggugcugucuccagguaagcgacuucaggccuagccugggggcaggggcaggaaguaugcccacuuaggagucaguugucacugaugaagagacaugcauagauucugggccaacucuggguggggucugggcuucaagggcagguggaaggcagccccuccaggugccugagggagauccccugcaggcagacgcaggacucaggacugggcuuuccagccccacucuucacuccauugcaagcuaggcagaauacggccucgaugggcaggaggaaugccuaggcuggcagugcccacaggaguuuggcggaccagagccaucuguccauguguccauggacucacccugcuuccuccaucugccagcaugccuccaucuuccgcacacccccagcucgaccccucguguaaccucucccuggccuuguuccuuucucaauaaauccccuugucccuggcuccugugauucuucccugaaggugccccaccuccugagucccccguucuguguggguugagaagcucucucugggaccuuggccuguccucucccuggucagcgugucagggcaguguggguagcagggguacuaaccccagguugagguccuugcuaacccuagucucuccccacaggcugccaccacggccccgcacccccaagccgccgacaccacugccgauccaaagccaagcgcucacgccaccaccagaacccucgggcugaagcgcccugcuaugucucacaccccucacccgugccacccuccacccccuggcccaccccaccagccacuacccccuucccagcgguuguccagcccuacccucucccaguguucucuccucgaggaggcccccagccucuucccccugcucccacaucugugcccccagcugcuuuccccgccccuuuggugaccccaaugguggccuuggugcucccuaacuaucuguucccaaccccauccagcuauccuuauggggcacuccagaccccugcugaagggccucccacuccugccucgcacuccccuucuccauccuugcccgcccucgccccgaguccuccucaccgcccggacucuccacuguucaacucgagaugcagcucuccacuccagcucaaucugcugcagcuggaggagcucccccgugcugagggggcugcuguugcaggaggcccugggagcagugccgggcccccaccucccagugcggaggcugcugagccagaggccagacuggugagcacugaccccugcgucugccugccagcccccaccccagccccgccccucugccacccugugcugccugcugucucugccaggcuggcgucucagccuccaggagguggagggaguccccagcugaauuucugaaugaggcagaaauuggcuaccuccucuuugaagggacaguccugucugucugacagguggugaggacaucucaauaacuucugagagagcaucugucacuuggaaagggucuggccucacauccccacucuucgccagcuuucuucucucucagccuggcccuacugucacgaaguggggagcagagaccacugggguuggaugugccucuccccacaaccaguaagagcaguugaagggaggccuaggugcugaccccuccaucccuccuugccccccuccccuccuccaggcggaggucacugaguccuccaaucaggacgcacuuuccggcuccagugaccugcucgaacuucugcugcaagaggacucgcgcuccggcacaggcuccgcagccucgggcuccuugggcucuggcuugggcucugggucugguucaggcucccaugaagggggcagcaccucagccagcaucacucgugaguaccccgccuccagcaucucccaggguagggcagugauuggggagccgggagcccaggccccgucuuggcggagcuuccuaaggccacugggauggacauguggccuuugagggaggccuugugaggucccaggagugggcaugcagccggccugacucccauuggucugccccccacuucacaggcagcagccagagcagccacacaagcaaauacuuuggcagcaucgacucuuccgaggcugaggcuggggcugcucggggcggggcugagccuggggaccaggugauuaaguacgugcuccaggaucccauuuggcugcucauggccaaugcugaccagcgcgucaugaugaccuaccaggugcccuccaggugaggcauuucagaggccuucuuggccuuccuuucagagguaguagugggggcaguuuucuuuucuggggcuggcucugcccuggauaggauaaacguuucuaucuuucuuccugcuccuuggagcccuguuacuaguuccucccaggaggagagcagguuuccuggucuuggaagccuugaccucgcauagcacuaguuuaggggaggagcaugaggugggaagcugugguagaggaaggaugccagcuucauggguccugguccggguccuggaucccagccucugccuucugaaccccuucuugggcagggacaugaccucugugcugaagcaggaucgggagcggcuccgagccaugcagaagcagcagccucgguuuucugaggaccagcggcgggaacugggugcugugcacuccuggguccggaagggccaacugccucgggcucuugaugugauggugagagaagccugggacggggagaaaaaagaauugagcucaaguucaagggggagaaaaaagaauugagcucaaguucaagggggagaaaaaagaauugagcucaaguucaagggaucgaggccaagagcugaucuccuugauguccuuggaucauuaauucugaagaauguugauuccacuaaauuugcuguggauuauagaauauuaagccgcgugagucuuugcagaacuuuucacagccuauccuaugcuaauaugcauugugacuguccuguaacggcaucuggguagagggcacaaggcacuguccaaccuuguuggaccgcaggugcaucuguguggacuggugcuucuugggaguacauuucgggaagcacagugggcugggggugggaagcugcgcuggcagguuagcagugagaacccugucugacucucucauguccauuucucucaccaaggccuguguggacugugggagcagcacccaagauccuggucacccugaugacccacucuucucagagcuggauggacuggggcuggagcccauggaagaggguggaggcgagcagggcagcagcgguggcggcaguggugagggagagggcugcgaggaggcccaaggcggggccaaggcuucaagcucucaggacuuggcuauggaggaggaggaagaaggcaggagcucauccaguccagccuuaccuacagcaggaaacugcaccagcuagacuccauucugggaccaucuccaggaguccaugagaggcuuucuucuccuaugucccaauucucagaacucagauguggcuagaccaaccagugggaaacugccccagcuucucccaccauagggggccggacccccaucaccagccuaggauccaggggcugccucuggccucuuagggagcagagagcagaacuccgcagcccagcccagaggagugucaccucccaccuuuggagaggaauccuucccuccccuggacaaaguugcugacaagcugcugaaguggccucuccauauuccagcugagccugaaucugacucuugaggguuggggcugcacuuauuuauugcggggagacagcucucucucccaccuccuccccagaugggaggagagccugaggcccaagcaggacccggggguuccagccccuagcugcucuggagugggggagguugguggaccauggagucccuggugcugccccucaggugggacccaggcguucucagcuguacccucugccgauggcauuuguguuuuugauauuugugucuguuacuacuuuuuuaauacaaaaagauaaaaacgccca

SEQ ID NO: 34852 - RNA, 8740 nt, Homo sapiens
gcaggcaggggguucgugacgccggcugggucugggggcugugggccagccgagccgacccgggcuucugggggaccgcgggggccgugagcacucagagggcgcaucccaggccccuccggggacccggccagccugaagaugccgacgaacggccugcaccaggugcugaagauccaguuuggccucgucaacgacacugaccgcuaccugacagcugagagcuucggcuucaaggucaaugccucggcacccagccucaagaggaagcagaccugggugcuggaacccgacccaggacaaggcacggcugugcugcuccgcagcagccaccugggccgcuaccugucggcagaagaggacgggcgcguggccugugaggcagagcagccgggccgugacugccgcuuccugguccugccgcagccagaugggcgcugggugcugcgguccgagccgcacggccgcuucuucggaggcaccgaggaccagcuguccugcuucgccacagccguuuccccggccgagcuguggaccgugcaccuggccauccacccgcaggcccaccugcugagcgugagccggcggcgcuacgugcaccugugcccgcgggaggacgagauggccgcagacggagacaagcccuggggcguggacgcccuccucacccucaucuuccggagccgacgguacugccucaaguccugugacagccgcuaccugcgcagcgacggccgucuggucugggagccugagccccgugccugcuacacgcuggaguucaaggcgggcaagcuggccuucaaggacugcgacggccacuaccuggcacccguggggcccgcaggcacccucaaggccggccgaaacacgcgaccuggcaaggaugagcucuuugaucuggaggagagucacccacagguggugcugguggcugccaaccaccgcuacgucucugugcggcaagguagggagggcacagguggcgaccuccugaggggugcugggaccccccugcuucagggaggaggccgugggggucucacggggagugguaucgugucugugcguucacaugucuguucugggcuggggguccaugugggacauguguggccacucaggguguaggugggugggccucgggccaugcccaggcgacccccacugaggggugguggcuucagggucagaggcaaggguuccuggccuuucucagcauagcuggagaaugucucagccaagcccugggcagcugcggagucugagacuggagaggugugggccaggcgaugggcagugcccagcaggggcaggaggcccacagccuggccuggugccaugaggggcaugugggcaggaggcugugggggguccauaucuccccuucuuuuucuccaccccauuuucuggacuucauuuauuuauuuauuuuuugagacagagucucgcucugucacccaggcuggagcgcaguggcgugaucucggcucacugcaagcgccgccucacggguucacgccauucuccugccucagccucccgaguagcugggacuacaggcgcccgccaccacgcccggcuaauuuuuuguauuuuuuagaagagacgggguuucacuguguuagccaggauggucuugaucuccugaccuugugaucuguccaccucggccucccaaagugcugggauuacaggcgugagccaccgugcccggcugcauuuucuggacuuuaaaggaaauuggggaggagcccaggguagggcagggagcuggggaucgggcggggauagcaccaccacgugccugaccaguggagccucguguccucaggagugggggggcuuaaggucagcuccagugauggaggacacggugggcaggcagcuuuacccggggccugggcuccugguggggaggcaccucccugccccaguggggcguggccuggcucuccccaguucccaggucaccaguugccugucugugugacucccuccaccgccuauggggugaaccccagcaguuccuccuuccccacaagcugagcucugagggaaaagcccuggcccgggcagucacuacccaccugggcuccuggcuccaugcaccccagaguggcucggagguggucugaaaaggcgagguggggagagccgggugcauggagcuccuccucccaacucagguccuuccagaccagcaucagcugggcaaggagagcuccccugucuccuggcagcucccaggugcccaccaagcccccacccugacggauguccaggcccccuggguacacugacacucuggggccagauggcagaggccccacccugugcauggagaggggagcccagccauggcuaugggguccugcaccugcaguuggcauccucgggccugucccagcagugacagggucccaggagugagaauucaacuguggaugcacggccauggcccuuccuuccuaucacagcccacaguccagcuguaaugccugcuggccugggcccaggccgggcauguggcaauccuuaggugguuaaaggggguaagugggacaguggcagugagaaugcuuccuccauggaagccaaagacacuagaccuuuaggcauuuguauauggacagcuuggaaagcagacucaaaguggcagucauggccguggccguggcauuguggugugaugugcaugguggcguggaaguggaggugaggacgguggugacagugugguggcagcagcgacaaugauggugauggugaugaugguggugauggugaugaugguggugaugguggugaugguggugaugguggugauggugauaauggugaugguggugaugauggugauggugaugaugguggugauggcgguggugauggugaugguggugauggugaugguggugguggugaugaugguggugguggugauggugguggugaugauggugauggugaugauggugguggugaugguggugauggugaugauggugauggugauggugguggugauagugaugauggagaugguggugauggugguggugauggugaugaugguggugguggugauggugaugauggugauggugaugguggugauggugaugguggugauggcgaugguggugaugauggugauggcgaugauggugaugauagugauggugaugauggugauggugauagugaugauaauggugaugauggugauggugguggugaugguggugguggugaugauagugauggugaugaugauggugaugaugauggugaugauggugauggugaugaugauagugaugguggugauggugauggugaugauggugaugauagugauggcgaugauggugaugauagugauggugaugauggugaugaugauaauggugaugauggugguggugaugguggugguggugaugguggugauggugaugguggugauggcgaugauggugaugauggugauggcgaugauggugauagugauggugaugauggugauggugauagugaugauaauggugaugaugauggugauggugauagugaugauaauggugaugaugauggugauggugguggugaugguagugguggugaugauagugauggugaugaugauggugaugauggugauggugaugauagugaugguggugauggugauggugaugauggugaugauagugauggcgaugauggugaugauagugauggugaugauggugauggugaugaugauggugauggugguggugauggugguggugaugguggugguggugaugauagugauggugaugaugauaauggugaugauggugauggugaugaugaugaugauagugaugguggugauggugaugguggugaugaugaugauagugauggcgaugauggugaugauagugauggugaugaugaugauagugaugguggugauggugauggugaugauagugauggcgaugauggugaugauagugauggugaugauggugauggugaugauaauggugaugaugauggugauggugguggugaugguggugguggugaugauagugauggugaugauggugaugauaauggugacgauggugaugaugaugauagugaugguggugauggugaugguggugauggugaugguggugaugauagugauggugauggugaugauggugauggugaugauaauggugaugauggugauggugaugaugguggugauggugaugauggaggcaauggugaugauagugauggugauggcgauagugauagugauggugguggugauagugauggugauggugaugaugacagugaugauggugaugguggugauggaggggugcugacagagugguggagggauggggacuguauggaccauuuuucagucucuugauccucaaccacccugcaucugacccuaucaucccuuugaggggagaauccccuacucaagaccagcucccaucucccacuuuagaagcaggaagcagcagccacucgccucccugccuucaacagggcugagggugaggacccaaccaccagguguuucaggcucuggauuggcggccagggcuguagggagcgggacauggcaucucaguccuggggcauggaaccucacggcuuccaaggcagcugcagcguggguggugccauagcaucaccccuacccggccucuguggaguggcuacauggcaggcccuucaucgaggcaucucccuggcugggcggccccuaacccucucuuccccccugggaggggagugagcacccaggcuugcauguauccccccccaucggccagagccugcucauuucugccaacagacagcauggcaggcagugucugaugcugccaguaacagaaaacuggccacaggcuggcucaagcagugacacugaucaucuccugaaacgggaguccagagagcccugggcaugguggguucccaggcagccacuaucacccgcucagcagcuuccccggaguccuccguucuuaccuccucaccgaaccacucuccugggucagcucugaccucagccugacgcccucacgguaguaauguggcugcugguauuccaggccucacauccaggcaggacaaaguccagaggaaaaagaggcacuggcucugcuugugucuucauaggaguaagaaaacuucuccccuaaguccuagcagacacuucuucacacucauuugccagaacugagucccccaacugcucagcuagccccucuggagggggguaaaaccaguguugcccagaccaaggcggacuccacuccucuccuauuuugaggccauguccccggaagcagguggcugaaugaguagccccagacagcauccugucugaaggggguguggggcaacucuggggacaccaaagugcuggccugggaggugcaguggcggggggagcccugcgaugcuguggcuuccuucagugcccgcagggacggcguucccacaccucucaugggccccuccugcgggcuccugcugcccccggguaccgugucaguguugcccuccacugggcccaggcagcugcuuuuaguucaguauuugccaggaucuagagcugguggcaguggggaugcuggcacgaauacucggucacagugcaggggacaugccgggugcuccucugcgucugaucagugaugagugugagggagaucccagccuggggcgugaggggcagcuuuggggcuggcagaaggcaaaaggucccaagcugucuggcauggucacagccuggcauccucuccccugggcacagcgugggaugggaucuggccccacccucaggcccugugggggcucugcccaccacucccucccaguccccagcuggacaggccaccagagucccugggccuugugggaagcuccgcaaucugacacaccacucccagugucuggcugccaugcaaacagggaggugguuugugggaggagccagggacuuaguucacagaagauccuggguaggcucuggugccugcuguccccaugcugggcaugggugccccuccauccccucgcaggaaccccagauggagcccggggcagucuuguccucccccagggguccugggagaccaagcacagaugguuggggaaagcugcagaggugacagggaccagccccuggcuggagcccaggggugccccaucaccauccgcaccauccccuucauuagguccugccugugcccauccagcagcuuagggugaguuauaaauagaggcugggguaagcccugggucaagagagcagggcaaggagauuaccagcugauuacugauuagcagagagugggggcugugccaagcagaagggccuggcuccuggggguguggagggaggucagggcucccuuggggacagugugcaggguccacagacggcacauauggcccuggggcaggguucccagggucucugagaggugccuuccaaaucuucucaagucaagaggguucuagaugagacccaccucuggcuucaggggugccccccaaaauaugcccccuccccugcucccuacccaggagaggcgugaggggcuuccccaucuccucccuccaggggucaacgucucagccaaucaggaugaugaacuagaccacgagaccuuccugaugcaaauugaccaggagacaaagaagugcaccuucuauuccagcacugggggcuacuggacccuggucacccaugggggcauucacgccacagccacacaagugugagugcacacaucccuuccuccuccaucauccccauccccaccaucaccauccccaucaucaccauccccaccauccgcauccccaucuccauccccaccacccccacccccaccagccccauccccaugaccaccauccccaucuccaccaucuccaucaccaucaucgccauccccauccccaucaucaccaucccuaucaccaccauccccaucaucaccauccccaccauccgcauccccaucuccauccccaccacccccaccaccaccagccccauccccaucaccaccauccccaucuccaccaucuccaucaccaucaucaccauccccaucuccaucaccaccauccccaucaccauccccaucucuaucucuaccaugcccaucaccaucaucaccauccccaucuccaccauccccauuaccaucuccaccauccccaucuccauccccaccauccccaucuccauccccaucucugccauccccaccaucaccauccccaucuccauuuacauccccauccccaucccccucaccauccucauccccaucccccucaccauccucauccccaucuccaccauccccaucuccaucaccaucccccucuccauccccauccccaucuccaucaccaucccccucuccauccccauccccaucuccaucuucaccauccccaccaccguucccaucaccugcaccaucacucccaccaccaucacugccucggccaugaggauugccguagcagcucagucagaaaggaaagcccacuggggcaggguagcgccugaugguggugggugugucaguggagggcaggcuucugucccacuccuuggaaccugaggaggauggggaagugagacccugcacccccaucuccugcuguccugaggagaccuuuugcugcucccuccaguucugccaacaccauguuugagauggaguggcguggccggcggguagcacucaaagccagcaacgggcgcuacgugugcaugaagaagaaugggcagcuggcggcuaucagcgauuuugucggugagcacucugccugccagguacuggggcaggggcugucuccacccagggaaaggaccugcccagacaccccaucuccaccaagagcuggacccuccccagcccacggaacgggugcugucauggagucauacuugcuagucaagauaacucgucuuggcaagggaaacaggucugaauguccuuaucuccgcugcugggaacccccuaggcgccuugccaaggccgcacaugaggcaauggcaggccugggucccuaaguccagguguggcguuucccagggcccccaccccgcccggccuggacagggaagguggcgggaggggcagcgcagcagacgcucuccccgccaggcaaggacgaagaguucacccucaagcucaucaaccggcccauccuggugcugcgcggccuggacggcuucgucugccaccaccgcggcuccaaccagcuggacaccaaccgcuccgucuacgacgucuuccaccugagcuucagcgacggcgccuaccggauccgaggugcguggcggggcgggugggcacgcgggagcggggguggcagcgggcaggugggcacccccgccgacgccgucccgucccccaggccgcgacggaggguucugguacacgggcagccacggcagcgugugcagcgacggcgaacgcgccgaggacuucgucuucgaguuccgugagcgcggccgccuggccauccgcgcccggagcggcaaguaccugcgcggcggcgccucgggccugcugcgggccgaugccgacgccccggccgggaccgcgcuuugggaguacugaggccgcgcccagaccagccugucgcgcauuaaaaccgugucucucccgca

SEQ ID NO: 34853 - RNA, 8740 nt, Homo sapiens; identical to SEQ ID NO: 34852

SEQ ID NO: 34854 - RNA, 80291 nt, Homo sapiens; identical to SEQ ID NO: 6315

SEQ ID NO: 34855 - RNA, 99529 nt, Homo sapiens; identical to SEQ ID NO: 6316

SEQ ID NO: 34856 - RNA, 99529 nt, Homo sapiens; identical to SEQ ID NO: 6316

SEQ ID NO: 34857 - RNA, 200162 nt, Homo sapiens; identical to SEQ ID NO: 6318

SEQ ID NO: 34858 - RNA, 181665 nt, Homo sapiens; identical to SEQ ID NO: 6319

SEQ ID NO: 34859 - RNA, 288439 nt, Homo sapiens; identical to SEQ ID NO: 6320

SEQ ID NO: 34860 - RNA, 366299 nt, Homo sapiens; identical to SEQ ID NO: 6321

SEQ ID NO: 34861 - RNA, 363789 nt, Homo sapiens; identical to SEQ ID NO: 6322

SEQ ID NO: 34862 - RNA, 181665 nt, Homo sapiens; identical to SEQ ID NO: 6319

SEQ ID NO: 34863 - RNA, 367484 nt, Homo sapiens; identical to SEQ ID NO: 6324

SEQ ID NO: 34864 - RNA, 367484 nt, Homo sapiens; identical to SEQ ID NO: 6324

SEQ ID NO: 34865 - RNA, 366299 nt, Homo sapiens; identical to SEQ ID NO: 6321

SEQ ID NO: 34866 - RNA, 413663 nt, Homo sapiens; identical to SEQ ID NO: 6327

SEQ ID NO: 34867 - RNA, 366299 nt, Homo sapiens; identical to SEQ ID NO: 6321

SEQ ID NO: 34868 - RNA, 179780 nt, Homo sapiens; identical to SEQ ID NO: 6329

SEQ ID NO: 34869 - RNA, 366432 nt, Homo sapiens; identical to SEQ ID NO: 6330

SEQ ID NO: 34870 - RNA, 9030 nt, Homo sapiens
ugucuauaguaggugcggagaagaaauguuuggcagaugaagaaaaugaggugcagagaggauuuaagagauucucucuuacugccuguucagggucaguccagaauugagggucuccgggggagggcagaggcuuugcccugcaggggaucugugggaggggguuaggagggagcagaugagcccaggaugaauggucagagucaggugcugcccggcggaggucacgaguccagggaggggaucaacauggccgcugcaccccggacuguguugaucuccggcugcucaucaggaauuggucuggaacuugcagugcaacuggcccaugaccccaagaagcgcuaccaggguaagaagugcaggguggcacuaggaggcagccggguggaaacggcuuccccagcacugucuccccuacccaucccucccagcugcacuugugggcuuggggagacccaggauucccuccaggaaucauccccucauccuagaaauauuucuugagcaucuucugggugcucugaaugcuggcaacacaacuggagaugaaauagacaaaaaucucagcccucaggacgggugucauguggggaggagagggagaaugggugauaaacagauaaaaagaaauuguugcucuaucuggugggaauaagugcugagacacaaaauaaagcaugcugagaguggcaggggguggguggggguuauuuuuagaaggguuucacuagggcauuuccuagauuggaauaaucacuacccugaugcucacucuuccacgucuccccagauuauugcuuuuacugagauaagcuucuuaagugcuccugaccuuggggguugaagggauggccuucuaguucuaagaacuugcccuucugcaccucuagaauaaaucccugggaccugcauccuaaccaaccaggagaaccccugacccagagggagcaugcuggagucaaagugggcaaaggguuguuacuuacaaagaggcgacugggggugagggcauugccccaguuggcagggcugcuucucccagcccucugcccucuguuuuagagacgcacacagcuuugagcaugacagccugaaugccagugugcagggaauaacgugugucccuaugggcgggcagauggguguaugaaacugcuggaggcuaauguuuauggagcuuuuacaaugcaccaagcugcauucuaagugcccugaauccaggaagucauuuaauccucacaucacacccgugaggcaggcacaaucauucaccccauuuuauuauuauuuuauuauuuauuuauuuugagucagagucuugcucugucacccaggcugagugcaguggugcaucuuggcucacugcagccuccacuucccacguucaagugauuuucaugccuugaccucccgaguuucugggauuaaggcaugcaccaccacacccggcuaaguuuuuguauuuuuaauagacaagguuucaccauguuggccagaccggucucgaacuccuggucucaggugaucugccugccugggccucccaaagugcugggauuacaggcaugagccaccgugccuggccugcccuauuuuagaaaugaggaaacuaaggugcagacugugaaaggucuuugcucaaggucucccagcugcaaaguagcagagcugggauuugaacucaggcagcccaucccuugcacccauguuucccacuauaucacauguagaugcaagugaccccauucacgugccugcuacccacaaaucacacugacccgaagacaagaggcaaaugcccccaggaguguucaugggugauuaugggugcacacauugggggauaucaaacacguaugcuggugcaugugcagacauaguacauaugcugagguccugcuuaagaacauaagcuugaggcugggcacaguggcucaugccuguaaucucagcacuuugggaggccuagguggacagaucaccugagaucaggaguuugagaccagccuggccaacauggugaaaccccgucucuacuaaaaauacaaaaaauuagccaggcguggugguggaugccuguagucccagcuauucgggaggcugaggcagaagaauggcgugaaccugugggguggagcuugcagugagucgagaucaugccacugcacuccagccuaagcgacagagcaugacucugucucaauaaauaaauaaauaaauauacaaaaauuagccaggcaugguggcagugccuauaaucccagcuacuugagaggcuaaggcaggagaauugcuugaaccgggagacagagguugcagugagcugagauuucaccacuguauuccagccugggcaccaagagcgagacuccgucucaaaaaaaaaaaaaagggcauaaaagcuuggccaggugcuguggcucucuggcuccucacgccuguaaucccagcacuuugggaggaugaggugggcagaucaccugagguucgagaccaggcugaccaauauggugaaaccccgucucuacuaaaaauacaaaagauuagccaggugugguggcaggcaccuguaccccuguaaucccagcuacucgggaggcugaggcaggggaauugcuugaacccaggagguggagguugcagugagccgagauugcaccccuguacuccagacugggcaacaaacaagagugaaacuucgucucaaaaaaaaaauauauauauauauauggcuauucacuucaguguucauauaugcacauauguuggcuauaguuguguaugcauuuuuuucauggcaaucuguuuuauguuuauauauuuuauugucuuaccuacuaggcuauaaauuccaugaaggcagaaacuuuaucuuauuuauuuauuuauuuauuuauuuauuuauuuauuuauuuugagacagucucgcucuguugccaggcuggagugcaguggcgcuaucucggcucacugcaagcuccgccucccggguucacgccauucuccugccucagccucccaaguagcugggacuacaggcgccugccaccacgccaggcuaauuuuuuuuuuuuuuuguauuuuuaguagagacgggguuucaccauguuagccaggauggucucgaucuccugaccucgugaucugcccaccucggccucccaaagugcugggauuacaggcgugagccaccgcgccaggccgcccggccuuauuuuuuauuuuuugagacagggucucacucucucacccagacgguagugcaguggcuccaucucggcucacugcagccucaaccuccugggcucaagcaauccucccaccacagccucccaaguagccaggacuacaggugggggccacccaccacaccuggcaaauuuguaaaauauaauuuuuuuguagagaugggaucucgcuauacuucccaggcuggucucaaacuccuggggucaagcaauccucccaccucagcuucccaacgugcugggauuacaggcuugagccaccacaccuggugacuuuaucuuauuucaugccauagccucagcaccuagaauagggcauaguguauaguagaugcucaauaaaugucuguugaacucaugguuggaaggauggauauagguacguggagaugcguguacacaagugugcacuuguuggcugagugauaaauguagguguguaaacuugugaguuuccaucucucugugacuuguaacgcaagaucacagacacguggcgcccacaccaaggggaaaggagcucagugccugucccugcuuuacucucugccccgcagucguggccaccaugagggaccuggggaagaaggagacacuggaggcagcugcuggggaggcucuggggcagacccucaccguggcccagcuggacgugugcagugaugagucgguggcccagugucucagcuguauccagggagaaguggacgugcugggugagacuucacagccccugauucacuaagccccauccuggucugaguauagacccucaauauggcaaggucugagcaccagcucucuggcuucuucagcaaucucugaaccugggcagaagggguagaccaguuggccaagagggguagaccaguugguccuaccaauugauuuauuaagggcugggugcaguggcucauaccuguaauccuagcacuuugggaggccgagacaggaggauugaccagccucagcaaaauagugagacucugacucuacaaaaaaauuaaaaauuagccagucauaguggugcaugccuaaucccagcuacucgggaggccaaggugggaggaucccuugagcccaggaguuugaggcugcagugaguuaugacagagccagucuggggagacagaguaagaccuugucucaaaaauaauuuuuuuuuugagacggagucuugcucugcgcccaggcuggagugcaguggcgugaucucggcucacugcaaccuccaccucccagguucaagcaauucuccugccucgccuccugaguagcugggauuacaggugccugccaccaugcccagcuaauuuuuguauuuuucuuagagacgagguuucaccguguuggucaggcuggucucaaacuccugaccucaagugauccgcccaccucgaccucccagagugcuggaauuacaggcaugcaccaccacaccuggccaaaaaucaauuuuuuuugagauggaauuucacucuuguugccuaggcuagagugcaauggcgcaaucucagcucacugcaaccuccaccuccuggguucaagugauucuccugccucagccucccaaguagcugggauuacaggcaggcgccaccacacuuggcuaauuuuguauuuuuaguagagacgggguuucuccauguucaucaggcuggucucgaagccugaccucaggugauccacucaccuuggccucccgaagugcugagauuacaggcaugagccaccaugcccagcucaaaaaucaauuuuuuuaaaaaacaaaaauauuagagacacuaguaacaaucugaggccuggagguggggcagauuuuauggaauagaaauucucauauauggagaaagccauaugugguugggaaaauuacuuggaugagucacuuggggaagacagcaugauacagaaauaagucauaaggucccuaaccuucgcaggaaggugggugucgcugucuugauguaauuuggggucagaauugaauugcucauggauuaaggggggcacuauucccagcagcccuuccucccacucagggcugaggauccccuaugacaaaugcuaaacuguguuuaaagguuaccaagguuucauauuuguccacccaagauacccuggacuggccuuggacuuggaguacggggugaggugcuucagggagugucuagaaguaaugcuagaagagugagggacuuuaagguaacccuuaguaccucuucucuuagugaauaaugcuggaaugggccugguggggccccuggaggggcucagccuugcugccaugcagaaugucuuugacaccaacuuuuucggagcuguccgucucgucaaagcugugcuuccaggcaugaagaggaggcggcagggccacaucguggugaucagcagugucaugggccugcagggugagcuguggggacccaacccuggaaaucccaccagugucugauccuccccagacugggaggauggcgaauggguuuuagaucauauucuaaauuagcauggacccugggcacggugauucaugccuguaaucuuagcacuuugggaggcugagacggguggauugccugagcucaggaguuugagaccagccugggcaacauggugaaagcccguuccuacuaaaauacaaaacaaucagccaggcaugguggcaugugccuguaaucccagcuacucaggaggcugaggcacgagaauuccuugaaccugggagguguagguugcagugagccaagaucgugccacugcacuccagccuaggcaacaaagugaaacucugucucaaaaaaaauaauaauaaaauaaaauaaauuagccuggagaauuguguucagaaggauucugaaguucagaaggaaaaaguggccagacauggugacucacgucuauaaucccagcacuuugcguggccuaggcaggagggcuguuugagcucaggaguuugagaccagccuggucaacacagggaguccucaucacuacuaaaaauuuuuuuagaauugggccaggcacggugacucaugccuguaaucccaacacuuugggaggccgaggcagguggauuacccaagaucaggaguucaagaccagccuggccaacauuaugaaaucccaucucuacuaaaaauacaaaaaaauuagccgugugugguggcacacaccuguagucccagcuacucggggugcugaagcaggagaauugcuugagcccaggaggcagagguugcaaugagcugagauugcgccauugcacuccagccugggcaacaagagcaagacucugucuaaaaaaaauaaauaaauaaguaaacaaacaaacaaacaaaaaacaacaacaaaacuuuggccagauguggugguucaugccuguaaucccagcacuuugggaggcugaggcugauggaucacuugaggucaggaguuggagaccagaauggccaacauggugaaacuccgucucuaguaaaaauacaaaaauuagcugggugugguggugugcaccuguagucccagcuacucaggaggcugaggcaggagauucacuugaucucaggaggcagaggcugcacuccagccugaacgacagagugagacuccgucucccccccgccaaaaaaaaauuaaauuaaauaaaaaaaucagccaagcauccuagugugugccuguagucccaguuacucaggaagcugaagugggaggaucgcuuaagcucaggaguucaaggcugcagugagccaugauugcaccacugcaccccagacugcagaacagagcaacaccuuaucaaaaaagaaaaagaaaaagagagagagagagaaggaaggaaggagggagggagggagggaggaaggaaggaagggagggaggaagagagacaagggcccuaaugaagagaaaaaugaaggggauccccaagcggccccaaagguuuagagaauggagggaaauaggggaguuuccugggaccagguggagcugggaggagguggcacccggcacccgagaacaaccucuuucugaccccauaugaccccaucacacaaugccauacacccaucaucuuggcaccauguaucugcuuucucugguucccacauccucuuugcucugucucccaaagaccccaucacccuggaacccacaaagcccaccucccagacccucaaagagcucuccucccucugacccucacaggugucaucuucaacgaugucuaugcagcuuccaaguucgcccuggagggauucuucgaaagccucgcuauccagcugcugcaguucaacaucuugugaggcgggcacgugggcagagggggcuuggagccagugauggggagguggcaucgaaagggggagaggagagaugaagacaaugaagcugagugcaguggcucacaccuguaaguccagcguuuugagaggcugaaaugggaggaucgcuugaggucaggcauuugagaccagccugggcaacauagcgagacccccaucucagcccaaaauuuaaaaauuagccaaggguggugguguguguaccugcagucccagcuacucaggaggcugaggcggaggauuguuugaacccaggaguuggaggcugcagacagcuaugaucaugccacugcacuccagccugggcaacagagugagacccuguaucuuaaaaaaaaaaaaaaauggacaaaauaggucagggagugguuggggcaucagacuuacacuacccaugccuggucgccagcaucucccugguggagccaggccccguggucaccgaguuugaggggaagcuucuggcgcagguuucuauggcugaguucccaggcacugacccugagacccugcacuacuuccgggaccucuaucucccagccuccaggaagcuguuuugcuccgugggacagaacccacaggacgugguucaggugagugaagggcccagagccccaagacguggcucagguauguugcggggugaggcccucccugggucccagcgcucagggccuccauucugcaggccauugucaacgucaucagcucgacucgaccaccccugcgccgacagaccaacauccgcuacucgccgcugaccacgcucaaaaccguggauuccucuggcagccuguaugugcgaacgacccaccgccuccucuuccgcuguccacgccuccucaaccuuggccuucaaugucuguccugcggcugccucccaacgcgggugcggccaagaugagcagaacagagcuucacgauccccaucccugaacaaccagaccucuucauuccacaucuaauucaaaggaugaacagacucuucauuuauucauucugcaaacucccccuccccuccucugugccuagacauggcuagaaucccagaagggccuuuauuuucaggcauagacuccucuguggucacagcuggagcacagagagggacccugggaacuuggccugggaagcccagagcaggaagccacagcugucucugggaaagcaagggaggcuuccuggaggaagcggcauuguuaugagccuugaaggaagagacagacucugcuacauucaaccucgugacuucaugauccugggccugagaacacaggaaugauucauagcccaccccccaccuccaugcauacaccagagcucuguggaccaaggggucauuccuggucacacacuccaucagcaaaauguauuugagcacacaccagcaauguauguauauuuuuuccauuaaauauauauuuauaaccaca

SEQ ID NO: 34871 - RNA, 5492 nt, Homo sapiens
ccggggaccacacgccgcgcuguccccagcacccaacccagguuaccauggccucccuguucucuggccgcauccugauccgcaacaauagcgaccaggacgagcuggauacggaggcugaggucagucgcaggcuggagaaccggcuggugcugcuguucuuuggugcuggggcuuguccacagugccaggccuucgugcccauccucaaggacuucuucgugcggcucacagaugaguucuauguacugcgggcggcucagcuggcccugguguacgugucccaggacuccacggaggagcagcaggaccuguuccucaaggacaugccaaagaaauggcuuuuccugcccuuugaggaugaucugaggaggugaggaggggcagggagggcuuccuggaggagggggcauguucgcugaaagugaagcauccauucuaacuagagugaaugagcagccccugugugccaguccauauacugggaacuaggggguacagacaggggugcccacuuccacaugcuggcuuccaugccaccccagggagcuuagagccgagugagaggaacagaugcaaaagacagaaucaacuauguaauagcaaggccgggcaugguggcuuaacccuguaaucccaggacuuuggcaggccgaggugggcagaucaccugaggucgggaguuugagacaagccuggucaacauagugaaacccugucucuacuaaaaauacaaaaauuauccaggcgugguggugggcgccuguaaucccagcugcuugggaggcugaggcaggagaaucguuugaaacugggaggcagaugcugcagugagguaagaucgugccacugcccuccagccugggugacagagggagacucugucuaaaaaaucaaaaaacaaauauauaauagcgaauugcaguagugcucagaggacaaagcuaggccacaaaguggaaauacaaugagggaaaccuuggugagguuccggggucagaggaugcuuccccgaaaaaguggcuuuaaagagagaccccuagcugggcacgguggcucaugccuguaguccuagccaccugggaggcuaugguaagaggauaacuggagccuagaguuugaggcugcagugagcuaugaucgcaccacugcacuccagccagggcaauacagguagacccugucucuuaaaaaaguaaggccagguacgguggcucacaccuguaaaucuagcacuuugggaggccaaggugagcagaucaccugaggucaggaguucgagacuagccugaccaauauggcaaaacccugucucuacuaaaaauacaaaaauuagccaggccugguggcgcacagcuguggucccagcuacuugcgaggcugaggcaggagaauugcuugaauccaggaggcgaaaguugcagugauccgagauggugccacugcacuccagccugggcaacagagugagacucugucucaaaaauaaaaauaaaaaauaaaaaauguaauaaauaaauaaauuacagggagacuccaaugagaagaaagauaggaggauggagaaugaggaaagggaagggguuccaggcagagggcacagcagaaaggcuuggaggcugucagagaaagaacaaccaguucagggagacuguagguaauuccggagaggaucaaauuuacaauguuauuguuacugcccacgcauuugucauaaucuucuuuagaugugacaggucuguggugcagagccaccuuaacaaguauagacaugauccucagaguagcagggagccaugguggacauuagaacagagggagagguagucggauucaagcuuuauaaggagauguccagccaggcaugguggcugacaccugcaaucccagcacuuuuggaggcugaggcaggaggauugcuugaggcugggaguugaagaccagcuugggcaacacagcaagacaccaccacucccaucucuaaaauuauaaaaaagaaaaauuaugaaagguggcuuggugcgguggcucaugccuguaaucccagcacacuuugggaggccgagguggguggaucacgugaggucaggaguucaagaccaaccuggccaacauggugaaaccccgucucuacuaaaaauacaaaaauuagccagacguaguguuggguaccuguagucccagcuacucaggaggcugaagcacgagaaucgcuugaacccgggaggcggagggugcagugagccaagaucgcaccacugcacuccaggcugagcgacagagcaagacucugucucaaaaaaaaaaaaaaaaaaaaaaauuaaaaagauccuuuaaaaaaauuuacaaaaggagcugcccaaugaaacaguauuauagcuugacuuuuuauuaugaaaaaaacguucaggcugggugcaguggcucacgcuuguaauccuagcacuuugagaggccgaggcgggcggaucacgaggucaggagaucgaaaccagggugaaaccccgucucuacuaaaaauacaauaaauuagccgggcgugguggcgggcgccuguagucccagcuacucggagaggcugaggcaagagaauggugugaacccgggagguggagcuugcagugacccgagaucgugccacugcacuccagccugggcgacagagcgagacuaugucacaaaaaaaaaaaaaaaaagaaagaaagaaaaagaaagaaagaaaaaaaauguucaaacauagcaaaaaguugaaagaaguguacaaugaaacccaucgcaauuguuaacauuuugccauauucacuuugucuacaauacaaauacgugucuauagacacauauacacuuugucuacaauaaaaauacgugucuauauacacguauaugcauacguguauaguuugugcuaaauuauuugaaagugaguugcagacuucaugacauuuucccaaugucaugccuuuuguuacucaacaaguuggaaguuucuggucaucaucagaauuuggacaucaucagaguuuggacacugaauccugcccacugcccucggcagcugaggagauuccucccugacgcuagcaacgcuuccuucccuggggcagagacgccagcugcagacaaaugcugaccuucucugagacaggguccucucaacaaaacauucacccagacuaguauguuaucugggcaguucccauuccacaucccccguagacgggauguccaguuaaaugaaauuucaggcugggugcagugguucaugccuguaaucccagugcuuugggaggcagagauggaaggaucaguugaggccaggaguucaaaaccagccugggcaacauagcaagaccauaucuuuacaaaaacuuaaaaaaaaaaauuagguguggugguacgagccuguagucccagcuacuuaggaggcugacgcuauaggaucacuggagcccaggaguuugaaguuaccacgaucuguguucccgccacugcacucuagccugggugacagauggaggcucugucucuaaaaaaaagaaaaagaaaaaaaaauugagauaaacaaugaauaaucuuucuuuaguauaaguaugucccaugcauuuggcuauacuuacacuaaaagauuauucauuguuuaucugaaauucaaauuuaacuaguguauuuauauauagaauagagagagauggggucucguuauguugcugaagcuggucucaaaccguugggcucaagcaauccucccaccucggccucccaaagugcugggauuacaggggugagccacuguacccagccuccaauuuuuuuuuuuuuuuuaagagagggagugucauauauauauguuguuuguuguuguuguuguuguugagauggaguaucuucgcccaggcuggagugcaguggcgugaucugggcucacugcaagcucugccuuccggguucacgccauucuccugccucagccucuccgaguagcugggacuacaggcgccugccaccacacccggcuaauuuuuuguauuuuuuaguagagacgggguuucaccguguuagccaggauggucucgaucuccugugagugucuuauauuuuuaauuacuaaaccuggcaaucuacucaugggauuuuguaaguaucauggguucucuuuguggcagccuggaaaagggccacggaagaaugcagcaggcugaaauuaagaacuguuaaccauguuggcuaggcuggucucgaacuccuggccuccggugauccgccuaucucagccucccaaagugcugagauuacaggcaugagccaccacgccggccaagcaggagaaauuuuaaaaaccauacaugauguugggugcugaaaggcacuuuggagaaaaacacugccuuggaauguuauuuauucuauuuucgagacaggaucuggcugugucacccaggcuggaguguaguggugcaaucauagcucacugcagccucgaaauccugggcucaagggauacuucucgagggaagucccagguaccucggccuccugaguaccugggacuacaggagcgcaccaccacacccugcuuuauuuauuuauuuauuuauuuauuuauuuauuuguagagacagggucuuacuacaaauaaauguaguaagaccuugugucuugcgaugugaggucuccauacuacagggucuuagccugcaaaugucugaggagagcgcuccagacgugggcacagccagcacaaaugccccgagguuggagcaugccuggggugcuggagacaaagcgcggggaccaaagugucuggcccugucccgguccucgugugcaccuacccagugcccggcaagaggcagugcacacagaaggcgcugccuaaguacugggaggagggauguggggcucucugguucagcaucagggauguggauccguccagacugaccugcccgcuccgcagggaccucgggcgccaguucucaguggagcgccugccggcggucguggugcucaagccggacggggacgugcucacucgcgacggcgccgacgagauccagcgccugggcaccgccugcuucgccaacuggcaggaggcggccgaggugcuggaccgcaacuuccagcugccagaggaccuggaggaccaggagccacggagccucaccgagugccugcgccgccacaaguaccgcguggaaaaggcggcgcgaggcgggcgcgaccccgggggaggggguggggaggagggcggggccggggggcuguucugacccgcuaggguggaggagaggagugggguuuguugaugaaccuccacccccaccccacccccgcacgccuguaaucccagcacuuggggaggccaaggcgggaggaucgcuugagcccagagguucgagaucaaccugggcaagagagugagacccugacucuacgaaaauuaaaaguuagcccggugugguggcgcgcaccuguggcuuagcuacccugaa

SEQ ID NO: 34872 - RNA, 21490 nt, Homo sapiens
ccaccuuggccgggauuacccuccgaguuccaggccaugacaaaugacaucacucccggcccaggcuuaaaaucuccccaugugaggggauguguuuccuucagccucugcugucuggccgcucugucuagguccugggccacgggagagccccgucccuccuuucugaaggugagcgucugcaggagaggcggaggggaccgaggaggggagaaaaaagagaggggagaaguuggguuuaucuuauucguggcuguguuugccgugcucugcaggugauguuugcugaauagucacacacaaaacagaggugccguccuggcauuuguggaaacggggcuaggcugugauugcagcaggagggaguaagguuagacagcagggacuggcugauggcacucggggcauugggaggauucaggguggcuugugggcaaggggguccccucaagcccugacggcauccgggguugggggcuucucaccgugguucuaaggcaacuccucagcauaccgcucuguuggauguucuuuaaaacucuuagcacugccugaaauuuucauuugcgcgaugauccacaaauggccugucucccucccuuguugagcacugauuuuuccccagugcccagcgugugguugggauuugccuaaauauguguugcauagauggauggaugaaugacagacaagggacggaacagacauauacgcagagagcccaggucuguggcugcaacaggaagaacuccggguggacuugggccugcccgagagagccaggaaugugaugacuggggaucacugugcuggugaauugaucacuuagggccucaaugcacccagaggcucuggcuuucagcccaggcucuacuucgggacuggggaauccucacgcccccgcccucuuagcuuccagcacagucacucucucugaucuucuuucugcaaaguuuuuuuuuguuuguuuuugagauggagucuugcucuguugcccaagcuggagugcagugccacgaucuccacucacugcaaccucuaccuccuagguccaaggaguccauccaccucagccucuugaguagcuggaauuacaggcgcgugcccccaugcccagcuauuuuuuguauuuuuaguagagauggggggucucuccauguuguccaggcuggucucgaacuccugaccucaagugaucagcccgccugagccucccaaagugcugggauuauggguaugagccucugcgcccagccggucuccugcaaaacucuugauugacaccuuguuucccgucugccccugucaggagggcugaggccuugucugucuugcucucggcuguauucccagugcuugggucaguccuagacacacagugagugcucagugaauaugcagggaaugaaugaaugaaugaagggcagaaggguagaagcagguagacagacugccacagagaggaggugugaugcgguuuucccaaaaggaacgagcgagggcugugauugccacagagugagguccgacuucagggcugcccacugugugugaauuucuggaugcuucagggaucacauuguugaucacggaguugauuugcucaggcucuaacugugccguggaucccagcuucccccaggucucauggccggcagugggugcauccacccagcuccuuguccccgcuggacagaggagccaacagaggcugcagagagaggcuggaguggcugacaagggagggcccugaauguggcugagcugggagggucuugccaagggcuggcaugaagccacaugagucugguuuuuuuuuuuuuuuuuugagacggagucucacucuguggcccaggcuggagugcaguggcaugaccucagcucagugcaaccuccaccucccagguucaagcgauucuccugccucagccucucaaguaucugggauuacaggcgugcaccaccaugccuggcuuauuuuuguauuuuuaguagagaugggguuucaccuuguuagccaggcuggucucaaacuccugaccucaggugauccaccugccucggccucccaaagugcugggauuacaggcgugagccaccacacccggccgagucugcguuuaaaucuuguucuuuucucacuguguggccuuggaccccucaugugggcucucugggccuugguugccuccucugcaaaguggggacaaugauaagcugucaccaugauccagccagaugagccauauugcaggccuggccugcagugggagcagggcaggagaccagccucauucuguuucuagggucccuagguagacuugggggugaagagcggggcucgggggccaaagagauuuaaauuuuaccccugguucuuccacucaucaccugugugaccucgggaauugacgaaaccucuuucagccucaguuuccuccucugagaaagggaccucugagcuccguggggcuguggggagcauccuaagaggccauaucgccgggugaucaggagggcaccggcuccggggcaggugcuggcccagcucuggcucugccgcugacgugcgagacagaacuggagacuacacuucucucagccucaguuuccuucucuguaaaguggggaugauaccagaagccgccugggaggaaguuuccauggaguuacuguugccugagaucuuguucccaagguccauggugcaugcagugugugagaagcuggggcccccuggagguccuuaaggucaucagccaccugaacugugggcaccucccucccucccaggcucagucucccccgcuguagaauggaguuaucugcaugucugccccaccagguggcugugagcauucagaccucaccugugggaacaacugcucagcugggaaccugggacccagugagugccgaaccccacagcucugagaaucagccuggggccucccagguugauccccagggcagagacacugauauucuuuguuccaccccuugaaaucauaaaacaucagugucuggaaauuguugucauugugagaucuuguauauaaagccugggccaagugucugccgagugaugaauuccuggacauucuuuuuuuuuuuuccuccccaggagacagguccucuuucgauugauugauuuuuuuuuuuuuuuuuugggauggagucgugcucugucgcccagguuggaaugcaguggugcaaucucagcucacugcagccuccgccucccgaguucaagagauuuuuguaccucagccuccccagaagcugggacaacaccaugcccggcuaauuuuuguauuuuuaguagacgggguuucaccacguuggccaggcuggccuugaacuccugaccucaagugauccgccugcuucagccucccaaagugcugagccacuggccuggccuguuuuguuuuguuuugagagaggaucuugcucuguugcccaggcuggagugcaguggcuggaucauagcucacugcagccuccaacuccugggcucaagcgaucuucccaccucagccucccagagugcugggauuacagguacgugccaccacgcccagcccucacuggaggcccuucugucaucagcugccucagguugcugccaaacccagggaaagauuucaguggauguucaauauuauuauuguuauuauucucugcugacaucuugucuaggcagcacuuuaucauuauuaucagcuguuugaucuggggcccacacuuuccuccugcugagccuccucuccccuauccguuaaaagggaugauccuggccaggcacuguggcccacgccugugauuccagcacuuagggaggccgaggugggcggaucaccugaggucagaaguuugagaccagccuggccaacauggagaaacccaaucucuacuaaaaauacaaaaaaaaaauuagccaggcaugauggcacaugccuguugucccagguugggaggcugaggcagaagaaucgcuugaauccgggagguggagguugcagugagccaagauugcgccacugcacuccagcaugggugacagagacuccgucucaaaauaacaacaacaacaaaaacaaaaacccagaaaguggugaucguaaaugugagcuuucuuggcuuuccuggaagguuaacugcuuagccaggcaaucugacucagauuugacggcgaagacaaugaaagugugugcuuuuguuccaggcccugcaaaugguccccaguggggcagguucaccaguuuccuugucuccacucucuggagguucauauuuaacauuauugguuuuuggagaagugggagaggacagagggaacccagguuagggggcugggggaauaggaccuucaggaauuacucuagccuugaaauccuggauucuccacugccagccugugugugaucccggguaagucacacuuucgagccugaagauguucucuaaacuguaagcaucaggcaaaagcagugucucaugccuguaaucucagcaauuugggaggcugaggcaggaggaucugcucaggccaggaguucaagaccagccugggcaacauggcaagacaccucucucuacacaaaaauuuaaaaaauuagcuaggcguuguggcacaccuguagucccagcuacuugggaggcugaggugggaggauggcuugagcucaggaggucgaggcugcagugagcuaugauugugccacugcacuccagccugggugacagagugacaugcugucccuaagaccaaaaccaaaaccaaaauguaagcaucauaguaauacagucucuaccucccaagguugugcuggggauuuaaugacuaccuguauagagaaggcuuguguauuaguuaacuauugcuggguaacacuuauccuaaaauugagcagcuucaaacaauaaacauuucugaucucuuauaguuuccaagggacaggaauccaagaguggcuuaacuggauuauuccggcucaggguguuccaugugguuguggucagaugucggccaggacugaagucacuuaauggcuuggcugaggcuggggaacuaaccuccaugguagcuuacucucauagcuguuggcaggaggccucauuucuuugccacauagaccucuccgugggauggcuugagcauccucacaacauggcggcuggcuuuccuuagagcuagccuuggaagccacgcucugucauuucugcaauauccuguugguuacacacgucagccagcuuguuaguagggacuacacagggcaugaauaucaggggguaaggauuauugggaguuaccuuggaggcaguuugauuuuggggauuuaauguagcugcuuuugauuuuauugucagcacugagccuucucgugacauuccuaccagguuuuacuuguucuuucugcuuuucuccaugaucaaucugcuauggucacacagggugccuuguuucuucuccaacaagaccaaguuggagacccugucuugcucagggugacggugugagauuccagccuccaagccuuugcaccugcuguuuuuuuaauuuuuuuuuuuugccuggaaaucucuauuccagauccacacaaauuccuagaugccucacccaccccaaaugccuucacucucauaacaaccuguuuuauuuuccugggaguucuugaaacuuucugaaggcuuuuuuuuuuuuuuuuuuuuugacagagucuugcucuguugcccaggcuggagugcaguagugccaucucagcucacugcaaccuccgccucccggguucaagcgauucucaaguaguugggauuacaggcacccaucaucaugucuggcuaauuuuuguauuuuaguagagaugggguuucaccauguuggccaggcugaucucaaacuccugaccucaagugauccucauaacucagccucccaaaguguugggauuacaggcaagagccccugcuccuggccauggcaucuuuauuaaaaaaaaaaaaaaaaaaaaaaaaaaaaaaaaaaaggcagggcgugguggcucacgccuguaaucccagcacuuugggaggccgaggcggguggaucacaugaggucaggaguucgagaccagccuggccaacauggugaaaccccaucucuacuaaaaauacaaaaauuagccagguaugguggcaggccccuguagucucagcuacuugggaggcugaggcaggagaaucacuugacccugggaggcagaggcugcagugagccgagaucaagccauugcacuccagccugggggacaagagugagacuucaucucaaaaaaaaaaaauuuuuuuuuccuuguuuguuauugguuucucuaggaacggaaccaagaaguucaauucuaugagaacagagaagcugcggucuuauuucuuccuauauuccuaguuccuagagcagggaaggcauucaaaaaauauuuacugaaugaacaguagaaucucaacuuaaaauaaacagaaucugucccccuccucaugugagggaugagaaggaaaggacagugagaggaacggaagagugggagcucacaauaaacaccauccauuuuuaauucuuuuucuuauguuucaaauauuuauugggggugcuggggacauggcaggaaccgagauauuaccagucccugaacucagguaacugauagaauuugagggagagagauagauaaacaaacauauaaauaugucguuuaauacaagcugugucuugaagaaaaggagguagggagcguguguguguguguguaaaauccaguuuaggggcguagguugcuuucucuggggaaaguagcugagcugagacguggaggagaagggguuagcuggugagaggggcuuuggggugggggagaggcguuccuagcccaggaaacggcuuaugcaaauagcuguggagggugagagguuuucugaguccauccuaaugagggcaaugaggaacccucagaggguuuucauguucuguuugcuuuuuugaagauuuuauuguuguuuuugcuuuugacaagaacacacacacacacacacacacacacacacacacacacacacacacacaauuaaaaaguaauccaaacuauagagacaagauauggcuuuagcauuccuucccagaggcagucacuggugccaguagcuugcuuccuuccugggaauuuucuacgcauauacaaguguauauucuacacaugaguaaaaucaaugccucauuuuguuuauuaauucauaauuauaauacuuauuauuuuugagauggagucucacucugccucccaggcuggagugcacuggcauaaucucggcucacugcaaccuccaccucccagguuccagagggucuccugccuccgcuucccaaguagcugggauuacaggcaugcaccaccaugccuggcuaauuuuuguauuuuuauuuuauuguauuuuuauuuuuaaauuuacuuuauuauuaugacucuuuuuuugagauggaguuucgcucuuguugcccaggcuggagugcaauggcgugaucucggcucacugcaaccucugccucccggguucaagugauucuccugccucagccucuggaguagcugggauuacaggcgcccaccaccacgccugccuaauuuuguauuuuuaguagagacaggguuuugccauguuggccaggcuggucuugaacucuugaccucaggugauccaucugccucggccucccaaagugcuggcauuacaggcgugagcaacugcaccuggccuauuuauuguuauuauugagacaaggucuuccucuauugccuaggcuggugugcgguggcaugcucauagcucacugcagucuccaaauccugggcuccagugauccuccugccucagccuccugaguagcugagacuacaggugcggaccaccaugccugaccaauuuuuguauuuuuuuuuuuguggagacagcguuuugccauguuacccaggcuggucucgaacuccugggcucaagcaaucugcccaccuugaccucccaaagugcugagauuauaggugugagacacagcaccuggccaucugcauuguuuuaaaaaucacaaaugguugcgagguauacauacugcccagcaccauacuuguuuccuuugaauauauaaauauuauaauuuuauaauauuuauaauauauaauaacacaaauaauaauaaauauauaugguuuggucauauacaauauauaaaauaacauucacaaacacuuauugucaaagugcaauuaaaugggaaaaaaagaaaaacauuuggccaggugugguggcucaugucuguaguccuagcacuuugggaggcugaggugggaagaucacuugagcccaggaguuggaggcugcagugagcuauggcaacgccgcugcacuccggccuggaugacagagggagaccuugucucuuaaaaaaccccaaaaaacaaaucugauucucugacgcauauauaauaagcacaggucaaagauuuauuuaagucaugaaugaaggaaccagcuguuucaaaggagaauuugggccgggugcaguggcucacgccuguaaucccagcacuuugggaggcugagguggguggaucacgaggucaagagauugagaccauccuggccaacauggugaaaccccgacucuacuaaaaauacaaaaauuagcugggcgugguggcgggugccugaggucaggaguucgagaccagcuuggcuaacaauggugaaaccuugucuuuacuaagaauacaaaaaauuagcugggugugguggcucaugccuguaaucccagcuacuugggaagcugaggcaggagaauaacuugaacccaggagguggaguuugcagcaagccgagauugugccacugcacuccagccugggcgacagaacaagacuccauuaaaaaaaaaaaaaaggagaauuugaugaacagaaguugauagguuuagucaggaaagacgggcuggagaaaauuugccagguuagauacaaaacugguuaaagaccuacaggacaauacaacuguaaccuuugagguuaccuuuucuaccagagagaaaucauuugcaaccaaacuuccugggguuaccauuuaccuugucgaagucuagacucuaaucaauaaugaauaacagaccggguguaguggcugacgccuguaaucccagcacuuugggaagccgaggcaggcggaucacgaggucaggaguucgagaccagccuggccaacauggugaaaccccgucucuacuaaaaauacaaaaauuagccgggcaugguggcgcaugccuguaaucccagcuccucaggaggcugaggcaggagaaucgcuugaacccaggaggcagaaguugcagugagccgagaucgcgccacugcacuuuagccugggcgacagagcaagacucugucucaaaaaaaaaaaaaaaaaaaaagaauaguaaaucaaauacagguacagucccuuagaauaggguccccaacccccgguuuguagucuguuaggcaugggguugcacagcuggugagcaagcauuacugccugagccccgccuccugucagaucagcgguggcucuagacucucacaggaacgugaacccuauugugaacugcacgugcgagagaucuagguuguacacuccuuaugaaaaucuaaggcacugcccacucccauccauggaaaaauuaucuucuacgaaaccaguuuuuggugccaaaaagguugaggacugcugccuuggaauaugaagcaaacuuugggugggucuguuagacaagacucccagaugacuuggaaauggcaugcugucagcuuuuuuugucuuauugccgagccuagaacuuuuuuuaauuuuuauuuuuuuugagaugaagucuugcucuugucucccaggcuggagugcaguggcacgaucugggcucacugcaaccucugccucccgggcucaagcgauucuccugccucagccuccagaguagcugggauuacaggcgccugccaccacgcccggauaauuuuuguauuuuaguugagacguuucaccauguuggccaggcuggucucgaacucccgaccucaggugauccgccugcuuuggccucccaaagugcugggauugcagaugugagccaccacaccuggccccuagaacaauuuuuuaaaacuauauaauggagaucuuuuaaaaucaguucagagagcagccuuauguuuuuuuuuuuuuuuuuugagacggagucucgcucugucgcccaagcuggagugcaguggcuugaucuuggcucauugcaacuucugccucccggguucaagcgauucuccugccucagccucccgaguagcugggauuacaggcacgcgccaccaugcccggcuaauuuuuguauuuucugcagagacgggguuucaccauguuggccaggcuggucucgaacuucugaccucuggugaucugccugccuuggccucccaaagugcugaaauuacaggcaugagccacugcgcccaggcuuacuuuaaaaaaaaaauuaauuuuuuguagagacaggagaguuucgcuauguugccaccugaacauaaaugcuauuuucuuuuucuuuucuuuucuuuuuuuugagacggaguccguagcccaggcuggggugugguggcaccauuuuggcucacuacagccuccgccucccagguucaagcgauucuccugccucagccucccaaguagcugggacuacaggcgugcaccccugugcccagcuaauuuuuguauuuuuaguagagacgggguuucaccauguugaccaggcuaaucucaaacuccugaccucaagugaucugccugccuuggucucccaaagugcugggauuacaggugugagccacugcgccuggcccauaaaugcgauuuucauucccauuuuccaacaaggcgacugagguauacauugaaggugaauuacuaggacaaaagaaagauggcauuuuacuucaauaacaguuuguuacaaccuguacugcuaccuaucugccaugggagugugccuuuccccacacugacaccagugcuggaaguuaucaaccuccuucaucuuugccaaccugauaggucaaaagugaucauggaagauccacacucgcuuuuuuuuuuuuuuuuuuuuugagauaggggucuauuucuuuuucuuuuuucagagauggggggucucacuauuucuuuuucuuuuuuucagagaugggggucucacuauguugccuaggcugguuuugaacuucugggcucaagugauucuccugccuugaccucccaaagugcugggauuacaggugugagccgccuugcuuagcccuuacugucguuuuuuuguuuguuuuuguuuuuguuuuuuuguuuuguuuuguuuuguuuuugagacagagucucgcucugucgcccaggcuggagugcgguggugcgaucuuggcucacugcaaccucugccucccggguuccagugauucuccugccucagccucccaaguagcugggauuacaggcacccgccaccacaccuggcuaauuuuuguauuuuuaauagagaugggguuucaccauguuggccaggcuggucuugaacuucugaccuuaggugauccauccaucucagccucccaaagugcugggauuacaggcgugagccaccuugccuggcccuuacuguugguuuaaugccacucucccuuagggugaccaaccaauccaguuugccugggaccauucuggcucuagcacugaaaguccuguguuccaagaaacacccaccucuccuccaaccugggcaaagagggacgguuggucaaccugcaguccuggguuauaagugaggcugagcguguuugcccauggucaagaaagaagggaucuuggaugaggguguguaacaggaucagauuuguuuuguuuuuuucuuagagucuugcugugucacccaggcuggagugcaauggccugaacacagcucacugcagccccaaacuccugggcucaagugauccucccaccucagccuccuggguagcugggauuacaggcaugcaucaccacacccaguuaacuuuuuaaagaacacuuuuuuuuuuuuuuuaagagacagggucuugcuauguugcucaggcuggucucaaacuccugggcucaagugauccucccgccuuggccucccaaagugcugggaugacagaugugagccauugugccuagccaggacgagauuuuuagaggguagaguaggaauaagagcuugcacuuaugaggcacaugauggcuucagcugucugcuuugcagagucucaagaaagcucugagaaccuuaagcagaggccauuuuacaugugaggacacagagguacagagaggugagauaaauggccaaggucacauaccuaagaggagaaggaggcaggauuugaaucgcagccugcacgucaccccauggugaguaacugguaagugagugagcaucccuccucuucucuugcaggcccccugacuugggccucaguguccccgaagaucaugauggcguauaugaacccggggccccacuauucugucaacgccuuggcccuaaguggccccaguguggaucugaugcaccaggcugugcccuacccaagugaguacagucguuucucuuggcaccccaggcuggccucaucucuuggaggaccucuggggucccuuugcccccaggaagaaggcaaucacaggggcgacuucagggccauacaccagcccucuggguucaucugaaauguaugucacuuagaaaaacauuagcaguccuagaaauucaggacagagguuccuuuuggggugaggaagaggggauguaaucuggaaggggaaucaagaggaauuuucaucuguuaccaaaacuuuauuauuuauuuauuuuucagagacaaggucucacacucugucacccaggcuggagugcaguggugguggucacggcucacugcagccucgaacuccugggcucaagcaauccucccaccucagccuccugaguagcugggacugcaggugugagccauugugccuaggcccggggggcacuuuuuuuuuuuaauuuuauuuuugagacagggucucacucuguugcccacucugaagugcaauggugcaaucacagcucacuacagccucgaacuccugggcucaagcgauccuuuugccuuggccucccaaauagcuaggauuacaggugcacgccaccaugccuggcuaacuuuuuuaaguuuuuguagauuuugcaggaucuggauuauacaaaacauagaaaaaauuauuauuauuuuuuuuuuuguagagauugggucucccuauguugcccaggcuggucucaaacucuuggguccaaauaauccgccugacucagccucccaaagugcugggauuacaggcaugagccacugcaccuggccugcaaagccuuauuucuuuuucuuuuuuuuucuuucgagacacaguuuagacggaguuucgcuccugcccaggcuggagugcaauggcgcgaucuuggcucuuugcaacuuuugccucccagguucaagugauucuccugccucagccucccaaguagcugggauuacaggcgcacaccaccaugcccggccaauuuuuguaaagccuuauuuuuaagagaagugaguacucaguuauuuguagcauuauucuuuagcucuuguuuuuuuuuuuuuuuuuuucaagaccgagccuuguucuguuaccaggcuggagugcaguggcauaaucuuggcucacugcaaccucugccuucuggguucaagcgauucuccucccucagccucccgaguagcugggacuacaggcaugcaccaccacaccuggcuaauuuuuuguauuuuuaguagagacagggguuccccauguuggccaggauagucucaauuucuugaccuugugaucugccugccucagccucccaaagugcugggauuauaggcgugagccaccgcacccagcccagacuugcuacuuuuauaggcuagaaacgguugaaugucagcaaugucaugcuucaacugauuaugucuuagugcauaagaaaguuuagaagagggaaaaacgacucgcacaccuccuuguugagcuaaagccuuggggucaggcaugagccacagagugccaggcacacagugagguguagaagggcagggaauguguauuccauccuuaguuuaggcagauggcaaccaggauggaauucuuggcaucccacccagccucagggccucacaccagcccauguggaugaccugaggguccuguuucccaucccaccccaggcgcccccaggaagcagcggcgggagcgcaccaccuucacccggagccaacuggaggagcuggaggcacuguuugccaagacccaguacccagacgucuaugcccgugaggagguggcucugaagaucaaucugccugaguccaggguucaggugggguggugggucccuggaccccucccgacacuuccugugaucucaggaggccugcccggaacaaagagugaugggaggagggagagaucacagagugacagccaaaguuauaaaggggacaauaaucccucuccccaccaucccacugaccgccucauggcucucauugccccucgcuccucuccagcugcgcuggcccugaccugccugccaagcacccuccugccuugggccuuugcacucaguuuccucuaucuggaaugcuuauuuccagauaaccacacagcaggccccaucgccuuguucgagucuuugcuuauccaucagugagacccacacugaacacagcauuuaaaauugcauaugauuuacauaugguaucucagagucuguuuauuuagacucugucucucccaacuagaaugucaauuccacugacggacacucagaguaguagaaaaugguuaauacauguuuauuaacugacugaauagacggauggauggauggguggguggaugcauagaugaauguauguaugugugacuguaggugugcgugugcauguaugacuggaagcauggaugaguguauguauguguauauaugagugucuguguguaugaugggauggauacauguauauauguguguuugcaugaacgcacauagguaugauuagauagaugaugaauguaugcaugcaugauauauguauacgugguguaugugcacauguauguauacaugcuugcaugauuggauggauggguauauuuauuuauuugaaauggagucucgcucugucgcccaggcuggagugcaguggcaugaucuuggcucacugcaaccuccgccuccuggguucaagugauucuccugccucagccuccuguguagcugggauuacaggcgugugccaccacaccgggcuaauuuuuguauuuuuaguagagaugggguuucaccauguuggccaggcuggucucaaacuccugaccucaggcaauccuacugccucggccuuccagagcgcugggauuacaggcgugagccaccgcgcccggccggauggguguauuuauguauauaugaguguaugcauguauauaugauuggacugauaaauaaaauguguguguuaguaugauuguauauagguaugacuggauggauuaauguauauguaugcaugauguauguguguaugauguauggguguauaauuguauauuuguauguuuguauaaucagauggauggaugaacaugcauaugauguauguaugauuagauagauccauuaaugcauguaugauguauguguguaugaccuauguuuauauaauuauauguauaagauggaugaaucuauguaugauguauguguguacaauuguauguaucaucagauggauaagucuauguaugauguauguaugaucagauggacuggugaauguguguaugacauauauaugugugagguauguauauaugaucagauggaugucuacauaauguauguguguaugguguauguauguauaauuguaugcguguauguuuguaugcuguagguaugauguuacauauaugugcauacacacguguguaugauuggaaggauaaaugaaauauguauguuugugugauuguaugcacauaugauuagauagauuaguguguagcuauguaugcuguauguguguacaauguaugugccuauaauuguauguuuguaugucuguaugaucagauggaugaauauguauaugauguauguaugaucagauagcuggauaaauguaugcaugaugcauguguguaugguguaugcauguauaauuguauguauguuugcauuagauggauaaaugccuguagguaucauguauguacgcauacaugcaugauuggaugacuggauggguuuauuuguguauauaugaguguacgcauguauauauaauuagauggauaaaugaaaugugugucugcaugauuguauguauggauuaauguguauauauguaugauguauguguguacaauguauguauguauaauuguauguuuguaugaucagauggauggaugaauguguaugauguauauauguaugaucagauggcuccauuaaugcauguaugauguaugcguguaugaugcauguacacuugcauguaugaucagaugagccagugaauguauguaugauguauauguguaugauguauguauguaugaucagauagauggguaaacguaugcaugauguaugugcguaugguguauguauguauaauuguaugugugcauguuuguauuagauggguggaugaauauguguaugauguauguaugaucauauagauggguaaaugcaggcaugauguauguguguaugguguauguauguauaauuguaugugugcauguuuguauuagauggauggaugaaaauguguaugauguacguaugaucauauagauggguaaauguaugcaugauauaugugcguaugguguauauauguauaacuguacgugugcauguuuguauuagauggguggaugaauauguguaugauguauguaugaucauaucgauggguaaaugcaggcaugauguaugugcguaugguguaugcauguauaauuguacgugugcauguuugcauuagacggaugggaugaaugcacauggguaugauguaugcauguguucaugcacacaugcagguaugauuggauggauagauggauggaugggugaauagacgccccacagcuggaugcaaaguagacagaugugaacccagcaccucucaccaauaaguguccucauccccgggcacccugcggcucuccugggccucuuccccacuuacccacccccaucuccgcucuuaucccccagguuugguucaagaaccggagggcuaaaugcaggcagcagcgacagcagcagaaacagcagcagcagcccccagggggccaggccaaggcccggccugccaagaggaaggcgggcacguccccaagacccuccacagauguguguccagacccucugggcaucucagauuccuacagucccccucugcccggccccucaggcuccccaaccacggcaguggccacuguguccaucuggagcccagccucagaguccccuuugccugaggcgcagcgggcugggcugguggccucagggccgucucugaccuccgcccccuaugccaugaccuacgccccggccuccgcuuucugcucuucccccuccgccuaugggucuccgagcuccuauuucagcggccuagaccccuaccuuucucccauggugccccagcuagggggcccggcucuuagcccccucucuggccccuccgugggaccuucccuggcccagucccccaccucccuaucaggccagagcuauggcgccuacagccccguggauagcuuggaauucaaggaccccacgggcaccuggaaauucaccuacaaucccauggacccucuggacuacaaggaucagagugccuggaaguuucagaucuuguagaggacgcagucuccaucucucuccaucgggccucgggacccuuucucuucugaaucugcuucccugcaguuuagaucccgggauggcauuccugagaaagcaacccgaaccagcuguccuucugacagcucgguguucagcuuacagagaccaccccuuuccuccacagggagaggcuccucccucuccugggacagcucacagguccuagugauucucucaacccuaacaccgucuggcacgauugugaccgcugaaguacaccacgagcuccaggcuucagaaaguggugcugagaacuugcuccaagaagaagucaaaccaaacuugcaguugauuuggggucauguuuaggucagaaucaccgugcccuugaacaagcagguaggggggcuugauaacuuaacuuuccacguggacagaauuuuuuuuuuuguuuuguuuuuguuuugcagacacagucuagcucugucgcccaggcuggagugcaguggcacgaucucagcucacugcaagcucuaccucccggguucacgccauucuccugccucagccucccgaguagcugggacuacagaugcccaccaccaggcccggcuaauuuuuuuuguauuuuuaguagagacgggguuucaccguguuagccaggauggucucgaucuccugaccucgugauccgcccgccucggccucccaaagugcuaggauuacaggcgugagccaccgcgcccggcccuuuuuuuuuuuuuuuuuuuuaauugagacggagucucacucuuuugcuuaggcuggagugcaguggugugaucucagcucacugacugcaaccuccaccucccggguugaagcguugcuccugccucaaucucccaauuagcugggauuacaggugugcuccaucaugcccggcuaauuuuucuauuauuaguagagacaggguuuuaccauguuggccaggcuggucuggaaccccugaccucaagugauccgccugccucggccucccaaagugcugggauuacaggcaugagccauugugccuggcccuacacguggacacuucuuuagcauaugguuagggaccuuucuagaaauuccaaagacagacuuuaagaagccccgucgggaaaccuuaggccaaugaugugguuacauuaaaaauaaauuaucugggaauuucacagacuucacaaaugucaggcuuacaugguagguuuaggggaccguuugagagacaaagaucuacauucauauauguagcuauacauauauguacuuuuucuucuuaguuucuuuuuaaagacauuuuaucacucauucgcucauuagcacauugggaauguguguauuugguagggaaaugaaaggcaccuugccuguuccaucucuacuccuuuuuucuuuuguuuuaggauuuucuaaaggugagacacugguggaacugggguagcugcuugggacguaccaccuauaguuguggcuauuucacagagaagcagcagcuagacagacucccaucuguaaauaaacaagagauaggaagagggggaaauagauuuggaggaggcagcccuacauuucaaacauacauucccuuuuuuagauuuuuuuuuuuuuuuuuuugguuuucaguuuugauggugggauuggaaaauagagcuuggcuugaggacauuuuccugggguggcaccauuauuucuugaaauagaaucuuacuuauggugacacuggcaagcacuugugagaaccugaagacggauugaggucauuugaugcucagaaguugggugcugggucccugccuucucaguccgaguucuccuuucauuuuuggguggggaggcggguuccaagagcccuucauugguggaguucacaaggcaagguguaaaaaaaaaaguagggcaggaagacaguggugugcuggcagaggucuaacaaugggcucuccaaggaagaggaaaagguugguuguggaguguuugucaguuuccgugguguaaauacucccaccacggcugacuucaagcuagcaaccggaggucacugaacuaagaguugggaagagauagggcacaauauaugcuuacgaguugguacacaccgucagcagcagccagggucaggagaaaggcgagaugugaagagaggccgggagguaucagaugacguuuccagcacuagaccagaagaggugcacacagccuagacccccugagggguacacccugaucucuagagcccacaaagagguuuuuauucaacauaaaacguguucaucucucauaggccugagucaugcuggguucugggacauuaagcccaggagugggccgggugcgguggcucacgccuguaaucccagcacuuugggaggccgaggcggguggaucaccugaggucaggaguucgagaccagccuggccaacauggugaaacccugucucuacuaauaauacaaaaauuagccgggcaugguggcacgcgccuguaaucccagcuacucgggaggcugaggcaggagaauugcuggaacccgggaggcggagguugaagagagcagagauugugccacugugcucuagccugggucacaagagcgaaacuccgucucaauaauaacaacaacaaaaauaacccaggaguggcucaagaguccagugugggaugaaaauauaaacagaggaagacaacauaugucacuggggaggcugggggagcuagacaaaauucacacgggaggggcagggaugagacaauauugugcccugggucugugcaaacguugggaccagaauccacuauaaguuucauucuucggagacacggaagcucugcacuggaggccgggacucaggcguggaagagaaucuucuccuuauucaccggggaggcugugucuugugcaaacaagucauagaaacuugaugggaguuggggagggacugaaggaugcaugcaagguucugggaaggagugagaaguagugaaggccaaggggcccccaucacaggccgaugggguaagacuucgagagagccugauccuggggucuucugagacuccaccaggagccggagagggcagggagccaaauccagcuaggagguuacagauugcuuuuccugggcugggcuccugaguguugguucuuccagcugugcacaggggauuucaaacguucuacguccuaaagccaggaagagugacaaggcagguggggacagaaggaagaagccaggagccucccugagaaggugucaccuuaucuguccuccucuuccccacacacuggccucugggucccccuucucuguccacccacagagugaaaccaauuaaaauguuggaucucauuuaa

SEQ ID NO: 34873 - RNA, 18 nt, Artificial Sequence
  Description of Artificial Sequence: Synthetic oligonucleotide
ggauuugcagagugcucc

SEQ ID NO: 34874 - RNA, 18 nt, Artificial Sequence
  Description of Artificial Sequence: Synthetic oligonucleotide
ggaacggauuugcagagu

SEQ ID NO: 34875 - RNA, 18 nt, Artificial Sequence
  Description of Artificial Sequence: Synthetic oligonucleotide
ccaguggaacggauuugc

SEQ ID NO: 34876 - RNA, 18 nt, Artificial Sequence
  Description of Artificial Sequence: Synthetic oligonucleotide
aggucccaguggaacgga

SEQ ID NO: 34877 - RNA, 18 nt, Artificial Sequence
  Description of Artificial Sequence: Synthetic oligonucleotide
caaucaggucccagugga

SEQ ID NO: 34878 - RNA, 18 nt, Artificial Sequence
  Description of Artificial Sequence: Synthetic oligonucleotide
cuucccaaucagguccca

SEQ ID NO: 34879 - RNA, 18 nt, Artificial Sequence
  Description of Artificial Sequence: Synthetic oligonucleotide
agguucuucccaaucagg

SEQ ID NO: 34880 - RNA, 18 nt, Artificial Sequence
  Description of Artificial Sequence: Synthetic oligonucleotide
caaacagguucuucccaa

SEQ ID NO: 34881 - RNA, 18 nt, Artificial Sequence
  Description of Artificial Sequence: Synthetic oligonucleotide
cauggcaaacagguucuu

SEQ ID NO: 34882 - RNA, 18 nt, Artificial Sequence
  Description of Artificial Sequence: Synthetic oligonucleotide
accaccauggcaaacagg

SEQ ID NO: 34883 - RNA, 18 nt, Artificial Sequence
  Description of Artificial Sequence: Synthetic oligonucleotide
cuuccaccaccauggcaa

SEQ ID NO: 34884 - RNA, 18 nt, Artificial Sequence
  Description of Artificial Sequence: Synthetic oligonucleotide
caccccuuccaccaccau

SEQ ID NO: 34885 - RNA, 18 nt, Artificial Sequence
  Description of Artificial Sequence: Synthetic oligonucleotide
uacaccaccccuuccacc

SEQ ID NO: 34886 - RNA, 18 nt, Artificial Sequence
  Description of Artificial Sequence: Synthetic oligonucleotide
ggaaguacaccaccccuu

SEQ ID NO: 34887 - RNA, 18 nt, Artificial Sequence
  Description of Artificial Sequence: Synthetic oligonucleotide
caggaggaaguacaccac

SEQ ID NO: 34888 - RNA, 18 nt, Artificial Sequence
  Description of Artificial Sequence: Synthetic oligonucleotide
agggucaggaggaaguac

SEQ ID NO: 34889 - RNA, 18 nt, Artificial Sequence
  Description of Artificial Sequence: Synthetic oligonucleotide
ccagcagggucaggagga

SEQ ID NO: 34890 - RNA, 18 nt, Artificial Sequence
  Description of Artificial Sequence: Synthetic oligonucleotide
cuggaccagcagggucag

SEQ ID NO: 34891 - RNA, 18 nt, Artificial Sequence
  Description of Artificial Sequence: Synthetic oligonucleotide
uggcgcuggaccagcagg

SEQ ID NO: 34892 - RNA, 18 nt, Artificial Sequence
  Description of Artificial Sequence: Synthetic oligonucleotide
agaaguggcgcuggacca

SEQ ID NO: 34893 - RNA, 18 nt, Artificial Sequence
  Description of Artificial Sequence: Synthetic oligonucleotide
gaggaagaaguggcgcug

SEQ ID NO: 34894 - RNA, 18 nt, Artificial Sequence
  Description of Artificial Sequence: Synthetic oligonucleotide
ugggagaggaagaagugg

SEQ ID NO: 34895 - RNA, 18 nt, Artificial Sequence
  Description of Artificial Sequence: Synthetic oligonucleotide
cccaggguguggcaugga

SEQ ID NO: 34896 - RNA, 18 nt, Artificial Sequence
  Description of Artificial Sequence: Synthetic oligonucleotide
acuggcccaggguguggc

SEQ ID NO: 34897 - RNA, 18 nt, Artificial Sequence
  Description of Artificial Sequence: Synthetic oligonucleotide
ugcccacuggcccagggu

SEQ ID NO: 34898 - RNA, 18 nt, Artificial Sequence
  Description of Artificial Sequence: Synthetic oligonucleotide
ugagcugcccacuggccc

SEQ ID NO: 34899 - RNA, 18 nt, Artificial Sequence
  Description of Artificial Sequence: Synthetic oligonucleotide
ugcccugagcugcccacu

SEQ ID NO: 34900 - RNA, 18 nt, Artificial Sequence
  Description of Artificial Sequence: Synthetic oligonucleotide
cuggaugcccugagcugc

SEQ ID NO: 34901 - RNA, 18 nt, Artificial Sequence
  Description of Artificial Sequence: Synthetic oligonucleotide
caguucuggaugcccuga

SEQ ID NO: 34902 - RNA, 18 nt, Artificial Sequence
  Description of Artificial Sequence: Synthetic oligonucleotide
agguccaguucuggaugc

SEQ ID NO: 34903 - RNA, 18 nt, Artificial Sequence
  Description of Artificial Sequence: Synthetic oligonucleotide
guauaagguccaguucug

SEQ ID NO: 34904 - RNA, 18 nt, Artificial Sequence
  Description of Artificial Sequence: Synthetic oligonucleotide
uguggguauaagguccag

SEQ ID NO: 34905 - RNA, 18 nt, Artificial Sequence
  Description of Artificial Sequence: Synthetic oligonucleotide
gaccauguggguauaagg

SEQ ID NO: 34906 - RNA, 18 nt, Artificial Sequence
  Description of Artificial Sequence: Synthetic oligonucleotide
gaaaugaccaugugggua

SEQ ID NO: 34907 - RNA, 18 nt, Artificial Sequence
  Description of Artificial Sequence: Synthetic oligonucleotide
ggaaagaaaugaccaugu

SEQ ID NO: 34908 - RNA, 18 nt, Artificial Sequence
  Description of Artificial Sequence: Synthetic oligonucleotide
ccugaggaaagaaaugac

SEQ ID NO: 34909 - RNA, 18 nt, Artificial Sequence
  Description of Artificial Sequence: Synthetic oligonucleotide
gggcuccugaggaaagaa

SEQ ID NO: 34910 - RNA, 18 nt, Artificial Sequence
  Description of Artificial Sequence: Synthetic oligonucleotide
agaaaaaacauuguggag

SEQ ID NO: 34911 - RNA, 18 nt, Artificial Sequence
  Description of Artificial Sequence: Synthetic oligonucleotide
aauguagaaaaaacauug

SEQ ID NO: 34912 - RNA, 18 nt, Artificial Sequence
  Description of Artificial Sequence: Synthetic oligonucleotide
uugagaauguagaaaaaa

SEQ ID NO: 34913 - RNA, 18 nt, Artificial Sequence
  Description of Artificial Sequence: Synthetic oligonucleotide
aggcuuugagaauguaga

SEQ ID NO: 34914 - RNA, 18 nt, Artificial Sequence
  Description of Artificial Sequence: Synthetic oligonucleotide
aagccaggcuuugagaau

SEQ ID NO: 34915 - RNA, 18 nt, Artificial Sequence
  Description of Artificial Sequence: Synthetic oligonucleotide
gagaaaagccaggcuuug

SEQ ID NO: 34916 - RNA, 18 nt, Artificial Sequence
  Description of Artificial Sequence: Synthetic oligonucleotide
uauuggagaaaagccagg

SEQ ID NO: 34917 - RNA, 18 nt, Artificial Sequence
  Description of Artificial Sequence: Synthetic oligonucleotide
uguauuauuggagaaaag

SEQ ID NO: 34918 - RNA, 18 nt, Artificial Sequence
  Description of Artificial Sequence: Synthetic oligonucleotide
cuacuuguauuauuggag

SEQ ID NO: 34919 - RNA, 18 nt, Artificial Sequence
  Description of Artificial Sequence: Synthetic oligonucleotide
auccucuacuuguauuau

SEQ ID NO: 34920 - RNA, 18 nt, Artificial Sequence
  Description of Artificial Sequence: Synthetic oligonucleotide
acccgauccucuacuugu

SEQ ID NO: 34921 - RNA, 18 nt, Artificial Sequence
  Description of Artificial Sequence: Synthetic oligonucleotide
uuuuaacccgauccucua

SEQ ID NO: 34922 - RNA, 18 nt, Artificial Sequence
  Description of Artificial Sequence: Synthetic oligonucleotide
gccuauuuuaacccgauc

SEQ ID NO: 34923 - RNA, 18 nt, Artificial Sequence
  Description of Artificial Sequence: Synthetic oligonucleotide
aaugugccuauuuuaacc

SEQ ID NO: 34924 - RNA, 18 nt, Artificial Sequence
  Description of Artificial Sequence: Synthetic oligonucleotide
auuugaaugugccuauuu

SEQ ID NO: 34925 - RNA, 18 nt, Artificial Sequence
  Description of Artificial Sequence: Synthetic oligonucleotide
cacauauuugaaugugcc

SEQ ID NO: 34926 - RNA, 18 nt, Artificial Sequence
  Description of Artificial Sequence: Synthetic oligonucleotide
cucuucacauauuugaau

SEQ ID NO: 34927 - RNA, 18 nt, Artificial Sequence
  Description of Artificial Sequence: Synthetic oligonucleotide
ggaugcucuucacauauu

SEQ ID NO: 34928 - RNA, 18 nt, Artificial Sequence
  Description of Artificial Sequence: Synthetic oligonucleotide
aaaguggaugcucuucac

SEQ ID NO: 34929 - RNA, 18 nt, Artificial Sequence
  Description of Artificial Sequence: Synthetic oligonucleotide
auuuuaaaguggaugcuc

SEQ ID NO: 34930 - RNA, 18 nt, Artificial Sequence
  Description of Artificial Sequence: Synthetic oligonucleotide
uaaauauuuuaaagugga

SEQ ID NO: 34931 - RNA, 18 nt, Artificial Sequence
  Description of Artificial Sequence: Synthetic oligonucleotide
cauuuuaaauauuuuaaa

SEQ ID NO: 34932 - RNA, 18 nt, Artificial Sequence
  Description of Artificial Sequence: Synthetic oligonucleotide
cacugcauuuuaaauauu

SEQ ID NO: 34933 - RNA, 18 nt, Artificial Sequence
  Description of Artificial Sequence: Synthetic oligonucleotide
aauagcacugcauuuuaa

SEQ ID NO: 34934 - RNA, 18 nt, Artificial Sequence
  Description of Artificial Sequence: Synthetic oligonucleotide
aaauuaauagcacugcau

SEQ ID NO: 34935 - RNA, 18 nt, Artificial Sequence
  Description of Artificial Sequence: Synthetic oligonucleotide
aauugaaauuaauagcac

SEQ ID NO: 34936 - RNA, 18 nt, Artificial Sequence
  Description of Artificial Sequence: Synthetic oligonucleotide
ucagcaauugaaauuaau

SEQ ID NO: 34937 - RNA, 18 nt, Artificial Sequence
  Description of Artificial Sequence: Synthetic oligonucleotide
aaauaucagcaauugaaa

SEQ ID NO: 34938 - RNA, 18 nt, Artificial Sequence
  Description of Artificial Sequence: Synthetic oligonucleotide
ggauuaaauaucagcaau

SEQ ID NO: 34939 - RNA, 18 nt, Artificial Sequence
  Description of Artificial Sequence: Synthetic oligonucleotide
gagaaggauuaaauauca

SEQ ID NO: 34940 - RNA, 18 nt, Artificial Sequence
  Description of Artificial Sequence: Synthetic oligonucleotide
uaaaugagaaggauuaaa

SEQ ID NO: 34941 - RNA, 18 nt, Artificial Sequence
  Description of Artificial Sequence: Synthetic oligonucleotide
guaauuaaaugagaagga

SEQ ID NO: 34942 - RNA, 18 nt, Artificial Sequence
  Description of Artificial Sequence: Synthetic oligonucleotide
auuugguaauuaaaugag

SEQ ID NO: 34943 - RNA, 18 nt, Artificial Sequence
  Description of Artificial Sequence: Synthetic oligonucleotide
uacacauuugguaauuaa

SEQ ID NO: 34944 - RNA, 18 nt, Artificial Sequence
  Description of Artificial Sequence: Synthetic oligonucleotide
caaaauacacauuuggua

SEQ ID NO: 34945 - RNA, 18 nt, Artificial Sequence
  Description of Artificial Sequence: Synthetic oligonucleotide
cuaaucaaaauacacauu

SEQ ID NO: 34946 - RNA, 18 nt, Artificial Sequence
  Description of Artificial Sequence: Synthetic oligonucleotide
aucaucuaaucaaaauac

SEQ ID NO: 34947 - RNA, 18 nt, Artificial Sequence
  Description of Artificial Sequence: Synthetic oligonucleotide
auacuaucaucuaaucaa

SEQ ID NO: 34948 - RNA, 18 nt, Artificial Sequence
  Description of Artificial Sequence: Synthetic oligonucleotide
uugcaauacuaucaucua

SEQ ID NO: 34949 - RNA, 18 nt, Artificial Sequence
  Description of Artificial Sequence: Synthetic oligonucleotide
guuauuugcaauacuauc

SEQ ID NO: 34950 - RNA, 18 nt, Artificial Sequence
  Description of Artificial Sequence: Synthetic oligonucleotide
ccauuguuauuugcaaua

SEQ ID NO: 34951 - RNA, 18 nt, Artificial Sequence
  Description of Artificial Sequence: Synthetic oligonucleotide
uguaaccauuguuauuug

SEQ ID NO: 34952 - RNA, 18 nt, Artificial Sequence
  Description of Artificial Sequence: Synthetic oligonucleotide
uacccuguaaccauuguu

SEQ ID NO: 34953 - RNA, 18 nt, Artificial Sequence
  Description of Artificial Sequence: Synthetic oligonucleotide
uuggauacccuguaacca

SEQ ID NO: 34954 - RNA, 18 nt, Artificial Sequence
  Description of Artificial Sequence: Synthetic oligonucleotide
guacuuuggauacccugu

SEQ ID NO: 34955 - RNA, 18 nt, Artificial Sequence
  Description of Artificial Sequence: Synthetic oligonucleotide
uccuaguacuuuggauac

SEQ ID NO: 34956 - RNA, 18 nt, Artificial Sequence
  Description of Artificial Sequence: Synthetic oligonucleotide
cuauuuccuaguacuuug

SEQ ID NO: 34957 - RNA, 18 nt, Artificial Sequence
  Description of Artificial Sequence: Synthetic oligonucleotide
uuagucuauuuccuagua

SEQ ID NO: 34958 - RNA, 18 nt, Artificial Sequence
  Description of Artificial Sequence: Synthetic oligonucleotide
auacauuagucuauuucc

SEQ ID NO: 34959 - RNA, 18 nt, Artificial Sequence
  Description of Artificial Sequence: Synthetic oligonucleotide
cauaaauacauuagucua

SEQ ID NO: 34960 - RNA, 18 nt, Artificial Sequence
  Description of Artificial Sequence: Synthetic oligonucleotide
ucucucauaaauacauua

SEQ ID NO: 34961 - RNA, 18 nt, Artificial Sequence
  Description of Artificial Sequence: Synthetic oligonucleotide
uccuuucucucauaaaua

SEQ ID NO: 34962 - RNA, 18 nt, Artificial Sequence
  Description of Artificial Sequence: Synthetic oligonucleotide
cuguguccuuucucucau

SEQ ID NO: 34963 - RNA, 18 nt, Artificial Sequence
  Description of Artificial Sequence: Synthetic oligonucleotide
gccugcuguguccuuucu

SEQ ID NO: 34964 - RNA, 18 nt, Artificial Sequence
  Description of Artificial Sequence: Synthetic oligonucleotide
gggccugcuguguccuuu

SEQ ID NO: 34965 - RNA, 18 nt, Artificial Sequence
  Description of Artificial Sequence: Synthetic oligonucleotide
ucucuaauuagcaaaggg

SEQ ID NO: 34966 - RNA, 18 nt, Artificial Sequence
  Description of Artificial Sequence: Synthetic oligonucleotide
ccaaaucucuaauuagca

SEQ ID NO: 34967 - RNA, 18 nt, Artificial Sequence
  Description of Artificial Sequence: Synthetic oligonucleotide
ugcucccaaaucucuaau

SEQ ID NO: 34968 - RNA, 18 nt, Artificial Sequence
  Description of Artificial Sequence: Synthetic oligonucleotide
ucccaugcucccaaaucu

SEQ ID NO: 34969 - RNA, 18 nt, Artificial Sequence
  Description of Artificial Sequence: Synthetic oligonucleotide
auuacucccaugcuccca

SEQ ID NO: 34970 - RNA, 18 nt, Artificial Sequence
  Description of Artificial Sequence: Synthetic oligonucleotide
cccauauuacucccaugc

SEQ ID NO: 34971 - RNA, 18 nt, Artificial Sequence
  Description of Artificial Sequence: Synthetic oligonucleotide
uggcucccauauuacucc

SEQ ID NO: 34972 - RNA, 18 nt, Artificial Sequence
  Description of Artificial Sequence: Synthetic oligonucleotide
ccacauggcucccauauu

SEQ ID NO: 34973 - RNA, 18 nt, Artificial Sequence
  Description of Artificial Sequence: Synthetic oligonucleotide
ccccuccacauggcuccc

SEQ ID NO: 34974 - RNA, 18 nt, Artificial Sequence
  Description of Artificial Sequence: Synthetic oligonucleotide
ccgcaccccuccacaugg

SEQ ID NO: 34975 - RNA, 18 nt, Artificial Sequence
  Description of Artificial Sequence: Synthetic oligonucleotide
acugcccgcaccccucca

SEQ ID NO: 34976 - RNA, 18 nt, Artificial Sequence
  Description of Artificial Sequence: Synthetic oligonucleotide
ugaucacugcccgcaccc

SEQ ID NO: 34977 - RNA, 18 nt, Artificial Sequence
  Description of Artificial Sequence: Synthetic oligonucleotide
ggucgugaucacugcccg

SEQ ID NO: 34978 - RNA, 18 nt, Artificial Sequence
  Description of Artificial Sequence: Synthetic oligonucleotide
gggucgugaucacugccc

SEQ ID NO: 34979 - RNA, 18 nt, Artificial Sequence
  Description of Artificial Sequence: Synthetic oligonucleotide
ccuuccuccaggaguggg

SEQ ID NO: 34980 - RNA, 18 nt, Artificial Sequence
  Description of Artificial Sequence: Synthetic oligonucleotide
acccaccuuccuccagga

SEQ ID NO: 34981 - RNA, 18 nt, Artificial Sequence
  Description of Artificial Sequence: Synthetic oligonucleotide
cagcuacccaccuuccuc

SEQ ID NO: 34982 - RNA, 18 nt, Artificial Sequence
  Description of Artificial Sequence: Synthetic oligonucleotide
guuggcagcuacccaccu

SEQ ID NO: 34983 - RNA, 18 nt, Artificial Sequence
  Description of Artificial Sequence: Synthetic oligonucleotide
ucaggguuggcagcuacc

SEQ ID NO: 34984 - RNA, 18 nt, Artificial Sequence
  Description of Artificial Sequence: Synthetic oligonucleotide
aaaagucaggguuggcag

SEQ ID NO: 34985 - RNA, 18 nt, Artificial Sequence
  Description of Artificial Sequence: Synthetic oligonucleotide
uggucaaaagucaggguu

SEQ ID NO: 34986 - RNA, 18 nt, Artificial Sequence
  Description of Artificial Sequence: Synthetic oligonucleotide
agcccuggucaaaaguca

SEQ ID NO: 34987 - RNA, 18 nt, Artificial Sequence
  Description of Artificial Sequence: Synthetic oligonucleotide
ugagaagcccuggucaaa

SEQ ID NO: 34988 - RNA, 18 nt, Artificial Sequence
  Description of Artificial Sequence: Synthetic oligonucleotide
ucaucaggccaccucaug

SEQ ID NO: 34989 - RNA, 18 nt, Artificial Sequence
  Description of Artificial Sequence: Synthetic oligonucleotide
aguugucaucaggccacc

SEQ ID NO: 34990 - RNA, 18 nt, Artificial Sequence
  Description of Artificial Sequence: Synthetic oligonucleotide
aacagaguugucaucagg

SEQ ID NO: 34991 - RNA, 18 nt, Artificial Sequence
  Description of Artificial Sequence: Synthetic oligonucleotide
uccaaaacagaguuguca

SEQ ID NO: 34992 - RNA, 18 nt, Artificial Sequence
  Description of Artificial Sequence: Synthetic oligonucleotide
accuuuccaaaacagagu

SEQ ID NO: 34993 - RNA, 18 nt, Artificial Sequence
  Description of Artificial Sequence: Synthetic oligonucleotide
acuccaccuuuccaaaac

SEQ ID NO: 34994 - RNA, 18 nt, Artificial Sequence
  Description of Artificial Sequence: Synthetic oligonucleotide
ugccaacuccaccuuucc

SEQ ID NO: 34995 - RNA, 18 nt, Artificial Sequence
  Description of Artificial Sequence: Synthetic oligonucleotide
ugcccugccaacuccacc

SEQ ID NO: 34996 - RNA, 18 nt, Artificial Sequence
  Description of Artificial Sequence: Synthetic oligonucleotide
cagucugcccugccaacu

SEQ ID NO: 34997 - RNA, 18 nt, Artificial Sequence
  Description of Artificial Sequence: Synthetic oligonucleotide
uccuccagucugcccugc

SEQ ID NO: 34998 - RNA, 18 nt, Artificial Sequence
  Description of Artificial Sequence: Synthetic oligonucleotide
ccacuuccuccagucugc

SEQ ID NO: 34999 - RNA, 18 nt, Artificial Sequence
  Description of Artificial Sequence: Synthetic oligonucleotide
gccucccacuuccuccag

SEQ ID NO: 35000 - RNA, 18 nt, Artificial Sequence
  Description of Artificial Sequence: Synthetic oligonucleotide
uccgagccucccacuucc

SEQ ID NO: 35001 - RNA, 18 nt, Artificial Sequence
  Description of Artificial Sequence: Synthetic oligonucleotide
uaaccuccgagccuccca

SEQ ID NO: 35002 - RNA, 18 nt, Artificial Sequence
  Description of Artificial Sequence: Synthetic oligonucleotide
guuacuaaccuccgagcc

SEQ ID NO: 35003 - RNA, 18 nt, Artificial Sequence
  Description of Artificial Sequence: Synthetic oligonucleotide
ggguaguuacuaaccucc

SEQ ID NO: 35004 - RNA, 18 nt, Artificial Sequence
  Description of Artificial Sequence: Synthetic oligonucleotide
gcaagcacucaguaaggg

SEQ ID NO: 35005 - RNA, 18 nt, Artificial Sequence
  Description of Artificial Sequence: Synthetic oligonucleotide
acagcaagcacucaguaa

SEQ ID NO: 35006 - RNA, 18 nt, Artificial Sequence
  Description of Artificial Sequence: Synthetic oligonucleotide
ccucuacagcaagcacuc

SEQ ID NO: 35007 - RNA, 18 nt, Artificial Sequence
  Description of Artificial Sequence: Synthetic oligonucleotide
ugcuuccucuacagcaag

SEQ ID NO: 35008 - RNA, 18 nt, Artificial Sequence
  Description of Artificial Sequence: Synthetic oligonucleotide
uaaaaugcuuccucuaca

SEQ ID NO: 35009 - RNA, 18 nt, Artificial Sequence
  Description of Artificial Sequence: Synthetic oligonucleotide
aggacuaaaaugcuuccu

SEQ ID NO: 35010 - RNA, 18 nt, Artificial Sequence
  Description of Artificial Sequence: Synthetic oligonucleotide
ccgucaggacuaaaaugc

SEQ ID NO: 35011 - RNA, 18 nt, Artificial Sequence
  Description of Artificial Sequence: Synthetic oligonucleotide
gaucaccgucaggacuaa

SEQ ID NO: 35012 - RNA, 18 nt, Artificial Sequence
  Description of Artificial Sequence: Synthetic oligonucleotide
ccugggaucaccgucagg

SEQ ID NO: 35013 - RNA, 18 nt, Artificial Sequence
  Description of Artificial Sequence: Synthetic oligonucleotide
cagggccugggaucaccg

SEQ ID NO: 35014 - RNA, 18 nt, Artificial Sequence
  Description of Artificial Sequence: Synthetic oligonucleotide
agacucagggccugggau

SEQ ID NO: 35015 - RNA, 18 nt, Artificial Sequence
  Description of Artificial Sequence: Synthetic oligonucleotide
aguaaagacucagggccu

SEQ ID NO: 35016 - RNA, 18 nt, Artificial Sequence
  Description of Artificial Sequence: Synthetic oligonucleotide
cacagaguaaagacucag

SEQ ID NO: 35017 - RNA, 18 nt, Artificial Sequence
  Description of Artificial Sequence: Synthetic oligonucleotide
ccuggcacagaguaaaga

SEQ ID NO: 35018 - RNA, 18 nt, Artificial Sequence
  Description of Artificial Sequence: Synthetic oligonucleotide
cagugccuggcacagagu

SEQ ID NO: 35019 - RNA, 18 nt, Artificial Sequence
  Description of Artificial Sequence: Synthetic oligonucleotide
cagcacagugccuggcac

SEQ ID NO: 35020 - RNA, 18 nt, Artificial Sequence
  Description of Artificial Sequence: Synthetic oligonucleotide
gaacucagcacagugccu

SEQ ID NO: 35021 - RNA, 18 nt, Artificial Sequence
  Description of Artificial Sequence: Synthetic oligonucleotide
aagaugaacucagcacag

SEQ ID NO: 35022 - RNA, 18 nt, Artificial Sequence
  Description of Artificial Sequence: Synthetic oligonucleotide
ugcugaagaugaacucag

SEQ ID NO: 35023 - RNA, 18 nt, Artificial Sequence
  Description of Artificial Sequence: Synthetic oligonucleotide
gauugugcugaagaugaa

SEQ ID NO: 35024 - RNA, 18 nt, Artificial Sequence
  Description of Artificial Sequence: Synthetic oligonucleotide
cauaggauugugcugaag

SEQ ID NO: 35025 - RNA, 18 nt, Artificial Sequence
  Description of Artificial Sequence: Synthetic oligonucleotide
ugucucauaggauugugc

SEQ ID NO: 35026 - RNA, 18 nt, Artificial Sequence
  Description of Artificial Sequence: Synthetic oligonucleotide
auaccugucucauaggau

SEQ ID NO: 35027 - RNA, 18 nt, Artificial Sequence
  Description of Artificial Sequence: Synthetic oligonucleotide
uaacaauaccugucucau

SEQ ID NO: 35028 - RNA, 18 nt, Artificial Sequence
  Description of Artificial Sequence: Synthetic oligonucleotide
gaggguaacaauaccugu

SEQ ID NO: 35029 - RNA, 18 nt, Artificial Sequence
  Description of Artificial Sequence: Synthetic oligonucleotide
aggaggaggguaacaaua

SEQ ID NO: 35030 - RNA, 18 nt, Artificial Sequence
  Description of Artificial Sequence: Synthetic oligonucleotide
ugaugaggaggaggguaa

SEQ ID NO: 35031 - RNA, 18 nt, Artificial Sequence
  Description of Artificial Sequence: Synthetic oligonucleotide
ccaugugaugaggaggag

SEQ ID NO: 35032 - RNA, 18 nt, Artificial Sequence
  Description of Artificial Sequence: Synthetic oligonucleotide
uucaaccaugugaugagg

SEQ ID NO: 35033 - RNA, 18 nt, Artificial Sequence
  Description of Artificial Sequence: Synthetic oligonucleotide
ccuacuucaaccauguga

SEQ ID NO: 35034 - RNA, 18 nt, Artificial Sequence
  Description of Artificial Sequence: Synthetic oligonucleotide
ccuugccuacuucaacca

SEQ ID NO: 35035 - RNA, 18 nt, Artificial Sequence
  Description of Artificial Sequence: Synthetic oligonucleotide
cugaaccuugccuacuuc

SEQ ID NO: 35036 - RNA, 18 nt, Artificial Sequence
  Description of Artificial Sequence: Synthetic oligonucleotide
ccucucugaaccuugccu

SEQ ID NO: 35037 - RNA, 18 nt, Artificial Sequence
  Description of Artificial Sequence: Synthetic oligonucleotide
uuggaccucucugaaccu

SEQ ID NO: 35038 - RNA, 18 nt, Artificial Sequence
  Description of Artificial Sequence: Synthetic oligonucleotide
gggcauuggaccucucug

SEQ ID NO: 35039 - RNA, 18 nt, Artificial Sequence
  Description of Artificial Sequence: Synthetic oligonucleotide
aucuugggcauuggaccu

SEQ ID NO: 35040 - RNA, 18 nt, Artificial Sequence
  Description of Artificial Sequence: Synthetic oligonucleotide
gugugaucuugggcauug

SEQ ID NO: 35041 - RNA, 18 nt, Artificial Sequence
  Description of Artificial Sequence: Synthetic oligonucleotide
cucaugugugaucuuggg

SEQ ID NO: 35042 - RNA, 18 nt, Artificial Sequence
  Description of Artificial Sequence: Synthetic oligonucleotide
gccuccucaugugugauc

SEQ ID NO: 35043 - RNA, 18 nt, Artificial Sequence
  Description of Artificial Sequence: Synthetic oligonucleotide
uccuggccuccucaugug

SEQ ID NO: 35044 - RNA, 18 nt, Artificial Sequence
  Description of Artificial Sequence: Synthetic oligonucleotide
uccaguccuggccuccuc

SEQ ID NO: 35045 - RNA, 18 nt, Artificial Sequence
  Description of Artificial Sequence: Synthetic oligonucleotide
uggguuccaguccuggcc

SEQ ID NO: 35046 - RNA, 18 nt, Artificial Sequence
  Description of Artificial Sequence: Synthetic oligonucleotide
agccuuggguuccagucc

SEQ ID NO: 35047 - RNA, 18 nt, Artificial Sequence
  Description of Artificial Sequence: Synthetic oligonucleotide
gagucagccuuggguucc

SEQ ID NO: 35048 - RNA, 18 nt, Artificial Sequence
  Description of Artificial Sequence: Synthetic oligonucleotide
guccagagucagccuugg

SEQ ID NO: 35049 - RNA, 18 nt, Artificial Sequence
  Description of Artificial Sequence: Synthetic oligonucleotide
cucauguccagagucagc

SEQ ID NO: 35050 - RNA, 18 nt, Artificial Sequence
  Description of Artificial Sequence: Synthetic oligonucleotide
aggugcucauguccagag

SEQ ID NO: 35051 - RNA, 18 nt, Artificial Sequence
  Description of Artificial Sequence: Synthetic oligonucleotide
aggucaggugcucauguc

SEQ ID NO: 35052 - RNA, 18 nt, Artificial Sequence
  Description of Artificial Sequence: Synthetic oligonucleotide
uagagaggucaggugcuc

SEQ ID NO: 35053 - RNA, 18 nt, Artificial Sequence
  Description of Artificial Sequence: Synthetic oligonucleotide
uuagguagagaggucagg

SEQ ID NO: 35054 - RNA, 18 nt, Artificial Sequence
  Description of Artificial Sequence: Synthetic oligonucleotide
aggcauuagguagagagg

SEQ ID NO: 35055 - RNA, 18 nt, Artificial Sequence
  Description of Artificial Sequence: Synthetic oligonucleotide
gcauuaggcauuagguag

SEQ ID NO: 35056 - RNA, 18 nt, Artificial Sequence
  Description of Artificial Sequence: Synthetic oligonucleotide
gagaggcauuaggcauua

SEQ ID NO: 35057 - RNA, 18 nt, Artificial Sequence
  Description of Artificial Sequence: Synthetic oligonucleotide
agcaggagaggcauuagg

SEQ ID NO: 35058 - RNA, 18 nt, Artificial Sequence
  Description of Artificial Sequence: Synthetic oligonucleotide
cucccagcaggagaggca

SEQ ID NO: 35059 - RNA, 18 nt, Artificial Sequence
  Description of Artificial Sequence: Synthetic oligonucleotide
aagggcucccagcaggag

SEQ ID NO: 35060 - RNA, 18 nt, Artificial Sequence
  Description of Artificial Sequence: Synthetic oligonucleotide
cuaaaaagggcucccagc

SEQ ID NO: 35061 - RNA, 18 nt, Artificial Sequence
  Description of Artificial Sequence: Synthetic oligonucleotide
aaauucuaaaaagggcuc

SEQ ID NO: 35062 - RNA, 18 nt, Artificial Sequence
  Description of Artificial Sequence: Synthetic oligonucleotide
gacuuaaauucuaaaaag

SEQ ID NO: 35063 - RNA, 18 nt, Artificial Sequence
  Description of Artificial Sequence: Synthetic oligonucleotide
uuuaagacuuaaauucua

SEQ ID NO: 35064 - RNA, 18 nt, Artificial Sequence
  Description of Artificial Sequence: Synthetic oligonucleotide
cauccuuuaagacuuaaa

SEQ ID NO: 35065 - RNA, 18 nt, Artificial Sequence
  Description of Artificial Sequence: Synthetic oligonucleotide
gcuuccauccuuuaagac

SEQ ID NO: 35066 - RNA, 18 nt, Artificial Sequence
  Description of Artificial Sequence: Synthetic oligonucleotide
ucugggcuuccauccuuu

SEQ ID NO: 35067 - RNA, 18 nt, Artificial Sequence
  Description of Artificial Sequence: Synthetic oligonucleotide
uuccuucugggcuuccau

SEQ ID NO: 35068 - RNA, 18 nt, Artificial Sequence
  Description of Artificial Sequence: Synthetic oligonucleotide
ucugcuuccuucugggcu

SEQ ID NO: 35069 - RNA, 18 nt, Artificial Sequence
  Description of Artificial Sequence: Synthetic oligonucleotide
uugcuucugcuuccuucu

SEQ ID NO: 35070 - RNA, 18 nt, Artificial Sequence
  Description of Artificial Sequence: Synthetic oligonucleotide
cuuccuugcuucugcuuc

SEQ ID NO: 35071 - RNA, 18 nt, Artificial Sequence
  Description of Artificial Sequence: Synthetic oligonucleotide
uuccacuuccuugcuucu

SEQ ID NO: 35072 - RNA, 18 nt, Artificial Sequence
  Description of Artificial Sequence: Synthetic oligonucleotide
cucucuuccacuuccuug

SEQ ID NO: 35073 - RNA, 18 nt, Artificial Sequence
  Description of Artificial Sequence: Synthetic oligonucleotide
gggaccucucuuccacuu

SEQ ID NO: 35074 - RNA, 18 nt, Artificial Sequence
  Description of Artificial Sequence: Synthetic oligonucleotide
uccaugggaccucucuuc

SEQ ID NO: 35075 - RNA, 18 nt, Artificial Sequence
  Description of Artificial Sequence: Synthetic oligonucleotide
uccuuuccaugggaccuc

SEQ ID NO: 35076 - RNA, 18 nt, Artificial Sequence
  Description of Artificial Sequence: Synthetic oligonucleotide
cacuguccuuuccauggg

SEQ ID NO: 35077 - RNA, 18 nt, Artificial Sequence
  Description of Artificial Sequence: Synthetic oligonucleotide
cuuggcacuguccuuucc

SEQ ID NO: 35078 - RNA, 18 nt, Artificial Sequence
  Description of Artificial Sequence: Synthetic oligonucleotide
guguccuuggcacugucc

SEQ ID NO: 35079 - RNA, 18 nt, Artificial Sequence
  Description of Artificial Sequence: Synthetic oligonucleotide
guacaguguccuuggcac

SEQ ID NO: 35080 - RNA, 18 nt, Artificial Sequence
  Description of Artificial Sequence: Synthetic oligonucleotide
uggcuguacaguguccuu

SEQ ID NO: 35081 - RNA, 18 nt, Artificial Sequence
  Description of Artificial Sequence: Synthetic oligonucleotide
ugggcuggcuguacagug

SEQ ID NO: 35082 - RNA, 18 nt, Artificial Sequence
  Description of Artificial Sequence: Synthetic oligonucleotide
aggauugggcuggcugua

SEQ ID NO: 35083 - RNA, 18 nt, Artificial Sequence
  Description of Artificial Sequence: Synthetic oligonucleotide
gggucaggauugggcugg

SEQ ID NO: 35084 - RNA, 18 nt, Artificial Sequence
  Description of Artificial Sequence: Synthetic oligonucleotide
cuuagugggcucggcaau

SEQ ID NO: 35085 - RNA, 18 nt, Artificial Sequence
  Description of Artificial Sequence: Synthetic oligonucleotide
ggcuccuuagugggcucg

SEQ ID NO: 35086 - RNA, 18 nt, Artificial Sequence
  Description of Artificial Sequence: Synthetic oligonucleotide
caaugggcuccuuagugg

SEQ ID NO: 35087 - RNA, 18 nt, Artificial Sequence
  Description of Artificial Sequence: Synthetic oligonucleotide
aucaacaaugggcuccuu

SEQ ID NO: 35088 - RNA, 18 nt, Artificial Sequence
  Description of Artificial Sequence: Synthetic oligonucleotide
ucuucaucaacaaugggc

SEQ ID NO: 35089 - RNA, 18 nt, Artificial Sequence
  Description of Artificial Sequence: Synthetic oligonucleotide
caucaucuucaucaacaa

SEQ ID NO: 35090 - RNA, 18 nt, Artificial Sequence
  Description of Artificial Sequence: Synthetic oligonucleotide
cacaucaucaucuucauc

SEQ ID NO: 35091 - RNA, 18 nt, Artificial Sequence
  Description of Artificial Sequence: Synthetic oligonucleotide
ucagccacaucaucaucu

SEQ ID NO: 35092 - RNA, 18 nt, Artificial Sequence
  Description of Artificial Sequence: Synthetic oligonucleotide
uuucuucagccacaucau

SEQ ID NO: 35093 - RNA, 18 nt, Artificial Sequence
  Description of Artificial Sequence: Synthetic oligonucleotide
uugucuuucuucagccac

SEQ ID NO: 35094 - RNA, 18 nt, Artificial Sequence
  Description of Artificial Sequence: Synthetic oligonucleotide
auucuuugucuuucuuca

SEQ ID NO: 35095 - RNA, 18 nt, Artificial Sequence
  Description of Artificial Sequence: Synthetic oligonucleotide
uaauaauucuuugucuuu

SEQ ID NO: 35096 - RNA, 18 nt, Artificial Sequence
  Description of Artificial Sequence: Synthetic oligonucleotide
accaguaauaauucuuug

SEQ ID NO: 35097 - RNA, 18 nt, Artificial Sequence
  Description of Artificial Sequence: Synthetic oligonucleotide
uuuccaccaguaauaauu

SEQ ID NO: 35098 - RNA, 18 nt, Artificial Sequence
  Description of Artificial Sequence: Synthetic oligonucleotide
uuuuauuuccaccaguaa

SEQ ID NO: 35099 - RNA, 18 nt, Artificial Sequence
  Description of Artificial Sequence: Synthetic oligonucleotide
gucaguuuuauuuccacc

SEQ ID NO: 35100 - RNA, 18 nt, Artificial Sequence
  Description of Artificial Sequence: Synthetic oligonucleotide
aagaugucaguuuuauuu

SEQ ID NO: 35101 - RNA, 18 nt, Artificial Sequence
  Description of Artificial Sequence: Synthetic oligonucleotide
gccuuaagaugucaguuu

SEQ ID NO: 35102 - RNA, 18 nt, Artificial Sequence
  Description of Artificial Sequence: Synthetic oligonucleotide
auguagccuuaagauguc

SEQ ID NO: 35103 - RNA, 18 nt, Artificial Sequence
  Description of Artificial Sequence: Synthetic oligonucleotide
aguucauguagccuuaag

SEQ ID NO: 35104 - RNA, 18 nt, Artificial Sequence
  Description of Artificial Sequence: Synthetic oligonucleotide
ugguuaguucauguagcc

SEQ ID NO: 35105 - RNA, 18 nt, Artificial Sequence
  Description of Artificial Sequence: Synthetic oligonucleotide
aucaugggaaugaccgcc

SEQ ID NO: 35106 - RNA, 18 nt, Artificial Sequence
  Description of Artificial Sequence: Synthetic oligonucleotide
gguacaucaugggaauga

SEQ ID NO: 35107 - RNA, 18 nt, Artificial Sequence
  Description of Artificial Sequence: Synthetic oligonucleotide
ugcuggguacaucauggg

SEQ ID NO: 35108 - RNA, 18 nt, Artificial Sequence
  Description of Artificial Sequence: Synthetic oligonucleotide
aaggaugcuggguacauc

SEQ ID NO: 35109 - RNA, 18 nt, Artificial Sequence
  Description of Artificial Sequence: Synthetic oligonucleotide
acaggaaggaugcugggu

SEQ ID NO: 35110 - RNA, 18 nt, Artificial Sequence
  Description of Artificial Sequence: Synthetic oligonucleotide
aucaaacaggaaggaugc

SEQ ID NO: 35111 - RNA, 18 nt, Artificial Sequence
  Description of Artificial Sequence: Synthetic oligonucleotide
gggacaucaaacaggaag

SEQ ID NO: 35112 - RNA, 18 nt, Artificial Sequence
  Description of Artificial Sequence: Synthetic oligonucleotide
cacauaggcugugcuggg

SEQ ID NO: 35113 - RNA, 18 nt, Artificial Sequence
  Description of Artificial Sequence: Synthetic oligonucleotide
agccacauaggcugugcu

SEQ ID NO: 35114 - RNA, 18 nt, Artificial Sequence
  Description of Artificial Sequence: Synthetic oligonucleotide
gauaaagccacauaggcu

SEQ ID NO: 35115 - RNA, 18 nt, Artificial Sequence
  Description of Artificial Sequence: Synthetic oligonucleotide
cacaagauaaagccacau

SEQ ID NO: 35116 - RNA, 18 nt, Artificial Sequence
  Description of Artificial Sequence: Synthetic oligonucleotide
auuagcacaagauaaagc

SEQ ID NO: 35117 - RNA, 18 nt, Artificial Sequence
  Description of Artificial Sequence: Synthetic oligonucleotide
aacagauuagcacaagau

SEQ ID NO: 35118 - RNA, 18 nt, Artificial Sequence
  Description of Artificial Sequence: Synthetic oligonucleotide
cgaugaacagauuagcac

SEQ ID NO: 35119 - RNA, 18 nt, Artificial Sequence
  Description of Artificial Sequence: Synthetic oligonucleotide
gaugccgaugaacagauu

SEQ ID NO: 35120 - RNA, 18 nt, Artificial Sequence
  Description of Artificial Sequence: Synthetic oligonucleotide
cuguugaugccgaugaac

SEQ ID NO: 35121 - RNA, 18 nt, Artificial Sequence
  Description of Artificial Sequence: Synthetic oligonucleotide
cacugcuguugaugccga

SEQ ID NO: 35122 - RNA, 18 nt, Artificial Sequence
  Description of Artificial Sequence: Synthetic oligonucleotide
aauagcacugcuguugau

SEQ ID NO: 35123 - RNA, 18 nt, Artificial Sequence
  Description of Artificial Sequence: Synthetic oligonucleotide
aagguaauagcacugcug

SEQ ID NO: 35124 - RNA, 18 nt, Artificial Sequence
  Description of Artificial Sequence: Synthetic oligonucleotide
agaugaagguaauagcac

SEQ ID NO: 35125 - RNA, 18 nt, Artificial Sequence
  Description of Artificial Sequence: Synthetic oligonucleotide
uuccaagaugaagguaau

SEQ ID NO: 35126 - RNA, 18 nt, Artificial Sequence
  Description of Artificial Sequence: Synthetic oligonucleotide
aauaauuccaagaugaag

SEQ ID NO: 35127 - RNA, 18 nt, Artificial Sequence
  Description of Artificial Sequence: Synthetic oligonucleotide
ucucaaauaauuccaaga

SEQ ID NO: 35128 - RNA, 18 nt, Artificial Sequence
  Description of Artificial Sequence: Synthetic oligonucleotide
guuauucucaaauaauuc

SEQ ID NO: 35129 - RNA, 18 nt, Artificial Sequence
  Description of Artificial Sequence: Synthetic oligonucleotide
aaagccaagaaaguuaug

SEQ ID NO: 35130 - RNA, 18 nt, Artificial Sequence
  Description of Artificial Sequence: Synthetic oligonucleotide
acaaaaaagccaagaaag

SEQ ID NO: 35131 - RNA, 18 nt, Artificial Sequence
  Description of Artificial Sequence: Synthetic oligonucleotide
aucaaacaaaaaagccaa

SEQ ID NO: 35132 - RNA, 18 nt, Artificial Sequence
  Description of Artificial Sequence: Synthetic oligonucleotide
uacuaaucaaacaaaaaa

SEQ ID NO: 35133 - RNA, 18 nt, Artificial Sequence
  Description of Artificial Sequence: Synthetic oligonucleotide
uauccuacuaaucaaaca

SEQ ID NO: 35134 - RNA, 18 nt, Artificial Sequence
  Description of Artificial Sequence: Synthetic oligonucleotide
ucuacuauccuacuaauc

SEQ ID NO: 35135 - RNA, 18 nt, Artificial Sequence
  Description of Artificial Sequence: Synthetic oligonucleotide
cauacucuacuauccuac

SEQ ID NO: 35136 - RNA, 18 nt, Artificial Sequence
  Description of Artificial Sequence: Synthetic oligonucleotide
caacacauacucuacuau

SEQ ID NO: 35137 - RNA, 18 nt, Artificial Sequence
  Description of Artificial Sequence: Synthetic oligonucleotide
ucgaccaacacauacucu

SEQ ID NO: 35138 - RNA, 18 nt, Artificial Sequence
  Description of Artificial Sequence: Synthetic oligonucleotide
ucugcucgaccaacacau

SEQ ID NO: 35139 - RNA, 18 nt, Artificial Sequence
  Description of Artificial Sequence: Synthetic oligonucleotide
cuggcucugcucgaccaa

SEQ ID NO: 35140 - RNA, 18 nt, Artificial Sequence
  Description of Artificial Sequence: Synthetic oligonucleotide
ugccccuggcucugcucg

SEQ ID NO: 35141 - RNA, 18 nt, Artificial Sequence
  Description of Artificial Sequence: Synthetic oligonucleotide
augcuugccccuggcucu

SEQ ID NO: 35142 - RNA, 18 nt, Artificial Sequence
  Description of Artificial Sequence: Synthetic oligonucleotide
guacgaugcuugccccug

SEQ ID NO: 35143 - RNA, 18 nt, Artificial Sequence
  Description of Artificial Sequence: Synthetic oligonucleotide
uacauguacgaugcuugc

SEQ ID NO: 35144 - RNA, 18 nt, Artificial Sequence
  Description of Artificial Sequence: Synthetic oligonucleotide
gcugcuacauguacgaug

SEQ ID NO: 35145 - RNA, 18 nt, Artificial Sequence
  Description of Artificial Sequence: Synthetic oligonucleotide
auacagcugcuacaugua

SEQ ID NO: 35146 - RNA, 18 nt, Artificial Sequence
  Description of Artificial Sequence: Synthetic oligonucleotide
uccgcauacagcugcuac

SEQ ID NO: 35147 - RNA, 18 nt, Artificial Sequence
  Description of Artificial Sequence: Synthetic oligonucleotide
acucauccgcauacagcu

SEQ ID NO: 35148 - RNA, 18 nt, Artificial Sequence
  Description of Artificial Sequence: Synthetic oligonucleotide
guggcacucauccgcaua

SEQ ID NO: 35149 - RNA, 18 nt, Artificial Sequence
  Description of Artificial Sequence: Synthetic oligonucleotide
agaaaguggcacucaucc

SEQ ID NO: 35150 - RNA, 18 nt, Artificial Sequence
  Description of Artificial Sequence: Synthetic oligonucleotide
gaggaagaaaguggcacu

SEQ ID NO: 35151 - RNA, 18 nt, Artificial Sequence
  Description of Artificial Sequence: Synthetic oligonucleotide
guagggaggaagaaagug

SEQ ID NO: 35152 - RNA, 18 nt, Artificial Sequence
  Description of Artificial Sequence: Synthetic oligonucleotide
ggguagggaggaagaaag

SEQ ID NO: 35153 - RNA, 18 nt, Artificial Sequence
  Description of Artificial Sequence: Synthetic oligonucleotide
aaaggaggcagggucggg

SEQ ID NO: 35154 - RNA, 18 nt, Artificial Sequence
  Description of Artificial Sequence: Synthetic oligonucleotide
gaaggaaaggaggcaggg

SEQ ID NO: 35155 - RNA, 18 nt, Artificial Sequence
  Description of Artificial Sequence: Synthetic oligonucleotide
ggaaggaaggaaaggagg

SEQ ID NO: 35156 - RNA, 18 nt, Artificial Sequence
  Description of Artificial Sequence: Synthetic oligonucleotide
aggaaggaaggaaggaaa

SEQ ID NO: 35157 - RNA, 18 nt, Artificial Sequence
  Description of Artificial Sequence: Synthetic oligonucleotide
augggaggaaggaaggaa

SEQ ID NO: 35158 - RNA, 18 nt, Artificial Sequence
  Description of Artificial Sequence: Synthetic oligonucleotide
gaaggaugggaggaagga

SEQ ID NO: 35159 - RNA, 18 nt, Artificial Sequence
  Description of Artificial Sequence: Synthetic oligonucleotide
ggaaggaaggaugggagg

SEQ ID NO: 35160 - RNA, 18 nt, Artificial Sequence
  Description of Artificial Sequence: Synthetic oligonucleotide
aaagaggaaggaaggaug

SEQ ID NO: 35161 - RNA, 18 nt, Artificial Sequence
  Description of Artificial Sequence: Synthetic oligonucleotide
gaaggaaagaggaaggaa

SEQ ID NO: 35162 - RNA, 18 nt, Artificial Sequence
  Description of Artificial Sequence: Synthetic oligonucleotide
gagaagaaggaaagagga

SEQ ID NO: 35163 - RNA, 18 nt, Artificial Sequence
  Description of Artificial Sequence: Synthetic oligonucleotide
gggaggagaagaaggaaa

SEQ ID NO: 35164 - RNA, 18 nt, Artificial Sequence
  Description of Artificial Sequence: Synthetic oligonucleotide
gaggagggaggagaagaa

SEQ ID NO: 35165 - RNA, 18 nt, Artificial Sequence
  Description of Artificial Sequence: Synthetic oligonucleotide
ggagggaggagggaggag

SEQ ID NO: 35166 - RNA, 18 nt, Artificial Sequence
  Description of Artificial Sequence: Synthetic oligonucleotide
gggaaggagggaggaggg

SEQ ID NO: 35167 - RNA, 18 nt, Artificial Sequence
  Description of Artificial Sequence: Synthetic oligonucleotide
aaggaaggaaggagggac

SEQ ID NO: 35168 - RNA, 18 nt, Artificial Sequence
  Description of Artificial Sequence: Synthetic oligonucleotide
ugaaaaaggaaggaagga

SEQ ID NO: 35169 - RNA, 18 nt, Artificial Sequence
  Description of Artificial Sequence: Synthetic oligonucleotide
agcaaugaaaaaggaagg

SEQ ID NO: 35170 - RNA, 18 nt, Artificial Sequence
  Description of Artificial Sequence: Synthetic oligonucleotide
aaggaagcaaugaaaaag

SEQ ID NO: 35171 - RNA, 18 nt, Artificial Sequence
  Description of Artificial Sequence: Synthetic oligonucleotide
gaaggaaggaagcaauga

SEQ ID NO: 35172 - RNA, 18 nt, Artificial Sequence
  Description of Artificial Sequence: Synthetic oligonucleotide
cgaaggaaggaaggaagc

SEQ ID NO: 35173 - RNA, 18 nt, Artificial Sequence
  Description of Artificial Sequence: Synthetic oligonucleotide
agggacgaaggaaggaag

SEQ ID NO: 35174 - RNA, 18 nt, Artificial Sequence
  Description of Artificial Sequence: Synthetic oligonucleotide
gaaggagggacgaaggaa

SEQ ID NO: 35175 - RNA, 18 nt, Artificial Sequence
  Description of Artificial Sequence: Synthetic oligonucleotide
gaagggaaggagggacga

SEQ ID NO: 35176 - RNA, 18 nt, Artificial Sequence
  Description of Artificial Sequence: Synthetic oligonucleotide
aagaggaagggaaggagg

SEQ ID NO: 35177 - RNA, 18 nt, Artificial Sequence
  Description of Artificial Sequence: Synthetic oligonucleotide
aaggaaagaggaagggaa

SEQ ID NO: 35178 - RNA, 18 nt, Artificial Sequence
  Description of Artificial Sequence: Synthetic oligonucleotide
ggcagaaggaaagaggaa

SEQ ID NO: 35179 - RNA, 18 nt, Artificial Sequence
  Description of Artificial Sequence: Synthetic oligonucleotide
gagagggcagaaggaaag

SEQ ID NO: 35180 - RNA, 18 nt, Artificial Sequence
  Description of Artificial Sequence: Synthetic oligonucleotide
agggagagagggcagaag

SEQ ID NO: 35181 - RNA, 18 nt, Artificial Sequence
  Description of Artificial Sequence: Synthetic oligonucleotide
gaaaaagggagagagggc

SEQ ID NO: 35182 - RNA, 18 nt, Artificial Sequence
  Description of Artificial Sequence: Synthetic oligonucleotide
gaaaggaaaaagggagag

SEQ ID NO: 35183 - RNA, 18 nt, Artificial Sequence
  Description of Artificial Sequence: Synthetic oligonucleotide
aggaugaaaggaaaaagg

SEQ ID NO: 35184 - RNA, 18 nt, Artificial Sequence
  Description of Artificial Sequence: Synthetic oligonucleotide
gagggaggaugaaaggaa

SEQ ID NO: 35185 - RNA, 18 nt, Artificial Sequence
  Description of Artificial Sequence: Synthetic oligonucleotide
ggauggagggaggaugaa

SEQ ID NO: 35186 - RNA, 18 nt, Artificial Sequence
  Description of Artificial Sequence: Synthetic oligonucleotide
gggagggauggagggagg

SEQ ID NO: 35187 - RNA, 18 nt, Artificial Sequence
  Description of Artificial Sequence: Synthetic oligonucleotide
auggagggagggauggag

SEQ ID NO: 35188 - RNA, 18 nt, Artificial Sequence
  Description of Artificial Sequence: Synthetic oligonucleotide
gaaggauggagggaggga

SEQ ID NO: 35189 - RNA, 18 nt, Artificial Sequence
  Description of Artificial Sequence: Synthetic oligonucleotide
agaaggaaggauggaggg

SEQ ID NO: 35190 - RNA, 18 nt, Artificial Sequence
  Description of Artificial Sequence: Synthetic oligonucleotide
aagaaagaaggaaggaug

SEQ ID NO: 35191 - RNA, 18 nt, Artificial Sequence
  Description of Artificial Sequence: Synthetic oligonucleotide
gaaggaagaaagaaggaa

SEQ ID NO: 35192 - RNA, 18 nt, Artificial Sequence
  Description of Artificial Sequence: Synthetic oligonucleotide
ggaaagaaggaagaaaga

SEQ ID NO: 35193 - RNA, 18 nt, Artificial Sequence
  Description of Artificial Sequence: Synthetic oligonucleotide
aggaaggaaagaaggaag

SEQ ID NO: 35194 - RNA, 18 nt, Artificial Sequence
  Description of Artificial Sequence: Synthetic oligonucleotide
cuuauaggaaggaaagaa

SEQ ID NO: 35195 - RNA, 18 nt, Artificial Sequence
  Description of Artificial Sequence: Synthetic oligonucleotide
aggugcuuauaggaagga

SEQ ID NO: 35196 - RNA, 18 nt, Artificial Sequence
  Description of Artificial Sequence: Synthetic oligonucleotide
gaaaaaggugcuuauagg

SEQ ID NO: 35197 - RNA, 18 nt, Artificial Sequence
  Description of Artificial Sequence: Synthetic oligonucleotide
gaaaugaaaaaggugcuu

SEQ ID NO: 35198 - RNA, 18 nt, Artificial Sequence
  Description of Artificial Sequence: Synthetic oligonucleotide
gcacagaaaugaaaaagg

SEQ ID NO: 35199 - RNA, 18 nt, Artificial Sequence
  Description of Artificial Sequence: Synthetic oligonucleotide
ucagagcacagaaaugaa

SEQ ID NO: 35200 - RNA, 18 nt, Artificial Sequence
  Description of Artificial Sequence: Synthetic oligonucleotide
uucauucagagcacagaa

SEQ ID NO: 35201 - RNA, 18 nt, Artificial Sequence
  Description of Artificial Sequence: Synthetic oligonucleotide
accauuucauucagagca

SEQ ID NO: 35202 - RNA, 18 nt, Artificial Sequence
  Description of Artificial Sequence: Synthetic oligonucleotide
agaaaaccauuucauuca

SEQ ID NO: 35203 - RNA, 18 nt, Artificial Sequence
  Description of Artificial Sequence: Synthetic oligonucleotide
aacacagaaaaccauuuc

SEQ ID NO: 35204 - RNA, 18 nt, Artificial Sequence
  Description of Artificial Sequence: Synthetic oligonucleotide
gaauaaacacagaaaacc

SEQ ID NO: 35205 - RNA, 18 nt, Artificial Sequence
  Description of Artificial Sequence: Synthetic oligonucleotide
uugcagaauaaacacaga

SEQ ID NO: 35206 - RNA, 18 nt, Artificial Sequence
  Description of Artificial Sequence: Synthetic oligonucleotide
uuugcuugcagaauaaac

SEQ ID NO: 35207 - RNA, 18 nt, Artificial Sequence
  Description of Artificial Sequence: Synthetic oligonucleotide
caaguuuugcuugcagaa

SEQ ID NO: 35208 - RNA, 18 nt, Artificial Sequence
  Description of Artificial Sequence: Synthetic oligonucleotide
agaaucaaguuuugcuug

SEQ ID NO: 35209 - RNA, 18 nt, Artificial Sequence
  Description of Artificial Sequence: Synthetic oligonucleotide
uugcaagaaucaaguuuu

SEQ ID NO: 35210 - RNA, 18 nt, Artificial Sequence
  Description of Artificial Sequence: Synthetic oligonucleotide
guuuauugcaagaaucaa

SEQ ID NO: 35211 - RNA, 18 nt, Artificial Sequence
  Description of Artificial Sequence: Synthetic oligonucleotide
uuaaaguuuauugcaaga

SEQ ID NO: 35212 - RNA, 18 nt, Artificial Sequence
  Description of Artificial Sequence: Synthetic oligonucleotide
aaagcuuaaaguuuauug

SEQ ID NO: 35213 - RNA, 18 nt, Artificial Sequence
  Description of Artificial Sequence: Synthetic oligonucleotide
uaagcaaagcuuaaaguu

SEQ ID NO: 35214 - RNA, 18 nt, Artificial Sequence
  Description of Artificial Sequence: Synthetic oligonucleotide
aagaguaagcaaagcuua

SEQ ID NO: 35215 - RNA, 18 nt, Artificial Sequence
  Description of Artificial Sequence: Synthetic oligonucleotide
ucugaaagaguaagcaaa

SEQ ID NO: 35216 - RNA, 18 nt, Artificial Sequence
  Description of Artificial Sequence: Synthetic oligonucleotide
accuuucugaaagaguaa

SEQ ID NO: 35217 - RNA, 18 nt, Artificial Sequence
  Description of Artificial Sequence: Synthetic oligonucleotide
agaaaaccuuucugaaag

SEQ ID NO: 35218 - RNA, 18 nt, Artificial Sequence
  Description of Artificial Sequence: Synthetic oligonucleotide
cccugagaaaaccuuucu

SEQ ID NO: 35219 - RNA, 18 nt, Artificial Sequence
  Description of Artificial Sequence: Synthetic oligonucleotide
aaagucccugagaaaacc

SEQ ID NO: 35220 - RNA, 18 nt, Artificial Sequence
  Description of Artificial Sequence: Synthetic oligonucleotide
cacccaaagucccugaga

SEQ ID NO: 35221 - RNA, 18 nt, Artificial Sequence
  Description of Artificial Sequence: Synthetic oligonucleotide
cccaacacccaaaguccc

SEQ ID NO: 35222 - RNA, 18 nt, Artificial Sequence
  Description of Artificial Sequence: Synthetic oligonucleotide
uaaaacccaacacccaaa

SEQ ID NO: 35223 - RNA, 18 nt, Artificial Sequence
  Description of Artificial Sequence: Synthetic oligonucleotide
guguguaaaacccaacac

SEQ ID NO: 35224 - RNA, 18 nt, Artificial Sequence
  Description of Artificial Sequence: Synthetic oligonucleotide
caggagcccucaaggcau

SEQ ID NO: 35225 - RNA, 18 nt, Artificial Sequence
  Description of Artificial Sequence: Synthetic oligonucleotide
aacaacaggagcccucaa

SEQ ID NO: 35226 - RNA, 18 nt, Artificial Sequence
  Description of Artificial Sequence: Synthetic oligonucleotide
uuugaaacaacaggagcc

SEQ ID NO: 35227 - RNA, 18 nt, Artificial Sequence
  Description of Artificial Sequence: Synthetic oligonucleotide
cucacuuugaaacaacag

SEQ ID NO: 35228 - RNA, 18 nt, Artificial Sequence
  Description of Artificial Sequence: Synthetic oligonucleotide
gcagacucacuuugaaac

SEQ ID NO: 35229 - RNA, 18 nt, Artificial Sequence
  Description of Artificial Sequence: Synthetic oligonucleotide
ucccugcagacucacuuu

SEQ ID NO: 35230 - RNA, 18 nt, Artificial Sequence
  Description of Artificial Sequence: Synthetic oligonucleotide
agcucucccugcagacuc

SEQ ID NO: 35231 - RNA, 18 nt, Artificial Sequence
  Description of Artificial Sequence: Synthetic oligonucleotide
uagggagcucucccugca

SEQ ID NO: 35232 - RNA, 18 nt, Artificial Sequence
  Description of Artificial Sequence: Synthetic oligonucleotide
ccacuuagggagcucucc

SEQ ID NO: 35233 - RNA, 18 nt, Artificial Sequence
  Description of Artificial Sequence: Synthetic oligonucleotide
gcuguccacuuagggagc

SEQ ID NO: 35234 - RNA, 18 nt, Artificial Sequence
  Description of Artificial Sequence: Synthetic oligonucleotide
cuccugcuguccacuuag

SEQ ID NO: 35235 - RNA, 18 nt, Artificial Sequence
  Description of Artificial Sequence: Synthetic oligonucleotide
cagcccuccugcugucca

SEQ ID NO: 35236 - RNA, 18 nt, Artificial Sequence
  Description of Artificial Sequence: Synthetic oligonucleotide
agcugcagcccuccugcu

SEQ ID NO: 35237 - RNA, 18 nt, Artificial Sequence
  Description of Artificial Sequence: Synthetic oligonucleotide
agagaagcugcagcccuc

SEQ ID NO: 35238 - RNA, 18 nt, Artificial Sequence
  Description of Artificial Sequence: Synthetic oligonucleotide
ugugcagagaagcugcag

SEQ ID NO: 35239 - RNA, 18 nt, Artificial Sequence
  Description of Artificial Sequence: Synthetic oligonucleotide
aggaaugugcagagaagc

SEQ ID NO: 35240 - RNA, 18 nt, Artificial Sequence
  Description of Artificial Sequence: Synthetic oligonucleotide
acagcaggaaugugcaga

SEQ ID NO: 35241 - RNA, 18 nt, Artificial Sequence
  Description of Artificial Sequence: Synthetic oligonucleotide
gggugacagcaggaaugu

SEQ ID NO: 35242 - RNA, 18 nt, Artificial Sequence
  Description of Artificial Sequence: Synthetic oligonucleotide
ccccuaggugacucuggg

SEQ ID NO: 35243 - RNA, 18 nt, Artificial Sequence
  Description of Artificial Sequence: Synthetic oligonucleotide
ccuccccuaggugacucu

SEQ ID NO: 35244 - RNA, 18 nt, Artificial Sequence
  Description of Artificial Sequence: Synthetic oligonucleotide
uuaccccuccccuaggug

SEQ ID NO: 35245 - RNA, 18 nt, Artificial Sequence
  Description of Artificial Sequence: Synthetic oligonucleotide
uguccuuaccccuccccu

SEQ ID NO: 35246 - RNA, 18 nt, Artificial Sequence
  Description of Artificial Sequence: Synthetic oligonucleotide
auuacuguccuuaccccu

SEQ ID NO: 35247 - RNA, 18 nt, Artificial Sequence
  Description of Artificial Sequence: Synthetic oligonucleotide
ccugcauuacuguccuua

SEQ ID NO: 35248 - RNA, 18 nt, Artificial Sequence
  Description of Artificial Sequence: Synthetic oligonucleotide
aggaaccugcauuacugu

SEQ ID NO: 35249 - RNA, 18 nt, Artificial Sequence
  Description of Artificial Sequence: Synthetic oligonucleotide
cugugaggaaccugcauu

SEQ ID NO: 35250 - RNA, 18 nt, Artificial Sequence
  Description of Artificial Sequence: Synthetic oligonucleotide
gcuaacugugaggaaccu

SEQ ID NO: 35251 - RNA, 18 nt, Artificial Sequence
  Description of Artificial Sequence: Synthetic oligonucleotide
ccgaggcuaacugugagg

SEQ ID NO: 35252 - RNA, 18 nt, Artificial Sequence
  Description of Artificial Sequence: Synthetic oligonucleotide
gggcaccgaggcuaacug

SEQ ID NO: 35253 - RNA, 18 nt, Artificial Sequence
  Description of Artificial Sequence: Synthetic oligonucleotide
caugugggcaccgaggcu

SEQ ID NO: 35254 - RNA, 18 nt, Artificial Sequence
  Description of Artificial Sequence: Synthetic oligonucleotide
aguaccaugugggcaccg

SEQ ID NO: 35255 - RNA, 18 nt, Artificial Sequence
  Description of Artificial Sequence: Synthetic oligonucleotide
ugcucaguaccauguggg

SEQ ID NO: 35256 - RNA, 18 nt, Artificial Sequence
  Description of Artificial Sequence: Synthetic oligonucleotide
uacuaugcucaguaccau

SEQ ID NO: 35257 - RNA, 18 nt, Artificial Sequence
  Description of Artificial Sequence: Synthetic oligonucleotide
acauuuacuaugcucagu

SEQ ID NO: 35258 - RNA, 18 nt, Artificial Sequence
  Description of Artificial Sequence: Synthetic oligonucleotide
ucuaaacauuuacuaugc

SEQ ID NO: 35259 - RNA, 18 nt, Artificial Sequence
  Description of Artificial Sequence: Synthetic oligonucleotide
caucuucuaaacauuuac

SEQ ID NO: 35260 - RNA, 18 nt, Artificial Sequence
  Description of Artificial Sequence: Synthetic oligonucleotide
ggcagcaucuucuaaaca

SEQ ID NO: 35261 - RNA, 18 nt, Artificial Sequence
  Description of Artificial Sequence: Synthetic oligonucleotide
agccaggcagcaucuucu

SEQ ID NO: 35262 - RNA, 18 nt, Artificial Sequence
  Description of Artificial Sequence: Synthetic oligonucleotide
ugucuagccaggcagcau

SEQ ID NO: 35263 - RNA, 18 nt, Artificial Sequence
  Description of Artificial Sequence: Synthetic oligonucleotide
cccuuugucuagccaggc

SEQ ID NO: 35264 - RNA, 18 nt, Artificial Sequence
  Description of Artificial Sequence: Synthetic oligonucleotide
gcuuccccuuugucuagc

SEQ ID NO: 35265 - RNA, 18 nt, Artificial Sequence
  Description of Artificial Sequence: Synthetic oligonucleotide
cgggagcuuccccuuugu

SEQ ID NO: 35266 - RNA, 18 nt, Artificial Sequence
  Description of Artificial Sequence: Synthetic oligonucleotide
gugggcgggagcuucccc

SEQ ID NO: 35267 - RNA, 18 nt, Artificial Sequence
  Description of Artificial Sequence: Synthetic oligonucleotide
uucuagugggcgggagcu

SEQ ID NO: 35268 - RNA, 18 nt, Artificial Sequence
  Description of Artificial Sequence: Synthetic oligonucleotide
caaguuucuagugggcgg

SEQ ID NO: 35269 - RNA, 18 nt, Artificial Sequence
  Description of Artificial Sequence: Synthetic oligonucleotide
cccugcaaguuucuagug

SEQ ID NO: 35270 - RNA, 18 nt, Artificial Sequence
  Description of Artificial Sequence: Synthetic oligonucleotide
gggcucccugcaaguuuc

SEQ ID NO: 35271 - RNA, 18 nt, Artificial Sequence
  Description of Artificial Sequence: Synthetic oligonucleotide
gaccaaucaaggacuggg

SEQ ID NO: 35272 - RNA, 18 nt, Artificial Sequence
  Description of Artificial Sequence: Synthetic oligonucleotide
ugaccaaucaaggacugg

SEQ ID NO: 35273 - RNA, 18 nt, Artificial Sequence
  Description of Artificial Sequence: Synthetic oligonucleotide
uuaaaugaccaaucaagg

SEQ ID NO: 35274 - RNA, 18 nt, Artificial Sequence
  Description of Artificial Sequence: Synthetic oligonucleotide
aucaauuaaaugaccaau

SEQ ID NO: 35275 - RNA, 18 nt, Artificial Sequence
  Description of Artificial Sequence: Synthetic oligonucleotide
agcuaaucaauuaaauga

SEQ ID NO: 35276 - RNA, 18 nt, Artificial Sequence
  Description of Artificial Sequence: Synthetic oligonucleotide
caaggagcuaaucaauua

SEQ ID NO: 35277 - RNA, 18 nt, Artificial Sequence
  Description of Artificial Sequence: Synthetic oligonucleotide
caggccaaggagcuaauc

SEQ ID NO: 35278 - RNA, 18 nt, Artificial Sequence
  Description of Artificial Sequence: Synthetic oligonucleotide
aaggccaggccaaggagc

SEQ ID NO: 35279 - RNA, 18 nt, Artificial Sequence
  Description of Artificial Sequence: Synthetic oligonucleotide
gccucaaggccaggccaa

SEQ ID NO: 35280 - RNA, 18 nt, Artificial Sequence
  Description of Artificial Sequence: Synthetic oligonucleotide
gcagugccucaaggccag

SEQ ID NO: 35281 - RNA, 18 nt, Artificial Sequence
  Description of Artificial Sequence: Synthetic oligonucleotide
uacaagcagugccucaag

SEQ ID NO: 35282 - RNA, 18 nt, Artificial Sequence
  Description of Artificial Sequence: Synthetic oligonucleotide
guacuuacaagcagugcc

SEQ ID NO: 35283 - RNA, 18 nt, Artificial Sequence
  Description of Artificial Sequence: Synthetic oligonucleotide
augaaguacuuacaagca

SEQ ID NO: 35284 - RNA, 18 nt, Artificial Sequence
  Description of Artificial Sequence: Synthetic oligonucleotide
aggucaugaaguacuuac

SEQ ID NO: 35285 - RNA, 18 nt, Artificial Sequence
  Description of Artificial Sequence: Synthetic oligonucleotide
aauggaggucaugaagua

SEQ ID NO: 35286 - RNA, 18 nt, Artificial Sequence
  Description of Artificial Sequence: Synthetic oligonucleotide
uuugcaauggaggucaug

SEQ ID NO: 35287 - RNA, 18 nt, Artificial Sequence
  Description of Artificial Sequence: Synthetic oligonucleotide
auggguuugcaauggagg

SEQ ID NO: 35288 - RNA, 18 nt, Artificial Sequence
  Description of Artificial Sequence: Synthetic oligonucleotide
gcaucauggguuugcaau

SEQ ID NO: 35289 - RNA, 18 nt, Artificial Sequence
  Description of Artificial Sequence: Synthetic oligonucleotide
gcagagcaucauggguuu

SEQ ID NO: 35290 - RNA, 18 nt, Artificial Sequence
  Description of Artificial Sequence: Synthetic oligonucleotide
guccagcagagcaucaug

SEQ ID NO: 35291 - RNA, 18 nt, Artificial Sequence
  Description of Artificial Sequence: Synthetic oligonucleotide
gauuuguccagcagagca

SEQ ID NO: 35292 - RNA, 18 nt, Artificial Sequence
  Description of Artificial Sequence: Synthetic oligonucleotide
ggagggauuuguccagca

SEQ ID NO: 35293 - RNA, 18 nt, Artificial Sequence
  Description of Artificial Sequence: Synthetic oligonucleotide
ccacuggagggauuuguc

SEQ ID NO: 35294 - RNA, 18 nt, Artificial Sequence
  Description of Artificial Sequence: Synthetic oligonucleotide
acuggccacuggagggau

SEQ ID NO: 35295 - RNA, 18 nt, Artificial Sequence
  Description of Artificial Sequence: Synthetic oligonucleotide
gccagacuggccacugga

SEQ ID NO: 35296 - RNA, 18 nt, Artificial Sequence
  Description of Artificial Sequence: Synthetic oligonucleotide
uugcagccagacuggcca

SEQ ID NO: 35297 - RNA, 18 nt, Artificial Sequence
  Description of Artificial Sequence: Synthetic oligonucleotide
aguccuugcagccagacu

SEQ ID NO: 35298 - RNA, 18 nt, Artificial Sequence
  Description of Artificial Sequence: Synthetic oligonucleotide
cagagaguccuugcagcc

SEQ ID NO: 35299 - RNA, 18 nt, Artificial Sequence
  Description of Artificial Sequence: Synthetic oligonucleotide
gcagacagagaguccuug

SEQ ID NO: 35300 - RNA, 18 nt, Artificial Sequence
  Description of Artificial Sequence: Synthetic oligonucleotide
ggccugcagacagagagu

SEQ ID NO: 35301 - RNA, 18 nt, Artificial Sequence
  Description of Artificial Sequence: Synthetic oligonucleotide
ggcaaggccugcagacag

SEQ ID NO: 35302 - RNA, 18 nt, Artificial Sequence
  Description of Artificial Sequence: Synthetic oligonucleotide
cacagggcaaggccugca

SEQ ID NO: 35303 - RNA, 18 nt, Artificial Sequence
  Description of Artificial Sequence: Synthetic oligonucleotide
gacagcacagggcaaggc

SEQ ID NO: 35304 - RNA, 18 nt, Artificial Sequence
  Description of Artificial Sequence: Synthetic oligonucleotide
cacaggacagcacagggc

SEQ ID NO: 35305 - RNA, 18 nt, Artificial Sequence
  Description of Artificial Sequence: Synthetic oligonucleotide
gcucucacaggacagcac

SEQ ID NO: 35306 - RNA, 18 nt, Artificial Sequence
  Description of Artificial Sequence: Synthetic oligonucleotide
cagaugcucucacaggac

SEQ ID NO: 35307 - RNA, 18 nt, Artificial Sequence
  Description of Artificial Sequence: Synthetic oligonucleotide
gggcccagaugcucucac

SEQ ID NO: 35308 - RNA, 18 nt, Artificial Sequence
  Description of Artificial Sequence: Synthetic oligonucleotide
cucucuucagcagguggg

SEQ ID NO: 35309 - RNA, 18 nt, Artificial Sequence
  Description of Artificial Sequence: Synthetic oligonucleotide
cccccucucuucagcagg

SEQ ID NO: 35310 - RNA, 18 nt, Artificial Sequence
  Description of Artificial Sequence: Synthetic oligonucleotide
ccacccccccucucuuca

SEQ ID NO: 35311 - RNA, 18 nt, Artificial Sequence
  Description of Artificial Sequence: Synthetic oligonucleotide
aaaccccacccccccucu

SEQ ID NO: 35312 - RNA, 18 nt, Artificial Sequence
  Description of Artificial Sequence: Synthetic oligonucleotide
aggacuguuggaaacggg

SEQ ID NO: 35313 - RNA, 18 nt, Artificial Sequence
  Description of Artificial Sequence: Synthetic oligonucleotide
cguugaaccugagcagcg

SEQ ID NO: 35314 - RNA, 18 nt, Artificial Sequence
  Description of Artificial Sequence: Synthetic oligonucleotide
cacggcguugaaccugag

SEQ ID NO: 35315 - RNA, 18 nt, Artificial Sequence
  Description of Artificial Sequence: Synthetic oligonucleotide
cucagcacggcguugaac

SEQ ID NO: 35316 - RNA, 18 nt, Artificial Sequence
  Description of Artificial Sequence: Synthetic oligonucleotide
gcuuccucagcacggcgu

SEQ ID NO: 35317 - RNA, 18 nt, Artificial Sequence
  Description of Artificial Sequence: Synthetic oligonucleotide
gagcagcuuccucagcac

SEQ ID NO: 35318 - RNA, 18 nt, Artificial Sequence
  Description of Artificial Sequence: Synthetic oligonucleotide
acaaugagcagcuuccuc

SEQ ID NO: 35319 - RNA, 18 nt, Artificial Sequence
  Description of Artificial Sequence: Synthetic oligonucleotide
ggaagacaaugagcagcu

SEQ ID NO: 35320 - RNA, 18 nt, Artificial Sequence
  Description of Artificial Sequence: Synthetic oligonucleotide
gggaagacaaugagcagc

SEQ ID NO: 35321 - RNA, 18 nt, Artificial Sequence
  Description of Artificial Sequence: Synthetic oligonucleotide
ggcccaggcagaaguggg

SEQ ID NO: 35322 - RNA, 18 nt, Artificial Sequence
  Description of Artificial Sequence: Synthetic oligonucleotide
gccccggcccaggcagaa

SEQ ID NO: 35323 - RNA, 18 nt, Artificial Sequence
  Description of Artificial Sequence: Synthetic oligonucleotide
augaggccccggcccagg

SEQ ID NO: 35324 - RNA, 18 nt, Artificial Sequence
  Description of Artificial Sequence: Synthetic oligonucleotide
ggucaaugaggccccggc

SEQ ID NO: 35325 - RNA, 18 nt, Artificial Sequence
  Description of Artificial Sequence: Synthetic oligonucleotide
ugcaaggucaaugaggcc

SEQ ID NO: 35326 - RNA, 18 nt, Artificial Sequence
  Description of Artificial Sequence: Synthetic oligonucleotide
cucagugcaaggucaaug

SEQ ID NO: 35327 - RNA, 18 nt, Artificial Sequence
  Description of Artificial Sequence: Synthetic oligonucleotide
ccuggcucagugcaaggu

SEQ ID NO: 35328 - RNA, 18 nt, Artificial Sequence
  Description of Artificial Sequence: Synthetic oligonucleotide
cacagccuggcucagugc

SEQ ID NO: 35329 - RNA, 18 nt, Artificial Sequence
  Description of Artificial Sequence: Synthetic oligonucleotide
ucugucacagccuggcuc

SEQ ID NO: 35330 - RNA, 18 nt, Artificial Sequence
  Description of Artificial Sequence: Synthetic oligonucleotide
agacaucugucacagccu

SEQ ID NO: 35331 - RNA, 18 nt, Artificial Sequence
  Description of Artificial Sequence: Synthetic oligonucleotide
ggcauagacaucugucac

SEQ ID NO: 35332 - RNA, 18 nt, Artificial Sequence
  Description of Artificial Sequence: Synthetic oligonucleotide
aaccgggcauagacaucu

SEQ ID NO: 35333 - RNA, 18 nt, Artificial Sequence
  Description of Artificial Sequence: Synthetic oligonucleotide
gcauccacugaagugguc

SEQ ID NO: 35334 - RNA, 18 nt, Artificial Sequence
  Description of Artificial Sequence: Synthetic oligonucleotide
ccacagcauccacugaag

SEQ ID NO: 35335 - RNA, 18 nt, Artificial Sequence
  Description of Artificial Sequence: Synthetic oligonucleotide
ggcaaccacagcauccac

SEQ ID NO: 35336 - RNA, 18 nt, Artificial Sequence
  Description of Artificial Sequence: Synthetic oligonucleotide
cagauggcaaccacagca

SEQ ID NO: 35337 - RNA, 18 nt, Artificial Sequence
  Description of Artificial Sequence: Synthetic oligonucleotide
ucacgcagauggcaacca

SEQ ID NO: 35338 - RNA, 18 nt, Artificial Sequence
  Description of Artificial Sequence: Synthetic oligonucleotide
gaaaaucacgcagauggc

SEQ ID NO: 35339 - RNA, 18 nt, Artificial Sequence
  Description of Artificial Sequence: Synthetic oligonucleotide
auggagaaaaucacgcag

SEQ ID NO: 35340 - RNA, 18 nt, Artificial Sequence
  Description of Artificial Sequence: Synthetic oligonucleotide
aggacauggagaaaauca

SEQ ID NO: 35341 - RNA, 18 nt, Artificial Sequence
  Description of Artificial Sequence: Synthetic oligonucleotide
gacgaaggacauggagaa

SEQ ID NO: 35342 - RNA, 18 nt, Artificial Sequence
  Description of Artificial Sequence: Synthetic oligonucleotide
gcugggacgaaggacaug

SEQ ID NO: 35343 - RNA, 18 nt, Artificial Sequence
  Description of Artificial Sequence: Synthetic oligonucleotide
agcuggcugggacgaagg

SEQ ID NO: 35344 - RNA, 18 nt, Artificial Sequence
  Description of Artificial Sequence: Synthetic oligonucleotide
gacaaagcuggcugggac

SEQ ID NO: 35345 - RNA, 18 nt, Artificial Sequence
  Description of Artificial Sequence: Synthetic oligonucleotide
uaaaggacaaagcuggcu

SEQ ID NO: 35346 - RNA, 18 nt, Artificial Sequence
  Description of Artificial Sequence: Synthetic oligonucleotide
ucaaauaaaggacaaagc

SEQ ID NO: 35347 - RNA, 18 nt, Artificial Sequence
  Description of Artificial Sequence: Synthetic oligonucleotide
cuggaucaaauaaaggac

SEQ ID NO: 35348 - RNA, 18 nt, Artificial Sequence
  Description of Artificial Sequence: Synthetic oligonucleotide
cgcuccuggaucaaauaa

SEQ ID NO: 35349 - RNA, 18 nt, Artificial Sequence
  Description of Artificial Sequence: Synthetic oligonucleotide
ucacccgcuccuggauca

SEQ ID NO: 35350 - RNA, 18 nt, Artificial Sequence
  Description of Artificial Sequence: Synthetic oligonucleotide
uuuguucacccgcuccug

SEQ ID NO: 35351 - RNA, 18 nt, Artificial Sequence
  Description of Artificial Sequence: Synthetic oligonucleotide
uuggauuuguucacccgc

SEQ ID NO: 35352 - RNA, 18 nt, Artificial Sequence
  Description of Artificial Sequence: Synthetic oligonucleotide
ggugcuuggauuuguuca

SEQ ID NO: 35353 - RNA, 18 nt, Artificial Sequence
  Description of Artificial Sequence: Synthetic oligonucleotide
cuggaggugcuuggauuu

SEQ ID NO: 35354 - RNA, 18 nt, Artificial Sequence
  Description of Artificial Sequence: Synthetic oligonucleotide
auaaacuggaggugcuug

SEQ ID NO: 35355 - RNA, 18 nt, Artificial Sequence
  Description of Artificial Sequence: Synthetic oligonucleotide
cacugauaaacuggaggu

SEQ ID NO: 35356 - RNA, 18 nt, Artificial Sequence
  Description of Artificial Sequence: Synthetic oligonucleotide
cacuccacugauaaacug

SEQ ID NO: 35357 - RNA, 18 nt, Artificial Sequence
  Description of Artificial Sequence: Synthetic oligonucleotide
gggcucacuccacugaua

SEQ ID NO: 35358 - RNA, 18 nt, Artificial Sequence
  Description of Artificial Sequence: Synthetic oligonucleotide
cacccaguaggugguggg

SEQ ID NO: 35359 - RNA, 18 nt, Artificial Sequence
  Description of Artificial Sequence: Synthetic oligonucleotide
ggucacccaguagguggu

SEQ ID NO: 35360 - RNA, 18 nt, Artificial Sequence
  Description of Artificial Sequence: Synthetic oligonucleotide
aaguuggucacccaguag

SEQ ID NO: 35361 - RNA, 18 nt, Artificial Sequence
  Description of Artificial Sequence: Synthetic oligonucleotide
agaggaaguuggucaccc

SEQ ID NO: 35362 - RNA, 18 nt, Artificial Sequence
  Description of Artificial Sequence: Synthetic oligonucleotide
gucccagaggaaguuggu

SEQ ID NO: 35363 - RNA, 18 nt, Artificial Sequence
  Description of Artificial Sequence: Synthetic oligonucleotide
aggcgcuguaaacugaca

SEQ ID NO: 35364 - RNA, 18 nt, Artificial Sequence
  Description of Artificial Sequence: Synthetic oligonucleotide
gagggaggcgcuguaaac

SEQ ID NO: 35365 - RNA, 18 nt, Artificial Sequence
  Description of Artificial Sequence: Synthetic oligonucleotide
gggagggaggcgcuguaa

SEQ ID NO: 35366 - RNA, 18 nt, Artificial Sequence
  Description of Artificial Sequence: Synthetic oligonucleotide
ccuugggcccacggaggg

SEQ ID NO: 35367 - RNA, 18 nt, Artificial Sequence
  Description of Artificial Sequence: Synthetic oligonucleotide
cuccaccuugggcccacg

SEQ ID NO: 35368 - RNA, 18 nt, Artificial Sequence
  Description of Artificial Sequence: Synthetic oligonucleotide
acaagcuccaccuugggc

SEQ ID NO: 35369 - RNA, 18 nt, Artificial Sequence
  Description of Artificial Sequence: Synthetic oligonucleotide
cacacacaagcuccaccu

SEQ ID NO: 35370 - RNA, 18 nt, Artificial Sequence
  Description of Artificial Sequence: Synthetic oligonucleotide
cagagcacacacaagcuc

SEQ ID NO: 35371 - RNA, 18 nt, Artificial Sequence
  Description of Artificial Sequence: Synthetic oligonucleotide
uccuucagagcacacaca

SEQ ID NO: 35372 - RNA, 18 nt, Artificial Sequence
  Description of Artificial Sequence: Synthetic oligonucleotide
ucugguccuucagagcac

SEQ ID NO: 35373 - RNA, 18 nt, Artificial Sequence
  Description of Artificial Sequence: Synthetic oligonucleotide
cuuggucugguccuucag

SEQ ID NO: 35374 - RNA, 18 nt, Artificial Sequence
  Description of Artificial Sequence: Synthetic oligonucleotide
ccccucuuggucuggucc

SEQ ID NO: 35375 - RNA, 18 nt, Artificial Sequence
  Description of Artificial Sequence: Synthetic oligonucleotide
ccccuccccucuuggucu

SEQ ID NO: 35376 - RNA, 18 nt, Artificial Sequence
  Description of Artificial Sequence: Synthetic oligonucleotide
gagaaccccuccccucuu

SEQ ID NO: 35377 - RNA, 18 nt, Artificial Sequence
  Description of Artificial Sequence: Synthetic oligonucleotide
accgugagaaccccuccc

SEQ ID NO: 35378 - RNA, 18 nt, Artificial Sequence
  Description of Artificial Sequence: Synthetic oligonucleotide
cuggcaccgugagaaccc

SEQ ID NO: 35379 - RNA, 18 nt, Artificial Sequence
  Description of Artificial Sequence: Synthetic oligonucleotide
cagcccuggcaccgugag

SEQ ID NO: 35380 - RNA, 18 nt, Artificial Sequence
  Description of Artificial Sequence: Synthetic oligonucleotide
uucagcagcccuggcacc

SEQ ID NO: 35381 - RNA, 18 nt, Artificial Sequence
  Description of Artificial Sequence: Synthetic oligonucleotide
ugccuuucagcagcccug

SEQ ID NO: 35382 - RNA, 18 nt, Artificial Sequence
  Description of Artificial Sequence: Synthetic oligonucleotide
cccagugccuuucagcag

SEQ ID NO: 35383 - RNA, 18 nt, Artificial Sequence
  Description of Artificial Sequence: Synthetic oligonucleotide
cuuggcccagugccuuuc

SEQ ID NO: 35384 - RNA, 18 nt, Artificial Sequence
  Description of Artificial Sequence: Synthetic oligonucleotide
aggcccuuggcccagugc

SEQ ID NO: 35385 - RNA, 18 nt, Artificial Sequence
  Description of Artificial Sequence: Synthetic oligonucleotide
acacaaggcccuuggccc

SEQ ID NO: 35386 - RNA, 18 nt, Artificial Sequence
  Description of Artificial Sequence: Synthetic oligonucleotide
cagauacacaaggcccuu

SEQ ID NO: 35387 - RNA, 18 nt, Artificial Sequence
  Description of Artificial Sequence: Synthetic oligonucleotide
gacagcagauacacaagg

SEQ ID NO: 35388 - RNA, 18 nt, Artificial Sequence
  Description of Artificial Sequence: Synthetic oligonucleotide
caagggacagcagauaca

SEQ ID NO: 35389 - RNA, 18 nt, Artificial Sequence
  Description of Artificial Sequence: Synthetic oligonucleotide
gaugucaagggacagcag

SEQ ID NO: 35390 - RNA, 18 nt, Artificial Sequence
  Description of Artificial Sequence: Synthetic oligonucleotide
gagaagaugucaagggac

SEQ ID NO: 35391 - RNA, 18 nt, Artificial Sequence
  Description of Artificial Sequence: Synthetic oligonucleotide
uuucugagaagaugucaa

SEQ ID NO: 35392 - RNA, 18 nt, Artificial Sequence
  Description of Artificial Sequence: Synthetic oligonucleotide
gugccuuucugagaagau

SEQ ID NO: 35393 - RNA, 18 nt, Artificial Sequence
  Description of Artificial Sequence: Synthetic oligonucleotide
guucugugccuuucugag

SEQ ID NO: 35394 - RNA, 18 nt, Artificial Sequence
  Description of Artificial Sequence: Synthetic oligonucleotide
uccuaguucugugccuuu

SEQ ID NO: 35395 - RNA, 18 nt, Artificial Sequence
  Description of Artificial Sequence: Synthetic oligonucleotide
cgggcuccuaguucugug

SEQ ID NO: 35396 - RNA, 18 nt, Artificial Sequence
  Description of Artificial Sequence: Synthetic oligonucleotide
agcuucgggcuccuaguu

SEQ ID NO: 35397 - RNA, 18 nt, Artificial Sequence
  Description of Artificial Sequence: Synthetic oligonucleotide
uuccuagcuucgggcucc

SEQ ID NO: 35398 - RNA, 18 nt, Artificial Sequence
  Description of Artificial Sequence: Synthetic oligonucleotide
agccuuuccuagcuucgg

SEQ ID NO: 35399 - RNA, 18 nt, Artificial Sequence
  Description of Artificial Sequence: Synthetic oligonucleotide
cccacagccuuuccuagc

SEQ ID NO: 35400 - RNA, 18 nt, Artificial Sequence
  Description of Artificial Sequence: Synthetic oligonucleotide
ugcaccccacagccuuuc

SEQ ID NO: 35401 - RNA, 18 nt, Artificial Sequence
  Description of Artificial Sequence: Synthetic oligonucleotide
uaagcugcaccccacagc

SEQ ID NO: 35402 - RNA, 18 nt, Artificial Sequence
  Description of Artificial Sequence: Synthetic oligonucleotide
guuguuaagcugcacccc

SEQ ID NO: 35403 - RNA, 18 nt, Artificial Sequence
  Description of Artificial Sequence: Synthetic oligonucleotide
caccaguuguuaagcugc

SEQ ID NO: 35404 - RNA, 18 nt, Artificial Sequence
  Description of Artificial Sequence: Synthetic oligonucleotide
ccguucaccaguuguuaa

SEQ ID NO: 35405 - RNA, 18 nt, Artificial Sequence
  Description of Artificial Sequence: Synthetic oligonucleotide
agcccccguucaccaguu

SEQ ID NO: 35406 - RNA, 18 nt, Artificial Sequence
  Description of Artificial Sequence: Synthetic oligonucleotide
uagagagcccccguucac

SEQ ID NO: 35407 - RNA, 18 nt, Artificial Sequence
  Description of Artificial Sequence: Synthetic oligonucleotide
ggacauagagagcccccg

SEQ ID NO: 35408 - RNA, 18 nt, Artificial Sequence
  Description of Artificial Sequence: Synthetic oligonucleotide
gugcaggacauagagagc

SEQ ID NO: 35409 - RNA, 18 nt, Artificial Sequence
  Description of Artificial Sequence: Synthetic oligonucleotide
ccucagugcaggacauag

SEQ ID NO: 35410 - RNA, 18 nt, Artificial Sequence
  Description of Artificial Sequence: Synthetic oligonucleotide
agaccccucagugcagga

SEQ ID NO: 35411 - RNA, 18 nt, Artificial Sequence
  Description of Artificial Sequence: Synthetic oligonucleotide
ucagaagaccccucagug

SEQ ID NO: 35412 - RNA, 18 nt, Artificial Sequence
  Description of Artificial Sequence: Synthetic oligonucleotide
augggucagaagaccccu

SEQ ID NO: 35413 - RNA, 18 nt, Artificial Sequence
  Description of Artificial Sequence: Synthetic oligonucleotide
auuugaugggucagaaga

SEQ ID NO: 35414 - RNA, 18 nt, Artificial Sequence
  Description of Artificial Sequence: Synthetic oligonucleotide
ugauuauuugauggguca

SEQ ID NO: 35415 - RNA, 18 nt, Artificial Sequence
  Description of Artificial Sequence: Synthetic oligonucleotide
ugcagugauuauuugaug

SEQ ID NO: 35416 - RNA, 18 nt, Artificial Sequence
  Description of Artificial Sequence: Synthetic oligonucleotide
ugcggugcagugauuauu

SEQ ID NO: 35417 - RNA, 18 nt, Artificial Sequence
  Description of Artificial Sequence: Synthetic oligonucleotide
augccugcggugcaguga

SEQ ID NO: 35418 - RNA, 18 nt, Artificial Sequence
  Description of Artificial Sequence: Synthetic oligonucleotide
gacucaugccugcggugc

SEQ ID NO: 35419 - RNA, 18 nt, Artificial Sequence
  Description of Artificial Sequence: Synthetic oligonucleotide
ggccagacucaugccugc

SEQ ID NO: 35420 - RNA, 18 nt, Artificial Sequence
  Description of Artificial Sequence: Synthetic oligonucleotide
aggaaggccagacucaug

SEQ ID NO: 35421 - RNA, 18 nt, Artificial Sequence
  Description of Artificial Sequence: Synthetic oligonucleotide
augccaggaaggccagac

SEQ ID NO: 35422 - RNA, 18 nt, Artificial Sequence
  Description of Artificial Sequence: Synthetic oligonucleotide
gacugaugccaggaaggc

SEQ ID NO: 35423 - RNA, 18 nt, Artificial Sequence
  Description of Artificial Sequence: Synthetic oligonucleotide
cgccagacugaugccagg

SEQ ID NO: 35424 - RNA, 18 nt, Artificial Sequence
  Description of Artificial Sequence: Synthetic oligonucleotide
cucagcgccagacugaug

SEQ ID NO: 35425 - RNA, 18 nt, Artificial Sequence
  Description of Artificial Sequence: Synthetic oligonucleotide
accuucucagcgccagac

SEQ ID NO: 35426 - RNA, 18 nt, Artificial Sequence
  Description of Artificial Sequence: Synthetic oligonucleotide
auauuaccuucucagcgc

SEQ ID NO: 35427 - RNA, 18 nt, Artificial Sequence
  Description of Artificial Sequence: Synthetic oligonucleotide
ccuucauauuaccuucuc

SEQ ID NO: 35428 - RNA, 18 nt, Artificial Sequence
  Description of Artificial Sequence: Synthetic oligonucleotide
agaccccuucauauuacc

SEQ ID NO: 35429 - RNA, 18 nt, Artificial Sequence
  Description of Artificial Sequence: Synthetic oligonucleotide
gugaaagaccccuucaua

SEQ ID NO: 35430 - RNA, 18 nt, Artificial Sequence
  Description of Artificial Sequence: Synthetic oligonucleotide
gggugaaagaccccuuca

SEQ ID NO: 35431 - RNA, 18 nt, Artificial Sequence
  Description of Artificial Sequence: Synthetic oligonucleotide
ggcaggauuugagaaggg

SEQ ID NO: 35432 - RNA, 18 nt, Artificial Sequence
  Description of Artificial Sequence: Synthetic oligonucleotide
gggcaggauuugagaagg

SEQ ID NO: 35433 - RNA, 18 nt, Artificial Sequence
  Description of Artificial Sequence: Synthetic oligonucleotide
uacccuuuugaagguggg

SEQ ID NO: 35434 - RNA, 18 nt, Artificial Sequence
  Description of Artificial Sequence: Synthetic oligonucleotide
accuuuacccuuuugaag

SEQ ID NO: 35435 - RNA, 18 nt, Artificial Sequence
  Description of Artificial Sequence: Synthetic oligonucleotide
guuuuaccuuuacccuuu

SEQ ID NO: 35436 - RNA, 18 nt, Artificial Sequence
  Description of Artificial Sequence: Synthetic oligonucleotide
ggaaaguuuuaccuuuac

SEQ ID NO: 35437 - RNA, 18 nt, Artificial Sequence
  Description of Artificial Sequence: Synthetic oligonucleotide
cacagggaaaguuuuacc

SEQ ID NO: 35438 - RNA, 18 nt, Artificial Sequence
  Description of Artificial Sequence: Synthetic oligonucleotide
ccuaccacagggaaaguu

SEQ ID NO: 35439 - RNA, 18 nt, Artificial Sequence
  Description of Artificial Sequence: Synthetic oligonucleotide
gugacccuaccacaggga

SEQ ID NO: 35440 - RNA, 18 nt, Artificial Sequence
  Description of Artificial Sequence: Synthetic oligonucleotide
aucuggugacccuaccac

SEQ ID NO: 35441 - RNA, 18 nt, Artificial Sequence
  Description of Artificial Sequence: Synthetic oligonucleotide
uauuuaucuggugacccu

SEQ ID NO: 35442 - RNA, 18 nt, Artificial Sequence
  Description of Artificial Sequence: Synthetic oligonucleotide
uccuguauuuaucuggug

SEQ ID NO: 35443 - RNA, 18 nt, Artificial Sequence
  Description of Artificial Sequence: Synthetic oligonucleotide
ggguguccuguauuuauc

SEQ ID NO: 35444 - RNA, 18 nt, Artificial Sequence
  Description of Artificial Sequence: Synthetic oligonucleotide
uaacuggguguccuguau

SEQ ID NO: 35445 - RNA, 18 nt, Artificial Sequence
  Description of Artificial Sequence: Synthetic oligonucleotide
aaauuuaacugggugucc

SEQ ID NO: 35446 - RNA, 18 nt, Artificial Sequence
  Description of Artificial Sequence: Synthetic oligonucleotide
aaauuaaauuuaacuggg

SEQ ID NO: 35447 - RNA, 18 nt, Artificial Sequence
  Description of Artificial Sequence: Synthetic oligonucleotide
aucugaaauuaaauuuaa

SEQ ID NO: 35448 - RNA, 18 nt, Artificial Sequence
  Description of Artificial Sequence: Synthetic oligonucleotide
ucaucaucugaaauuaaa

SEQ ID NO: 35449 - RNA, 18 nt, Artificial Sequence
  Description of Artificial Sequence: Synthetic oligonucleotide
auuauucaucaucugaaa

SEQ ID NO: 35450 - RNA, 18 nt, Artificial Sequence
  Description of Artificial Sequence: Synthetic oligonucleotide
uaaaaauuauucaucauc

SEQ ID NO: 35451 - RNA, 18 nt, Artificial Sequence
  Description of Artificial Sequence: Synthetic oligonucleotide
uauacuaaaaauuauuca

SEQ ID NO: 35452 - RNA, 18 nt, Artificial Sequence
  Description of Artificial Sequence: Synthetic oligonucleotide
augcuuauacuaaaaauu

SEQ ID NO: 35453 - RNA, 18 nt, Artificial Sequence
  Description of Artificial Sequence: Synthetic oligonucleotide
agcauaugcuuauacuaa

SEQ ID NO: 35454 - RNA, 18 nt, Artificial Sequence
  Description of Artificial Sequence: Synthetic oligonucleotide
gaaguagcauaugcuuau

SEQ ID NO: 35455 - RNA, 18 nt, Artificial Sequence
  Description of Artificial Sequence: Synthetic oligonucleotide
uauuugaaguagcauaug

SEQ ID NO: 35456 - RNA, 18 nt, Artificial Sequence
  Description of Artificial Sequence: Synthetic oligonucleotide
agacgggcuuccucaggg

SEQ ID NO: 35457 - RNA, 18 nt, Artificial Sequence
  Description of Artificial Sequence: Synthetic oligonucleotide
ccagagacgggcuuccuc

SEQ ID NO: 35458 - RNA, 18 nt, Artificial Sequence
  Description of Artificial Sequence: Synthetic oligonucleotide
aagaaccagagacgggcu

SEQ ID NO: 35459 - RNA, 18 nt, Artificial Sequence
  Description of Artificial Sequence: Synthetic oligonucleotide
agggcaagaaccagagac

SEQ ID NO: 35460 - RNA, 18 nt, Artificial Sequence
  Description of Artificial Sequence: Synthetic oligonucleotide
ggagcagggcaagaacca

SEQ ID NO: 35461 - RNA, 18 nt, Artificial Sequence
  Description of Artificial Sequence: Synthetic oligonucleotide
gaucaggagcagggcaag

SEQ ID NO: 35462 - RNA, 18 nt, Artificial Sequence
  Description of Artificial Sequence: Synthetic oligonucleotide
auggugaucaggagcagg

SEQ ID NO: 35463 - RNA, 18 nt, Artificial Sequence
  Description of Artificial Sequence: Synthetic oligonucleotide
gagccauggugaucagga

SEQ ID NO: 35464 - RNA, 18 nt, Artificial Sequence
  Description of Artificial Sequence: Synthetic oligonucleotide
gggaggagccauggugau

SEQ ID NO: 35465 - RNA, 18 nt, Artificial Sequence
  Description of Artificial Sequence: Synthetic oligonucleotide
uacugggcacagaaaggg

SEQ ID NO: 35466 - RNA, 18 nt, Artificial Sequence
  Description of Artificial Sequence: Synthetic oligonucleotide
auacugggcacagaaagg

SEQ ID NO: 35467 - RNA, 18 nt, Artificial Sequence
  Description of Artificial Sequence: Synthetic oligonucleotide
ccacuauacugggcacag

SEQ ID NO: 35468 - RNA, 18 nt, Artificial Sequence
  Description of Artificial Sequence: Synthetic oligonucleotide
uacagccacuauacuggg

SEQ ID NO: 35469 - RNA, 18 nt, Artificial Sequence
  Description of Artificial Sequence: Synthetic oligonucleotide
aguccuacagccacuaua

SEQ ID NO: 35470 - RNA, 18 nt, Artificial Sequence
  Description of Artificial Sequence: Synthetic oligonucleotide
aauuuaguccuacagcca

SEQ ID NO: 35471 - RNA, 18 nt, Artificial Sequence
  Description of Artificial Sequence: Synthetic oligonucleotide
uaaacaauuuaguccuac

SEQ ID NO: 35472 - RNA, 18 nt, Artificial Sequence
  Description of Artificial Sequence: Synthetic oligonucleotide
cuuuuuaaacaauuuagu

SEQ ID NO: 35473 - RNA, 18 nt, Artificial Sequence
  Description of Artificial Sequence: Synthetic oligonucleotide
auacccuuuuuaaacaau

SEQ ID NO: 35474 - RNA, 18 nt, Artificial Sequence
  Description of Artificial Sequence: Synthetic oligonucleotide
uaaugauacccuuuuuaa

SEQ ID NO: 35475 - RNA, 18 nt, Artificial Sequence
  Description of Artificial Sequence: Synthetic oligonucleotide
auaaauaaugauacccuu

SEQ ID NO: 35476 - RNA, 18 nt, Artificial Sequence
  Description of Artificial Sequence: Synthetic oligonucleotide
cucaaauaaauaaugaua

SEQ ID NO: 35477 - RNA, 18 nt, Artificial Sequence
  Description of Artificial Sequence: Synthetic oligonucleotide
caaagcucaaauaaauaa

SEQ ID NO: 35478 - RNA, 18 nt, Artificial Sequence
  Description of Artificial Sequence: Synthetic oligonucleotide
cuucacaaagcucaaaua

SEQ ID NO: 35479 - RNA, 18 nt, Artificial Sequence
  Description of Artificial Sequence: Synthetic oligonucleotide
cuuggcuucacaaagcuc

SEQ ID NO: 35480 - RNA, 18 nt, Artificial Sequence
  Description of Artificial Sequence: Synthetic oligonucleotide
uaguucuuggcuucacaa

SEQ ID NO: 35481 - RNA, 18 nt, Artificial Sequence
  Description of Artificial Sequence: Synthetic oligonucleotide
aagccuaguucuuggcuu

SEQ ID NO: 35482 - RNA, 18 nt, Artificial Sequence
  Description of Artificial Sequence: Synthetic oligonucleotide
acuuaaagccuaguucuu

SEQ ID NO: 35483 - RNA, 18 nt, Artificial Sequence
  Description of Artificial Sequence: Synthetic oligonucleotide
gaaaaacuuaaagccuag

SEQ ID NO: 35484 - RNA, 18 nt, Artificial Sequence
  Description of Artificial Sequence: Synthetic oligonucleotide
auucagaaaaacuuaaag

SEQ ID NO: 35485 - RNA, 18 nt, Artificial Sequence
  Description of Artificial Sequence: Synthetic oligonucleotide
ucagaauucagaaaaacu

SEQ ID NO: 35486 - RNA, 18 nt, Artificial Sequence
  Description of Artificial Sequence: Synthetic oligonucleotide
ugucuucagaauucagaa

SEQ ID NO: 35487 - RNA, 18 nt, Artificial Sequence
  Description of Artificial Sequence: Synthetic oligonucleotide
aagcaugucuucagaauu

SEQ ID NO: 35488 - RNA, 18 nt, Artificial Sequence
  Description of Artificial Sequence: Synthetic oligonucleotide
uuucuaagcaugucuuca

SEQ ID NO: 35489 - RNA, 18 nt, Artificial Sequence
  Description of Artificial Sequence: Synthetic oligonucleotide
ucuucuuucuaagcaugu

SEQ ID NO: 35490 - RNA, 18 nt, Artificial Sequence
  Description of Artificial Sequence: Synthetic oligonucleotide
uugauucuucuuucuaag

SEQ ID NO: 35491 - RNA, 18 nt, Artificial Sequence
  Description of Artificial Sequence: Synthetic oligonucleotide
uuuuguugauucuucuuu

SEQ ID NO: 35492 - RNA, 18 nt, Artificial Sequence
  Description of Artificial Sequence: Synthetic oligonucleotide
uaaaguuuuguugauucu

SEQ ID NO: 35493 - RNA, 18 nt, Artificial Sequence
  Description of Artificial Sequence: Synthetic oligonucleotide
ggucauaaaguuuuguug

SEQ ID NO: 35494 - RNA, 18 nt, Artificial Sequence
  Description of Artificial Sequence: Synthetic oligonucleotide
uauuuggucauaaaguuu

SEQ ID NO: 35495 - RNA, 18 nt, Artificial Sequence
  Description of Artificial Sequence: Synthetic oligonucleotide
cuuucuauuuggucauaa

SEQ ID NO: 35496 - RNA, 18 nt, Artificial Sequence
  Description of Artificial Sequence: Synthetic oligonucleotide
ucacucuuucuauuuggu

SEQ ID NO: 35497 - RNA, 18 nt, Artificial Sequence
  Description of Artificial Sequence: Synthetic oligonucleotide
gucucucacucuuucuau

SEQ ID NO: 35498 - RNA, 18 nt, Artificial Sequence
  Description of Artificial Sequence: Synthetic oligonucleotide
gccuggucucucacucuu

SEQ ID NO: 35499 - RNA, 18 nt, Artificial Sequence
  Description of Artificial Sequence: Synthetic oligonucleotide
auucugccuggucucuca

SEQ ID NO: 35500 - RNA, 18 nt, Artificial Sequence
  Description of Artificial Sequence: Synthetic oligonucleotide
acaaaauucugccugguc

SEQ ID NO: 35501 - RNA, 18 nt, Artificial Sequence
  Description of Artificial Sequence: Synthetic oligonucleotide
caauuacaaaauucugcc

SEQ ID NO: 35502 - RNA, 18 nt, Artificial Sequence
  Description of Artificial Sequence: Synthetic oligonucleotide
aggaucaauuacaaaauu

SEQ ID NO: 35503 - RNA, 18 nt, Artificial Sequence
  Description of Artificial Sequence: Synthetic oligonucleotide
uugaaaggaucaauuaca

SEQ ID NO: 35504 - RNA, 18 nt, Artificial Sequence
  Description of Artificial Sequence: Synthetic oligonucleotide
aucuuuugaaaggaucaa

SEQ ID NO: 35505 - RNA, 18 nt, Artificial Sequence
  Description of Artificial Sequence: Synthetic oligonucleotide
uuuguaucuuuugaaagg

SEQ ID NO: 35506 - RNA, 18 nt, Artificial Sequence
  Description of Artificial Sequence: Synthetic oligonucleotide
uuuaguuuguaucuuuug

SEQ ID NO: 35507 - RNA, 18 nt, Artificial Sequence
  Description of Artificial Sequence: Synthetic oligonucleotide
gaaccuuuaguuuguauc

SEQ ID NO: 35508 - RNA, 18 nt, Artificial Sequence
  Description of Artificial Sequence: Synthetic oligonucleotide
caagggaaccuuuaguuu

SEQ ID NO: 35509 - RNA, 18 nt, Artificial Sequence
  Description of Artificial Sequence: Synthetic oligonucleotide
ccugccaagggaaccuuu

SEQ ID NO: 35510 - RNA, 18 nt, Artificial Sequence
  Description of Artificial Sequence: Synthetic oligonucleotide
accucccugccaagggaa

SEQ ID NO: 35511 - RNA, 18 nt, Artificial Sequence
  Description of Artificial Sequence: Synthetic oligonucleotide
gcccuaccucccugccaa

SEQ ID NO: 35512 - RNA, 18 nt, Artificial Sequence
  Description of Artificial Sequence: Synthetic oligonucleotide
cccaugcccuaccucccu

SEQ ID NO: 35513 - RNA, 18 nt, Artificial Sequence
  Description of Artificial Sequence: Synthetic oligonucleotide
cccaccccaugcccuacc

SEQ ID NO: 35514 - RNA, 18 nt, Artificial Sequence
  Description of Artificial Sequence: Synthetic oligonucleotide
ccuaccccaccccaugcc

SEQ ID NO: 35515 - RNA, 18 nt, Artificial Sequence
  Description of Artificial Sequence: Synthetic oligonucleotide
guccuccuaccccacccc

SEQ ID NO: 35516 - RNA, 18 nt, Artificial Sequence
  Description of Artificial Sequence: Synthetic oligonucleotide
cacuaguccuccuacccc

SEQ ID NO: 35517 - RNA, 18 nt, Artificial Sequence
  Description of Artificial Sequence: Synthetic oligonucleotide
gcugucacuaguccuccu

SEQ ID NO: 35518 - RNA, 18 nt, Artificial Sequence
  Description of Artificial Sequence: Synthetic oligonucleotide
guuaagcugucacuaguc

SEQ ID NO: 35519 - RNA, 18 nt, Artificial Sequence
  Description of Artificial Sequence: Synthetic oligonucleotide
cauauguuaagcugucac

SEQ ID NO: 35520 - RNA, 18 nt, Artificial Sequence
  Description of Artificial Sequence: Synthetic oligonucleotide
gcaaacauauguuaagcu

SEQ ID NO: 35521 - RNA, 18 nt, Artificial Sequence
  Description of Artificial Sequence: Synthetic oligonucleotide
gguuggcaaacauauguu

SEQ ID NO: 35522 - RNA, 18 nt, Artificial Sequence
  Description of Artificial Sequence: Synthetic oligonucleotide
uucuugguuggcaaacau

SEQ ID NO: 35523 - RNA, 18 nt, Artificial Sequence
  Description of Artificial Sequence: Synthetic oligonucleotide
aacaguucuugguuggca

SEQ ID NO: 35524 - RNA, 18 nt, Artificial Sequence
  Description of Artificial Sequence: Synthetic oligonucleotide
uuuuaaacaguucuuggu

SEQ ID NO: 35525 - RNA, 18 nt, Artificial Sequence
  Description of Artificial Sequence: Synthetic oligonucleotide
uugcuuuuuaaacaguuc

SEQ ID NO: 35526 - RNA, 18 nt, Artificial Sequence
  Description of Artificial Sequence: Synthetic oligonucleotide
ucgacuugcuuuuuaaac

SEQ ID NO: 35527 - RNA, 18 nt, Artificial Sequence
  Description of Artificial Sequence: Synthetic oligonucleotide
cugauucgacuugcuuuu

SEQ ID NO: 35528 - RNA, 18 nt, Artificial Sequence
  Description of Artificial Sequence: Synthetic oligonucleotide
ggauucugauucgacuug

SEQ ID NO: 35529 - RNA, 18 nt, Artificial Sequence
  Description of Artificial Sequence: Synthetic oligonucleotide
gucugggauucugauucg

SEQ ID NO: 35530 - RNA, 18 nt, Artificial Sequence
  Description of Artificial Sequence: Synthetic oligonucleotide
guagggucugggauucug

SEQ ID NO: 35531 - RNA, 18 nt, Artificial Sequence
  Description of Artificial Sequence: Synthetic oligonucleotide
agcucguagggucuggga

SEQ ID NO: 35532 - RNA, 18 nt, Artificial Sequence
  Description of Artificial Sequence: Synthetic oligonucleotide
ccuccagcucguaggguc

SEQ ID NO: 35533 - RNA, 18 nt, Artificial Sequence
  Description of Artificial Sequence: Synthetic oligonucleotide
aggcuccuccagcucgua

SEQ ID NO: 35534 - RNA, 18 nt, Artificial Sequence
  Description of Artificial Sequence: Synthetic oligonucleotide
gggccaggcuccuccagc

SEQ ID NO: 35535 - RNA, 18 nt, Artificial Sequence
  Description of Artificial Sequence: Synthetic oligonucleotide
agcucugcaaaaugaggg

SEQ ID NO: 35536 - RNA, 18 nt, Artificial Sequence
  Description of Artificial Sequence: Synthetic oligonucleotide
cagcucugcaaaaugagg

SEQ ID NO: 35537 - RNA, 18 nt, Artificial Sequence
  Description of Artificial Sequence: Synthetic oligonucleotide
gcugccagcucugcaaaa

SEQ ID NO: 35538 - RNA, 18 nt, Artificial Sequence
  Description of Artificial Sequence: Synthetic oligonucleotide
gaccugcugccagcucug

SEQ ID NO: 35539 - RNA, 18 nt, Artificial Sequence
  Description of Artificial Sequence: Synthetic oligonucleotide
ucucagaccugcugccag

SEQ ID NO: 35540 - RNA, 18 nt, Artificial Sequence
  Description of Artificial Sequence: Synthetic oligonucleotide
uaaccucucagaccugcu

SEQ ID NO: 35541 - RNA, 18 nt, Artificial Sequence
  Description of Artificial Sequence: Synthetic oligonucleotide
ucacuuaaccucucagac

SEQ ID NO: 35542 - RNA, 18 nt, Artificial Sequence
  Description of Artificial Sequence: Synthetic oligonucleotide
gcaagucacuuaaccucu

SEQ ID NO: 35543 - RNA, 18 nt, Artificial Sequence
  Description of Artificial Sequence: Synthetic oligonucleotide
ggagagcaagucacuuaa

SEQ ID NO: 35544 - RNA, 18 nt, Artificial Sequence
  Description of Artificial Sequence: Synthetic oligonucleotide
cacucacggaauaauuca

SEQ ID NO: 35545 - RNA, 18 nt, Artificial Sequence
  Description of Artificial Sequence: Synthetic oligonucleotide
cccagcacucacggaaua

SEQ ID NO: 35546 - RNA, 18 nt, Artificial Sequence
  Description of Artificial Sequence: Synthetic oligonucleotide
accagcccagcacucacg

SEQ ID NO: 35547 - RNA, 18 nt, Artificial Sequence
  Description of Artificial Sequence: Synthetic oligonucleotide
ccaccaccagcccagcac

SEQ ID NO: 35548 - RNA, 18 nt, Artificial Sequence
  Description of Artificial Sequence: Synthetic oligonucleotide
gaugcccaccaccagccc

SEQ ID NO: 35549 - RNA, 18 nt, Artificial Sequence
  Description of Artificial Sequence: Synthetic oligonucleotide
augaagaugcccaccacc

SEQ ID NO: 35550 - RNA, 18 nt, Artificial Sequence
  Description of Artificial Sequence: Synthetic oligonucleotide
acccgaugaagaugccca

SEQ ID NO: 35551 - RNA, 18 nt, Artificial Sequence
  Description of Artificial Sequence: Synthetic oligonucleotide
cugaaacccgaugaagau

SEQ ID NO: 35552 - RNA, 18 nt, Artificial Sequence
  Description of Artificial Sequence: Synthetic oligonucleotide
uucuucugaaacccgaug

SEQ ID NO: 35553 - RNA, 18 nt, Artificial Sequence
  Description of Artificial Sequence: Synthetic oligonucleotide
aggcuuucuucugaaacc

SEQ ID NO: 35554 - RNA, 18 nt, Artificial Sequence
  Description of Artificial Sequence: Synthetic oligonucleotide
aguguaggcuuucuucug

SEQ ID NO: 35555 - RNA, 18 nt, Artificial Sequence
  Description of Artificial Sequence: Synthetic oligonucleotide
ggagaaguguaggcuuuc

SEQ ID NO: 35556 - RNA, 18 nt, Artificial Sequence
  Description of Artificial Sequence: Synthetic oligonucleotide
uuucuggagaaguguagg

SEQ ID NO: 35557 - RNA, 18 nt, Artificial Sequence
  Description of Artificial Sequence: Synthetic oligonucleotide
aagguuuucuggagaagu

SEQ ID NO: 35558 - RNA, 18 nt, Artificial Sequence
  Description of Artificial Sequence: Synthetic oligonucleotide
gcaggaagguuuucugga

SEQ ID NO: 35559 - RNA, 18 nt, Artificial Sequence
  Description of Artificial Sequence: Synthetic oligonucleotide
caagggcaggaagguuuu

SEQ ID NO: 35560 - RNA, 18 nt, Artificial Sequence
  Description of Artificial Sequence: Synthetic oligonucleotide
ugccacaagggcaggaag

SEQ ID NO: 35561 - RNA, 18 nt, Artificial Sequence
  Description of Artificial Sequence: Synthetic oligonucleotide
agcagugccacaagggca

SEQ ID NO: 35562 - RNA, 18 nt, Artificial Sequence
  Description of Artificial Sequence: Synthetic oligonucleotide
gcaggagcagugccacaa

SEQ ID NO: 35563 - RNA, 18 nt, Artificial Sequence
  Description of Artificial Sequence: Synthetic oligonucleotide
auacagcaggagcagugc

SEQ ID NO: 35564 - RNA, 18 nt, Artificial Sequence
  Description of Artificial Sequence: Synthetic oligonucleotide
agaaauauugguuaaaau

SEQ ID NO: 35565 - RNA, 18 nt, Artificial Sequence
  Description of Artificial Sequence: Synthetic oligonucleotide
acuucagaaauauugguu

SEQ ID NO: 35566 - RNA, 18 nt, Artificial Sequence
  Description of Artificial Sequence: Synthetic oligonucleotide
gauggacuucagaaauau

SEQ ID NO: 35567 - RNA, 18 nt, Artificial Sequence
  Description of Artificial Sequence: Synthetic oligonucleotide
auuuugauggacuucaga

SEQ ID NO: 35568 - RNA, 18 nt, Artificial Sequence
  Description of Artificial Sequence: Synthetic oligonucleotide
cccauauuuugauggacu

SEQ ID NO: 35569 - RNA, 18 nt, Artificial Sequence
  Description of Artificial Sequence: Synthetic oligonucleotide
aguagcccauauuuugau

SEQ ID NO: 35570 - RNA, 18 nt, Artificial Sequence
  Description of Artificial Sequence: Synthetic oligonucleotide
aggacaguagcccauauu

SEQ ID NO: 35571 - RNA, 18 nt, Artificial Sequence
  Description of Artificial Sequence: Synthetic oligonucleotide
aacugaggacaguagccc

SEQ ID NO: 35572 - RNA, 18 nt, Artificial Sequence
  Description of Artificial Sequence: Synthetic oligonucleotide
caucaaacugaggacagu

SEQ ID NO: 35573 - RNA, 18 nt, Artificial Sequence
  Description of Artificial Sequence: Synthetic oligonucleotide
aauugcaucaaacugagg

SEQ ID NO: 35574 - RNA, 18 nt, Artificial Sequence
  Description of Artificial Sequence: Synthetic oligonucleotide
ucaucaauugcaucaaac

SEQ ID NO: 35575 - RNA, 18 nt, Artificial Sequence
  Description of Artificial Sequence: Synthetic oligonucleotide
gcagcucaucaauugcau

SEQ ID NO: 35576 - RNA, 18 nt, Artificial Sequence
  Description of Artificial Sequence: Synthetic oligonucleotide
ugugagcagcucaucaau

SEQ ID NO: 35577 - RNA, 18 nt, Artificial Sequence
  Description of Artificial Sequence: Synthetic oligonucleotide
cguccugugagcagcuca

SEQ ID NO: 35578 - RNA, 18 nt, Artificial Sequence
  Description of Artificial Sequence: Synthetic oligonucleotide
guucucguccugugagca

SEQ ID NO: 35579 - RNA, 18 nt, Artificial Sequence
  Description of Artificial Sequence: Synthetic oligonucleotide
aagauguucucguccugu

SEQ ID NO: 35580 - RNA, 18 nt, Artificial Sequence
  Description of Artificial Sequence: Synthetic oligonucleotide
agguaaagauguucucgu

SEQ ID NO: 35581 - RNA, 18 nt, Artificial Sequence
  Description of Artificial Sequence: Synthetic oligonucleotide
cauaaagguaaagauguu

SEQ ID NO: 35582 - RNA, 18 nt, Artificial Sequence
  Description of Artificial Sequence: Synthetic oligonucleotide
ccgggcauaaagguaaag

SEQ ID NO: 35583 - RNA, 18 nt, Artificial Sequence
  Description of Artificial Sequence: Synthetic oligonucleotide
cgaagccgggcauaaagg

SEQ ID NO: 35584 - RNA, 18 nt, Artificial Sequence
  Description of Artificial Sequence: Synthetic oligonucleotide
caccucgaagccgggcau

SEQ ID NO: 35585 - RNA, 18 nt, Artificial Sequence
  Description of Artificial Sequence: Synthetic oligonucleotide
ugguacaccucgaagccg

SEQ ID NO: 35586 - RNA, 18 nt, Artificial Sequence
  Description of Artificial Sequence: Synthetic oligonucleotide
ucugcugguacaccucga

SEQ ID NO: 35587 - RNA, 18 nt, Artificial Sequence
  Description of Artificial Sequence: Synthetic oligonucleotide
uuucuucugcugguacac

SEQ ID NO: 35588 - RNA, 18 nt, Artificial Sequence
  Description of Artificial Sequence: Synthetic oligonucleotide
uucgauuucuucugcugg

SEQ ID NO: 35589 - RNA, 18 nt, Artificial Sequence
  Description of Artificial Sequence: Synthetic oligonucleotide
ggccacaacaaaacauuu

SEQ ID NO: 35590 - RNA, 18 nt, Artificial Sequence
  Description of Artificial Sequence: Synthetic oligonucleotide
uauguggccacaacaaaa

SEQ ID NO: 35591 - RNA, 18 nt, Artificial Sequence
  Description of Artificial Sequence: Synthetic oligonucleotide
acuccuauguggccacaa

SEQ ID NO: 35592 - RNA, 18 nt, Artificial Sequence
  Description of Artificial Sequence: Synthetic oligonucleotide
accagacuccuauguggc

SEQ ID NO: 35593 - RNA, 18 nt, Artificial Sequence
  Description of Artificial Sequence: Synthetic oligonucleotide
aauuaaccagacuccuau

SEQ ID NO: 35594 - RNA, 18 nt, Artificial Sequence
  Description of Artificial Sequence: Synthetic oligonucleotide
cuuguaauuaaccagacu

SEQ ID NO: 35595 - RNA, 18 nt, Artificial Sequence
  Description of Artificial Sequence: Synthetic oligonucleotide
acaggcuuguaauuaacc

SEQ ID NO: 35596 - RNA, 18 nt, Artificial Sequence
  Description of Artificial Sequence: Synthetic oligonucleotide
augaaacaggcuuguaau

SEQ ID NO: 35597 - RNA, 18 nt, Artificial Sequence
  Description of Artificial Sequence: Synthetic oligonucleotide
cucucaugaaacaggcuu

SEQ ID NO: 35598 - RNA, 18 nt, Artificial Sequence
  Description of Artificial Sequence: Synthetic oligonucleotide
augcacucucaugaaaca

SEQ ID NO: 35599 - RNA, 18 nt, Artificial Sequence
  Description of Artificial Sequence: Synthetic oligonucleotide
agagaaugcacucucaug

SEQ ID NO: 35600 - RNA, 18 nt, Artificial Sequence
  Description of Artificial Sequence: Synthetic oligonucleotide
cuccaagagaaugcacuc

SEQ ID NO: 35601 - RNA, 18 nt, Artificial Sequence
  Description of Artificial Sequence: Synthetic oligonucleotide
cucaucuccaagagaaug

SEQ ID NO: 35602 - RNA, 18 nt, Artificial Sequence
  Description of Artificial Sequence: Synthetic oligonucleotide
aguuucucaucuccaaga

SEQ ID NO: 35603 - RNA, 18 nt, Artificial Sequence
  Description of Artificial Sequence: Synthetic oligonucleotide
gcuucaguuucucaucuc

SEQ ID NO: 35604 - RNA, 18 nt, Artificial Sequence
  Description of Artificial Sequence: Synthetic oligonucleotide
agcacgcuucaguuucuc

SEQ ID NO: 35605 - RNA, 18 nt, Artificial Sequence
  Description of Artificial Sequence: Synthetic oligonucleotide
ugaauagcacgcuucagu

SEQ ID NO: 35606 - RNA, 18 nt, Artificial Sequence
  Description of Artificial Sequence: Synthetic oligonucleotide
augaaugaauagcacgcu

SEQ ID NO: 35607 - RNA, 18 nt, Artificial Sequence
  Description of Artificial Sequence: Synthetic oligonucleotide
aaugaaugaaugaauagc

SEQ ID NO: 35608 - RNA, 18 nt, Artificial Sequence
  Description of Artificial Sequence: Synthetic oligonucleotide
guuggaaugaaugaauga

SEQ ID NO: 35609 - RNA, 18 nt, Artificial Sequence
  Description of Artificial Sequence: Synthetic oligonucleotide
cauuuguuggaaugaaug

SEQ ID NO: 35610 - RNA, 18 nt, Artificial Sequence
  Description of Artificial Sequence: Synthetic oligonucleotide
guaaacauuuguuggaau

SEQ ID NO: 35611 - RNA, 18 nt, Artificial Sequence
  Description of Artificial Sequence: Synthetic oligonucleotide
acauaguaaacauuuguu

SEQ ID NO: 35612 - RNA, 18 nt, Artificial Sequence
  Description of Artificial Sequence: Synthetic oligonucleotide
uagacacauaguaaacau

SEQ ID NO: 35613 - RNA, 18 nt, Artificial Sequence
  Description of Artificial Sequence: Synthetic oligonucleotide
cacaguagacacauagua

SEQ ID NO: 35614 - RNA, 18 nt, Artificial Sequence
  Description of Artificial Sequence: Synthetic oligonucleotide
uggcacacaguagacaca

SEQ ID NO: 35615 - RNA, 18 nt, Artificial Sequence
  Description of Artificial Sequence: Synthetic oligonucleotide
guacuuggcacacaguag

SEQ ID NO: 35616 - RNA, 18 nt, Artificial Sequence
  Description of Artificial Sequence: Synthetic oligonucleotide
gaacaguacuuggcacac

SEQ ID NO: 35617 - RNA, 18 nt, Artificial Sequence
  Description of Artificial Sequence: Synthetic oligonucleotide
uucuagaacaguacuugg

SEQ ID NO: 35618 - RNA, 18 nt, Artificial Sequence
  Description of Artificial Sequence: Synthetic oligonucleotide
cugguuucuagaacagua

SEQ ID NO: 35619 - RNA, 18 nt, Artificial Sequence
  Description of Artificial Sequence: Synthetic oligonucleotide
uacuccugguuucuagaa

SEQ ID NO: 35620 - RNA, 18 nt, Artificial Sequence
  Description of Artificial Sequence: Synthetic oligonucleotide
ugcuauacuccugguuuc

SEQ ID NO: 35621 - RNA, 18 nt, Artificial Sequence
  Description of Artificial Sequence: Synthetic oligonucleotide
uucacugcuauacuccug

SEQ ID NO: 35622 - RNA, 18 nt, Artificial Sequence
  Description of Artificial Sequence: Synthetic oligonucleotide
ucuuguucacugcuauac

SEQ ID NO: 35623 - RNA, 18 nt, Artificial Sequence
  Description of Artificial Sequence: Synthetic oligonucleotide
gucugucuuguucacugc

SEQ ID NO: 35624 - RNA, 18 nt, Artificial Sequence
  Description of Artificial Sequence: Synthetic oligonucleotide
uuuuugucugucuuguuc

SEQ ID NO: 35625 - RNA, 18 nt, Artificial Sequence
  Description of Artificial Sequence: Synthetic oligonucleotide
auuuuuuuuugucugucu

SEQ ID NO: 35626 - RNA, 18 nt, Artificial Sequence
  Description of Artificial Sequence: Synthetic oligonucleotide
gggauuuuuuuuugucug

SEQ ID NO: 35627 - RNA, 18 nt, Artificial Sequence
  Description of Artificial Sequence: Synthetic oligonucleotide
guuagauaugagaguggg

SEQ ID NO: 35628 - RNA, 18 nt, Artificial Sequence
  Description of Artificial Sequence: Synthetic oligonucleotide
auuuuguuagauaugaga

SEQ ID NO: 35629 - RNA, 18 nt, Artificial Sequence
  Description of Artificial Sequence: Synthetic oligonucleotide
acaacauuuuguuagaua

SEQ ID NO: 35630 - RNA, 18 nt, Artificial Sequence
  Description of Artificial Sequence: Synthetic oligonucleotide
ugcauacaacauuuuguu

SEQ ID NO: 35631 - RNA, 18 nt, Artificial Sequence
  Description of Artificial Sequence: Synthetic oligonucleotide
auaaaugcauacaacauu

SEQ ID NO: 35632 - RNA, 18 nt, Artificial Sequence
  Description of Artificial Sequence: Synthetic oligonucleotide
agaggauaaaugcauaca

SEQ ID NO: 35633 - RNA, 18 nt, Artificial Sequence
  Description of Artificial Sequence: Synthetic oligonucleotide
gagucagaggauaaaugc

SEQ ID NO: 35634 - RNA, 18 nt, Artificial Sequence
  Description of Artificial Sequence: Synthetic oligonucleotide
uugcugagucagaggaua

SEQ ID NO: 35635 - RNA, 18 nt, Artificial Sequence
  Description of Artificial Sequence: Synthetic oligonucleotide
ugugauugcugagucaga

SEQ ID NO: 35636 - RNA, 18 nt, Artificial Sequence
  Description of Artificial Sequence: Synthetic oligonucleotide
agacgugugauugcugag

SEQ ID NO: 35637 - RNA, 18 nt, Artificial Sequence
  Description of Artificial Sequence: Synthetic oligonucleotide
cucuuagacgugugauug

SEQ ID NO: 35638 - RNA, 18 nt, Artificial Sequence
  Description of Artificial Sequence: Synthetic oligonucleotide
auaaacucuuagacgugu

SEQ ID NO: 35639 - RNA, 18 nt, Artificial Sequence
  Description of Artificial Sequence: Synthetic oligonucleotide
ucaggauaaacucuuaga

SEQ ID NO: 35640 - RNA, 18 nt, Artificial Sequence
  Description of Artificial Sequence: Synthetic oligonucleotide
caucuucaggauaaacuc

SEQ ID NO: 35641 - RNA, 18 nt, Artificial Sequence
  Description of Artificial Sequence: Synthetic oligonucleotide
agaugcaucuucaggaua

SEQ ID NO: 35642 - RNA, 18 nt, Artificial Sequence
  Description of Artificial Sequence: Synthetic oligonucleotide
gugggagaugcaucuuca

SEQ ID NO: 35643 - RNA, 18 nt, Artificial Sequence
  Description of Artificial Sequence: Synthetic oligonucleotide
gcacugugggagaugcau

SEQ ID NO: 35644 - RNA, 18 nt, Artificial Sequence
  Description of Artificial Sequence: Synthetic oligonucleotide
auuuugcacugugggaga

SEQ ID NO: 35645 - RNA, 18 nt, Artificial Sequence
  Description of Artificial Sequence: Synthetic oligonucleotide
uauucauuuugcacugug

SEQ ID NO: 35646 - RNA, 18 nt, Artificial Sequence
  Description of Artificial Sequence: Synthetic oligonucleotide
auacauauucauuuugca

SEQ ID NO: 35647 - RNA, 18 nt, Artificial Sequence
  Description of Artificial Sequence: Synthetic oligonucleotide
accuuauacauauucauu

SEQ ID NO: 35648 - RNA, 18 nt, Artificial Sequence
  Description of Artificial Sequence: Synthetic oligonucleotide
ggaucaccuuauacauau

SEQ ID NO: 35649 - RNA, 18 nt, Artificial Sequence
  Description of Artificial Sequence: Synthetic oligonucleotide
gcaauggaucaccuuaua

SEQ ID NO: 35650 - RNA, 18 nt, Artificial Sequence
  Description of Artificial Sequence: Synthetic oligonucleotide
caaaugcaauggaucacc

SEQ ID NO: 35651 - RNA, 18 nt, Artificial Sequence
  Description of Artificial Sequence: Synthetic oligonucleotide
aauuacaaaugcaaugga

SEQ ID NO: 35652 - RNA, 18 nt, Artificial Sequence
  Description of Artificial Sequence: Synthetic oligonucleotide
uuugcaauuacaaaugca

SEQ ID NO: 35653 - RNA, 18 nt, Artificial Sequence
  Description of Artificial Sequence: Synthetic oligonucleotide
agcauuuugcaauuacaa

SEQ ID NO: 35654 - RNA, 18 nt, Artificial Sequence
  Description of Artificial Sequence: Synthetic oligonucleotide
cuuccagcauuuugcaau

SEQ ID NO: 35655 - RNA, 18 nt, Artificial Sequence
  Description of Artificial Sequence: Synthetic oligonucleotide
gguaacuuccagcauuuu

SEQ ID NO: 35656 - RNA, 18 nt, Artificial Sequence
  Description of Artificial Sequence: Synthetic oligonucleotide
auuuagguaacuuccagc

SEQ ID NO: 35657 - RNA, 18 nt, Artificial Sequence
  Description of Artificial Sequence: Synthetic oligonucleotide
uaaacauuuagguaacuu

SEQ ID NO: 35658 - RNA, 18 nt, Artificial Sequence
  Description of Artificial Sequence: Synthetic oligonucleotide
augacuaaacauuuaggu

SEQ ID NO: 35659 - RNA, 18 nt, Artificial Sequence
  Description of Artificial Sequence: Synthetic oligonucleotide
cuacaaugacuaaacauu

SEQ ID NO: 35660 - RNA, 18 nt, Artificial Sequence
  Description of Artificial Sequence: Synthetic oligonucleotide
ccaaucuacaaugacuaa

SEQ ID NO: 35661 - RNA, 18 nt, Artificial Sequence
  Description of Artificial Sequence: Synthetic oligonucleotide
uucagccaaucuacaaug

SEQ ID NO: 35662 - RNA, 18 nt, Artificial Sequence
  Description of Artificial Sequence: Synthetic oligonucleotide
aauuauucagccaaucua

SEQ ID NO: 35663 - RNA, 18 nt, Artificial Sequence
  Description of Artificial Sequence: Synthetic oligonucleotide
ccauaaauuauucagcca

SEQ ID NO: 35664 - RNA, 18 nt, Artificial Sequence
  Description of Artificial Sequence: Synthetic oligonucleotide
cuguaccauaaauuauuc

SEQ ID NO: 35665 - RNA, 18 nt, Artificial Sequence
  Description of Artificial Sequence: Synthetic oligonucleotide
ugugucuguaccauaaau

SEQ ID NO: 35666 - RNA, 18 nt, Artificial Sequence
  Description of Artificial Sequence: Synthetic oligonucleotide
uauugugugucuguacca

SEQ ID NO: 35667 - RNA, 18 nt, Artificial Sequence
  Description of Artificial Sequence: Synthetic oligonucleotide
gacuuuauugugugucug

SEQ ID NO: 35668 - RNA, 18 nt, Artificial Sequence
  Description of Artificial Sequence: Synthetic oligonucleotide
cguaagacuuuauugugu

SEQ ID NO: 35669 - RNA, 18 nt, Artificial Sequence
  Description of Artificial Sequence: Synthetic oligonucleotide
aguugcguaagacuuuau

SEQ ID NO: 35670 - RNA, 18 nt, Artificial Sequence
  Description of Artificial Sequence: Synthetic oligonucleotide
uuuauaguugcguaagac

SEQ ID NO: 35671 - RNA, 18 nt, Artificial Sequence
  Description of Artificial Sequence: Synthetic oligonucleotide
ucuuuuuuauaguugcgu

SEQ ID NO: 35672 - RNA, 18 nt, Artificial Sequence
  Description of Artificial Sequence: Synthetic oligonucleotide
cuucuucuuuuuuauagu

SEQ ID NO: 35673 - RNA, 18 nt, Artificial Sequence
  Description of Artificial Sequence: Synthetic oligonucleotide
cuuuucuucuucuuuuuu

SEQ ID NO: 35674 - RNA, 18 nt, Artificial Sequence
  Description of Artificial Sequence: Synthetic oligonucleotide
ugagacuuuucuucuucu

SEQ ID NO: 35675 - RNA, 18 nt, Artificial Sequence
  Description of Artificial Sequence: Synthetic oligonucleotide
uuuacugagacuuuucuu

SEQ ID NO: 35676 - RNA, 18 nt, Artificial Sequence
  Description of Artificial Sequence: Synthetic oligonucleotide
aucaguuuacugagacuu

SEQ ID NO: 35677 - RNA, 18 nt, Artificial Sequence
  Description of Artificial Sequence: Synthetic oligonucleotide
uccauaucaguuuacuga

SEQ ID NO: 35678 - RNA, 18 nt, Artificial Sequence
  Description of Artificial Sequence: Synthetic oligonucleotide
auaucuccauaucaguuu

SEQ ID NO: 35679 - RNA, 18 nt, Artificial Sequence
  Description of Artificial Sequence: Synthetic oligonucleotide
uggaaauaucuccauauc

SEQ ID NO: 35680 - RNA, 18 nt, Artificial Sequence
  Description of Artificial Sequence: Synthetic oligonucleotide
uuuacuggaaauaucucc

SEQ ID NO: 35681 - RNA, 18 nt, Artificial Sequence
  Description of Artificial Sequence: Synthetic oligonucleotide
caguauuuacuggaaaua

SEQ ID NO: 35682 - RNA, 18 nt, Artificial Sequence
  Description of Artificial Sequence: Synthetic oligonucleotide
uuuaacaguauuuacugg

SEQ ID NO: 35683 - RNA, 18 nt, Artificial Sequence
  Description of Artificial Sequence: Synthetic oligonucleotide
uaucauuuaacaguauuu

SEQ ID NO: 35684 - RNA, 18 nt, Artificial Sequence
  Description of Artificial Sequence: Synthetic oligonucleotide
cuuuuuaucauuuaacag

SEQ ID NO: 35685 - RNA, 18 nt, Artificial Sequence
  Description of Artificial Sequence: Synthetic oligonucleotide
cuuugcuuuuuaucauuu

SEQ ID NO: 35686 - RNA, 18 nt, Artificial Sequence
  Description of Artificial Sequence: Synthetic oligonucleotide
uuccacuuugcuuuuuau

SEQ ID NO: 35687 - RNA, 18 nt, Artificial Sequence
  Description of Artificial Sequence: Synthetic oligonucleotide
cuauccucagacugcggg

SEQ ID NO: 35688 - RNA, 18 nt, Artificial Sequence
  Description of Artificial Sequence: Synthetic oligonucleotide
gcuauccucagacugcgg

SEQ ID NO: 35689 - RNA, 18 nt, Artificial Sequence
  Description of Artificial Sequence: Synthetic oligonucleotide
uugcugcuauccucagac

SEQ ID NO: 35690 - RNA, 18 nt, Artificial Sequence
  Description of Artificial Sequence: Synthetic oligonucleotide
agccauugcugcuauccu

SEQ ID NO: 35691 - RNA, 18 nt, Artificial Sequence
  Description of Artificial Sequence: Synthetic oligonucleotide
aacacagccauugcugcu

SEQ ID NO: 35692 - RNA, 18 nt, Artificial Sequence
  Description of Artificial Sequence: Synthetic oligonucleotide
augugaacacagccauug

SEQ ID NO: 35693 - RNA, 18 nt, Artificial Sequence
  Description of Artificial Sequence: Synthetic oligonucleotide
gaacaaugugaacacagc

SEQ ID NO: 35694 - RNA, 18 nt, Artificial Sequence
  Description of Artificial Sequence: Synthetic oligonucleotide
cuggagaacaaugugaac

SEQ ID NO: 35695 - RNA, 18 nt, Artificial Sequence
  Description of Artificial Sequence: Synthetic oligonucleotide
aggcacuggagaacaaug

SEQ ID NO: 35696 - RNA, 18 nt, Artificial Sequence
  Description of Artificial Sequence: Synthetic oligonucleotide
gaaccaggcacuggagaa

SEQ ID NO: 35697 - RNA, 18 nt, Artificial Sequence
  Description of Artificial Sequence: Synthetic oligonucleotide
gcacugaaccaggcacug

SEQ ID NO: 35698 - RNA, 18 nt, Artificial Sequence
  Description of Artificial Sequence: Synthetic oligonucleotide
gccaggcacugaaccagg

SEQ ID NO: 35699 - RNA, 18 nt, Artificial Sequence
  Description of Artificial Sequence: Synthetic oligonucleotide
cauacgccaggcacugaa

SEQ ID NO: 35700 - RNA, 18 nt, Artificial Sequence
  Description of Artificial Sequence: Synthetic oligonucleotide
cugaccauacgccaggca

SEQ ID NO: 35701 - RNA, 18 nt, Artificial Sequence
  Description of Artificial Sequence: Synthetic oligonucleotide
gagcacugaccauacgcc

SEQ ID NO: 35702 - RNA, 18 nt, Artificial Sequence
  Description of Artificial Sequence: Synthetic oligonucleotide
cuauggagcacugaccau

SEQ ID NO: 35703 - RNA, 18 nt, Artificial Sequence
  Description of Artificial Sequence: Synthetic oligonucleotide
cauaccuauggagcacug

SEQ ID NO: 35704 - RNA, 18 nt, Artificial Sequence
  Description of Artificial Sequence: Synthetic oligonucleotide
cgacacauaccuauggag

SEQ ID NO: 35705 - RNA, 18 nt, Artificial Sequence
  Description of Artificial Sequence: Synthetic oligonucleotide
gcauccgacacauaccua

SEQ ID NO: 35706 - RNA, 18 nt, Artificial Sequence
  Description of Artificial Sequence: Synthetic oligonucleotide
cuugugcauccgacacau

SEQ ID NO: 35707 - RNA, 18 nt, Artificial Sequence
  Description of Artificial Sequence: Synthetic oligonucleotide
aaagccuugugcauccga

SEQ ID NO: 35708 - RNA, 18 nt, Artificial Sequence
  Description of Artificial Sequence: Synthetic oligonucleotide
cacccaaagccuugugca

SEQ ID NO: 35709 - RNA, 18 nt, Artificial Sequence
  Description of Artificial Sequence: Synthetic oligonucleotide
gguuacacccaaagccuu

SEQ ID NO: 35710 - RNA, 18 nt, Artificial Sequence
  Description of Artificial Sequence: Synthetic oligonucleotide
aagaggguuacacccaaa

SEQ ID NO: 35711 - RNA, 18 nt, Artificial Sequence
  Description of Artificial Sequence: Synthetic oligonucleotide
ccgucaagaggguuacac

SEQ ID NO: 35712 - RNA, 18 nt, Artificial Sequence
  Description of Artificial Sequence: Synthetic oligonucleotide
cccacccgucaagagggu

SEQ ID NO: 35713 - RNA, 18 nt, Artificial Sequence
  Description of Artificial Sequence: Synthetic oligonucleotide
uugaucccacccgucaag

SEQ ID NO: 35714 - RNA, 18 nt, Artificial Sequence
  Description of Artificial Sequence: Synthetic oligonucleotide
accuguugaucccacccg

SEQ ID NO: 35715 - RNA, 18 nt, Artificial Sequence
  Description of Artificial Sequence: Synthetic oligonucleotide
cccagaccuguugauccc

SEQ ID NO: 35716 - RNA, 18 nt, Artificial Sequence
  Description of Artificial Sequence: Synthetic oligonucleotide
ugagucccagaccuguug

SEQ ID NO: 35717 - RNA, 18 nt, Artificial Sequence
  Description of Artificial Sequence: Synthetic oligonucleotide
gauggugagucccagacc

SEQ ID NO: 35718 - RNA, 18 nt, Artificial Sequence
  Description of Artificial Sequence: Synthetic oligonucleotide
gagaagauggugaguccc

SEQ ID NO: 35719 - RNA, 18 nt, Artificial Sequence
  Description of Artificial Sequence: Synthetic oligonucleotide
uguuugagaagaugguga

SEQ ID NO: 35720 - RNA, 18 nt, Artificial Sequence
  Description of Artificial Sequence: Synthetic oligonucleotide
ggcucuguuugagaagau

SEQ ID NO: 35721 - RNA, 18 nt, Artificial Sequence
  Description of Artificial Sequence: Synthetic oligonucleotide
aggaaggcucuguuugag

SEQ ID NO: 35722 - RNA, 18 nt, Artificial Sequence
  Description of Artificial Sequence: Synthetic oligonucleotide
ggaggaggaaggcucugu

SEQ ID NO: 35723 - RNA, 18 nt, Artificial Sequence
  Description of Artificial Sequence: Synthetic oligonucleotide
gcaguggaggaggaaggc

SEQ ID NO: 35724 - RNA, 18 nt, Artificial Sequence
  Description of Artificial Sequence: Synthetic oligonucleotide
ggcuagcaguggaggagg

SEQ ID NO: 35725 - RNA, 18 nt, Artificial Sequence
  Description of Artificial Sequence: Synthetic oligonucleotide
accauggcuagcagugga

SEQ ID NO: 35726 - RNA, 18 nt, Artificial Sequence
  Description of Artificial Sequence: Synthetic oligonucleotide
ccuggaccauggcuagca

SEQ ID NO: 35727 - RNA, 18 nt, Artificial Sequence
  Description of Artificial Sequence: Synthetic oligonucleotide
agcguccuggaccauggc

SEQ ID NO: 35728 - RNA, 18 nt, Artificial Sequence
  Description of Artificial Sequence: Synthetic oligonucleotide
cgcccagcguccuggacc

SEQ ID NO: 35729 - RNA, 18 nt, Artificial Sequence
  Description of Artificial Sequence: Synthetic oligonucleotide
ggucucgcccagcguccu

SEQ ID NO: 35730 - RNA, 18 nt, Artificial Sequence
  Description of Artificial Sequence: Synthetic oligonucleotide
cagugggucucgcccagc

SEQ ID NO: 35731 - RNA, 18 nt, Artificial Sequence
  Description of Artificial Sequence: Synthetic oligonucleotide
caagacagugggucucgc

SEQ ID NO: 35732 - RNA, 18 nt, Artificial Sequence
  Description of Artificial Sequence: Synthetic oligonucleotide
aagagcaagacagugggu

SEQ ID NO: 35733 - RNA, 18 nt, Artificial Sequence
  Description of Artificial Sequence: Synthetic oligonucleotide
uuacaaagagcaagacag

SEQ ID NO: 35734 - RNA, 18 nt, Artificial Sequence
  Description of Artificial Sequence: Synthetic oligonucleotide
cagccuuacaaagagcaa

SEQ ID NO: 35735 - RNA, 18 nt, Artificial Sequence
  Description of Artificial Sequence: Synthetic oligonucleotide
gacuucagccuuacaaag

SEQ ID NO: 35736 - RNA, 18 nt, Artificial Sequence
  Description of Artificial Sequence: Synthetic oligonucleotide
aaauggacuucagccuua

SEQ ID NO: 35737 - RNA, 18 nt, Artificial Sequence
  Description of Artificial Sequence: Synthetic oligonucleotide
cugggaaauggacuucag

SEQ ID NO: 35738 - RNA, 18 nt, Artificial Sequence
  Description of Artificial Sequence: Synthetic oligonucleotide
gccgccugggaaauggac

SEQ ID NO: 35739 - RNA, 18 nt, Artificial Sequence
  Description of Artificial Sequence: Synthetic oligonucleotide
guguagccgccugggaaa

SEQ ID NO: 35740 - RNA, 18 nt, Artificial Sequence
  Description of Artificial Sequence: Synthetic oligonucleotide
guuggguguagccgccug

SEQ ID NO: 35741 - RNA, 18 nt, Artificial Sequence
  Description of Artificial Sequence: Synthetic oligonucleotide
caucuguuggguguagcc

SEQ ID NO: 35742 - RNA, 18 nt, Artificial Sequence
  Description of Artificial Sequence: Synthetic oligonucleotide
cucagcaucuguugggug

SEQ ID NO: 35743 - RNA, 18 nt, Artificial Sequence
  Description of Artificial Sequence: Synthetic oligonucleotide
gccugcucagcaucuguu

SEQ ID NO: 35744 - RNA, 18 nt, Artificial Sequence
  Description of Artificial Sequence: Synthetic oligonucleotide
gcccagccugcucagcau

SEQ ID NO: 35745 - RNA, 18 nt, Artificial Sequence
  Description of Artificial Sequence: Synthetic oligonucleotide
ggguggcccagccugcuc

SEQ ID NO: 35746 - RNA, 18 nt, Artificial Sequence
  Description of Artificial Sequence: Synthetic oligonucleotide
ucccaggguggcccagcc

SEQ ID NO: 35747 - RNA, 18 nt, Artificial Sequence
  Description of Artificial Sequence: Synthetic oligonucleotide
uuggaucccaggguggcc

SEQ ID NO: 35748 - RNA, 18 nt, Artificial Sequence
  Description of Artificial Sequence: Synthetic oligonucleotide
gugucuuggaucccaggg

SEQ ID NO: 35749 - RNA, 18 nt, Artificial Sequence
  Description of Artificial Sequence: Synthetic oligonucleotide
ucucugugucuuggaucc

SEQ ID NO: 35750 - RNA, 18 nt, Artificial Sequence
  Description of Artificial Sequence: Synthetic oligonucleotide
cuuucucucugugucuug

SEQ ID NO: 35751 - RNA, 18 nt, Artificial Sequence
  Description of Artificial Sequence: Synthetic oligonucleotide
gggcucuuucucucugug

SEQ ID NO: 35752 - RNA, 18 nt, Artificial Sequence
  Description of Artificial Sequence: Synthetic oligonucleotide
uucaggcgccagacaggg

SEQ ID NO: 35753 - RNA, 18 nt, Artificial Sequence
  Description of Artificial Sequence: Synthetic oligonucleotide
gcuucaggcgccagacag

SEQ ID NO: 35754 - RNA, 18 nt, Artificial Sequence
  Description of Artificial Sequence: Synthetic oligonucleotide
caugugcuucaggcgcca

SEQ ID NO: 35755 - RNA, 18 nt, Artificial Sequence
  Description of Artificial Sequence: Synthetic oligonucleotide
ucuggcaugugcuucagg

SEQ ID NO: 35756 - RNA, 18 nt, Artificial Sequence
  Description of Artificial Sequence: Synthetic oligonucleotide
uguccucuggcaugugcu

SEQ ID NO: 35757 - RNA, 18 nt, Artificial Sequence
  Description of Artificial Sequence: Synthetic oligonucleotide
gcuccuguccucuggcau

SEQ ID NO: 35758 - RNA, 18 nt, Artificial Sequence
  Description of Artificial Sequence: Synthetic oligonucleotide
ugcuggcuccuguccucu

SEQ ID NO: 35759 - RNA, 18 nt, Artificial Sequence
  Description of Artificial Sequence: Synthetic oligonucleotide
gcuccugcuggcuccugu

SEQ ID NO: 35760 - RNA, 18 nt, Artificial Sequence
  Description of Artificial Sequence: Synthetic oligonucleotide
aacaggcuccugcuggcu

SEQ ID NO: 35761 - RNA, 18 nt, Artificial Sequence
  Description of Artificial Sequence: Synthetic oligonucleotide
gcugaaacaggcuccugc

SEQ ID NO: 35762 - RNA, 18 nt, Artificial Sequence
  Description of Artificial Sequence: Synthetic oligonucleotide
gcuaggcugaaacaggcu

SEQ ID NO: 35763 - RNA, 18 nt, Artificial Sequence
  Description of Artificial Sequence: Synthetic oligonucleotide
ccccagcuaggcugaaac

SEQ ID NO: 35764 - RNA, 18 nt, Artificial Sequence
  Description of Artificial Sequence: Synthetic oligonucleotide
gaaauccccagcuaggcu

SEQ ID NO: 35765 - RNA, 18 nt, Artificial Sequence
  Description of Artificial Sequence: Synthetic oligonucleotide
agaaugaaauccccagcu

SEQ ID NO: 35766 - RNA, 18 nt, Artificial Sequence
  Description of Artificial Sequence: Synthetic oligonucleotide
ccuccagaaugaaauccc

SEQ ID NO: 35767 - RNA, 18 nt, Artificial Sequence
  Description of Artificial Sequence: Synthetic oligonucleotide
ucacgccuccagaaugaa

SEQ ID NO: 35768 - RNA, 18 nt, Artificial Sequence
  Description of Artificial Sequence: Synthetic oligonucleotide
agaucucacgccuccaga

SEQ ID NO: 35769 - RNA, 18 nt, Artificial Sequence
  Description of Artificial Sequence: Synthetic oligonucleotide
cucccagaucucacgccu

SEQ ID NO: 35770 - RNA, 18 nt, Artificial Sequence
  Description of Artificial Sequence: Synthetic oligonucleotide
uugggcucccagaucuca

SEQ ID NO: 35771 - RNA, 18 nt, Artificial Sequence
  Description of Artificial Sequence: Synthetic oligonucleotide
aagccuugggcucccaga

SEQ ID NO: 35772 - RNA, 18 nt, Artificial Sequence
  Description of Artificial Sequence: Synthetic oligonucleotide
guucaaagccuugggcuc

SEQ ID NO: 35773 - RNA, 18 nt, Artificial Sequence
  Description of Artificial Sequence: Synthetic oligonucleotide
ccccaguucaaagccuug

SEQ ID NO: 35774 - RNA, 18 nt, Artificial Sequence
  Description of Artificial Sequence: Synthetic oligonucleotide
accucccccaguucaaag

SEQ ID NO: 35775 - RNA, 18 nt, Artificial Sequence
  Description of Artificial Sequence: Synthetic oligonucleotide
cccaaaccucccccaguu

SEQ ID NO: 35776 - RNA, 18 nt, Artificial Sequence
  Description of Artificial Sequence: Synthetic oligonucleotide
aacaccccaaaccucccc

SEQ ID NO: 35777 - RNA, 18 nt, Artificial Sequence
  Description of Artificial Sequence: Synthetic oligonucleotide
aagcaaacaccccaaacc

SEQ ID NO: 35778 - RNA, 18 nt, Artificial Sequence
  Description of Artificial Sequence: Synthetic oligonucleotide
aagacaagcaaacacccc

SEQ ID NO: 35779 - RNA, 18 nt, Artificial Sequence
  Description of Artificial Sequence: Synthetic oligonucleotide
uggagaagacaagcaaac

SEQ ID NO: 35780 - RNA, 18 nt, Artificial Sequence
  Description of Artificial Sequence: Synthetic oligonucleotide
ccauuuggagaagacaag

SEQ ID NO: 35781 - RNA, 18 nt, Artificial Sequence
  Description of Artificial Sequence: Synthetic oligonucleotide
aaaugccauuuggagaag

SEQ ID NO: 35782 - RNA, 18 nt, Artificial Sequence
  Description of Artificial Sequence: Synthetic oligonucleotide
uaauacuccaguuugcaa

SEQ ID NO: 35783 - RNA, 18 nt, Artificial Sequence
  Description of Artificial Sequence: Synthetic oligonucleotide
gcucuuaauacuccaguu

SEQ ID NO: 35784 - RNA, 18 nt, Artificial Sequence
  Description of Artificial Sequence: Synthetic oligonucleotide
cccaggcucuuaauacuc

SEQ ID NO: 35785 - RNA, 18 nt, Artificial Sequence
  Description of Artificial Sequence: Synthetic oligonucleotide
ucaggcccaggcucuuaa

SEQ ID NO: 35786 - RNA, 18 nt, Artificial Sequence
  Description of Artificial Sequence: Synthetic oligonucleotide
gacagucaggcccaggcu

SEQ ID NO: 35787 - RNA, 18 nt, Artificial Sequence
  Description of Artificial Sequence: Synthetic oligonucleotide
gcguagacagucaggccc

SEQ ID NO: 35788 - RNA, 18 nt, Artificial Sequence
  Description of Artificial Sequence: Synthetic oligonucleotide
agucggcguagacaguca

SEQ ID NO: 35789 - RNA, 18 nt, Artificial Sequence
  Description of Artificial Sequence: Synthetic oligonucleotide
caggcagucggcguagac

SEQ ID NO: 35790 - RNA, 18 nt, Artificial Sequence
  Description of Artificial Sequence: Synthetic oligonucleotide
ccagccaggcagucggcg

SEQ ID NO: 35791 - RNA, 18 nt, Artificial Sequence
  Description of Artificial Sequence: Synthetic oligonucleotide
acgugccagccaggcagu

SEQ ID NO: 35792 - RNA, 18 nt, Artificial Sequence
  Description of Artificial Sequence: Synthetic oligonucleotide
acuguacgugccagccag

SEQ ID NO: 35793 - RNA, 18 nt, Artificial Sequence
  Description of Artificial Sequence: Synthetic oligonucleotide
cccccacuguacgugcca

SEQ ID NO: 35794 - RNA, 18 nt, Artificial Sequence
  Description of Artificial Sequence: Synthetic oligonucleotide
uguugcccccacuguacg

SEQ ID NO: 35795 - RNA, 18 nt, Artificial Sequence
  Description of Artificial Sequence: Synthetic oligonucleotide
ccgcuuguugcccccacu

SEQ ID NO: 35796 - RNA, 18 nt, Artificial Sequence
  Description of Artificial Sequence: Synthetic oligonucleotide
aguuuccgcuuguugccc

SEQ ID NO: 35797 - RNA, 18 nt, Artificial Sequence
  Description of Artificial Sequence: Synthetic oligonucleotide
uggagaguuuccgcuugu

SEQ ID NO: 35798 - RNA, 18 nt, Artificial Sequence
  Description of Artificial Sequence: Synthetic oligonucleotide
ggcuguggagaguuuccg

SEQ ID NO: 35799 - RNA, 18 nt, Artificial Sequence
  Description of Artificial Sequence: Synthetic oligonucleotide
gcgauggcuguggagagu

SEQ ID NO: 35800 - RNA, 18 nt, Artificial Sequence
  Description of Artificial Sequence: Synthetic oligonucleotide
ugagugcgauggcugugg

SEQ ID NO: 35801 - RNA, 18 nt, Artificial Sequence
  Description of Artificial Sequence: Synthetic oligonucleotide
gccaaugagugcgauggc

SEQ ID NO: 35802 - RNA, 18 nt, Artificial Sequence
  Description of Artificial Sequence: Synthetic oligonucleotide
gggcagccaaugagugcg

SEQ ID NO: 35803 - RNA, 18 nt, Artificial Sequence
  Description of Artificial Sequence: Synthetic oligonucleotide
gcggugggcagccaauga

SEQ ID NO: 35804 - RNA, 18 nt, Artificial Sequence
  Description of Artificial Sequence: Synthetic oligonucleotide
caccagcggugggcagcc

SEQ ID NO: 35805 - RNA, 18 nt, Artificial Sequence
  Description of Artificial Sequence: Synthetic oligonucleotide
agcagcaccagcgguggg

SEQ ID NO: 35806 - RNA, 18 nt, Artificial Sequence
  Description of Artificial Sequence: Synthetic oligonucleotide
gcguugaaccugagcagc

SEQ ID NO: 35807 - RNA, 18 nt, Artificial Sequence
  Description of Artificial Sequence: Synthetic oligonucleotide
gcacggcguugaaccuga

SEQ ID NO: 35808 - RNA, 18 nt, Artificial Sequence
  Description of Artificial Sequence: Synthetic oligonucleotide
ccucagcacggcguugaa

SEQ ID NO: 35809 - RNA, 18 nt, Artificial Sequence
  Description of Artificial Sequence: Synthetic oligonucleotide
agcuuccucagcacggcg

SEQ ID NO: 35810 - RNA, 18 nt, Artificial Sequence
  Description of Artificial Sequence: Synthetic oligonucleotide
ugagcagcuuccucagca

SEQ ID NO: 35811 - RNA, 18 nt, Artificial Sequence
  Description of Artificial Sequence: Synthetic oligonucleotide
gacaaugagcagcuuccu

SEQ ID NO: 35812 - RNA, 18 nt, Artificial Sequence
  Description of Artificial Sequence: Synthetic oligonucleotide
gggaagacaaugagcagc

SEQ ID NO: 35813 - RNA, 18 nt, Artificial Sequence
  Description of Artificial Sequence: Synthetic oligonucleotide
ggcccaggcagaaguggg

SEQ ID NO: 35814 - RNA, 18 nt, Artificial Sequence
  Description of Artificial Sequence: Synthetic oligonucleotide
ccccggcccaggcagaag

SEQ ID NO: 35815 - RNA, 18 nt, Artificial Sequence
  Description of Artificial Sequence: Synthetic oligonucleotide
ugaggccccggcccaggc

SEQ ID NO: 35816 - RNA, 18 nt, Artificial Sequence
  Description of Artificial Sequence: Synthetic oligonucleotide
gucaaugaggccccggcc

SEQ ID NO: 35817 - RNA, 18 nt, Artificial Sequence
  Description of Artificial Sequence: Synthetic oligonucleotide
gcaaggucaaugaggccc

SEQ ID NO: 35818 - RNA, 18 nt, Artificial Sequence
  Description of Artificial Sequence: Synthetic oligonucleotide
ucagugcaaggucaauga

SEQ ID NO: 35819 - RNA, 18 nt, Artificial Sequence
  Description of Artificial Sequence: Synthetic oligonucleotide
cuggcucagugcaagguc

SEQ ID NO: 35820 - RNA, 18 nt, Artificial Sequence
  Description of Artificial Sequence: Synthetic oligonucleotide
acagccuggcucagugca

SEQ ID NO: 35821 - RNA, 18 nt, Artificial Sequence
  Description of Artificial Sequence: Synthetic oligonucleotide
cugucacagccuggcuca

SEQ ID NO: 35822 - RNA, 18 nt, Artificial Sequence
  Description of Artificial Sequence: Synthetic oligonucleotide
gacaucugucacagccug

SEQ ID NO: 35823 - RNA, 18 nt, Artificial Sequence
  Description of Artificial Sequence: Synthetic oligonucleotide
gcauagacaucugucaca

SEQ ID NO: 35824 - RNA, 18 nt, Artificial Sequence
  Description of Artificial Sequence: Synthetic oligonucleotide
accgggcauagacaucug

SEQ ID NO: 35825 - RNA, 18 nt, Artificial Sequence
  Description of Artificial Sequence: Synthetic oligonucleotide
caugggccucggcuacca

SEQ ID NO: 35826 - RNA, 18 nt, Artificial Sequence
  Description of Artificial Sequence: Synthetic oligonucleotide
ugcuccaugggccucggc

SEQ ID NO: 35827 - RNA, 18 nt, Artificial Sequence
  Description of Artificial Sequence: Synthetic oligonucleotide
gcccaugcuccaugggcc

SEQ ID NO: 35828 - RNA, 18 nt, Artificial Sequence
  Description of Artificial Sequence: Synthetic oligonucleotide
ccagggcccaugcuccau

SEQ ID NO: 35829 - RNA, 18 nt, Artificial Sequence
  Description of Artificial Sequence: Synthetic oligonucleotide
uggacccagggcccaugc

SEQ ID NO: 35830 - RNA, 18 nt, Artificial Sequence
  Description of Artificial Sequence: Synthetic oligonucleotide
agcuuuggacccagggcc

SEQ ID NO: 35831 - RNA, 18 nt, Artificial Sequence
  Description of Artificial Sequence: Synthetic oligonucleotide
cucccagcuuuggaccca

SEQ ID NO: 35832 - RNA, 18 nt, Artificial Sequence
  Description of Artificial Sequence: Synthetic oligonucleotide
uaacccucccagcuuugg

SEQ ID NO: 35833 - RNA, 18 nt, Artificial Sequence
  Description of Artificial Sequence: Synthetic oligonucleotide
cccgguaacccucccagc

SEQ ID NO: 35834 - RNA, 18 nt, Artificial Sequence
  Description of Artificial Sequence: Synthetic oligonucleotide
gcccccccgguaacccuc

SEQ ID NO: 35835 - RNA, 18 nt, Artificial Sequence
  Description of Artificial Sequence: Synthetic oligonucleotide
caggagcccccccgguaa

SEQ ID NO: 35836 - RNA, 18 nt, Artificial Sequence
  Description of Artificial Sequence: Synthetic oligonucleotide
ugaugcaggagccccccc

SEQ ID NO: 35837 - RNA, 18 nt, Artificial Sequence
  Description of Artificial Sequence: Synthetic oligonucleotide
cagucugaugcaggagcc

SEQ ID NO: 35838 - RNA, 18 nt, Artificial Sequence
  Description of Artificial Sequence: Synthetic oligonucleotide
ugccacagucugaugcag

SEQ ID NO: 35839 - RNA, 18 nt, Artificial Sequence
  Description of Artificial Sequence: Synthetic oligonucleotide
gccccugccacagucuga

SEQ ID NO: 35840 - RNA, 18 nt, Artificial Sequence
  Description of Artificial Sequence: Synthetic oligonucleotide
caccagccccugccacag

SEQ ID NO: 35841 - RNA, 18 nt, Artificial Sequence
  Description of Artificial Sequence: Synthetic oligonucleotide
ccuagcaccagccccugc

SEQ ID NO: 35842 - RNA, 18 nt, Artificial Sequence
  Description of Artificial Sequence: Synthetic oligonucleotide
ccccuccuagcaccagcc

SEQ ID NO: 35843 - RNA, 18 nt, Artificial Sequence
  Description of Artificial Sequence: Synthetic oligonucleotide
aagguccccuccuagcac

SEQ ID NO: 35844 - RNA, 18 nt, Artificial Sequence
  Description of Artificial Sequence: Synthetic oligonucleotide
ccaacaagguccccuccu

SEQ ID NO: 35845 - RNA, 18 nt, Artificial Sequence
  Description of Artificial Sequence: Synthetic oligonucleotide
ccagcccaacaagguccc

SEQ ID NO: 35846 - RNA, 18 nt, Artificial Sequence
  Description of Artificial Sequence: Synthetic oligonucleotide
caccuccagcccaacaag

SEQ ID NO: 35847 - RNA, 18 nt, Artificial Sequence
  Description of Artificial Sequence: Synthetic oligonucleotide
caggacaccuccagccca

SEQ ID NO: 35848 - RNA, 18 nt, Artificial Sequence
  Description of Artificial Sequence: Synthetic oligonucleotide
gcuggcaggacaccucca

SEQ ID NO: 35849 - RNA, 18 nt, Artificial Sequence
  Description of Artificial Sequence: Synthetic oligonucleotide
cuccagcuggcaggacac

SEQ ID NO: 35850 - RNA, 18 nt, Artificial Sequence
  Description of Artificial Sequence: Synthetic oligonucleotide
auccucuccagcuggcag

SEQ ID NO: 35851 - RNA, 18 nt, Artificial Sequence
  Description of Artificial Sequence: Synthetic oligonucleotide
cccuaauccucuccagcu

SEQ ID NO: 35852 - RNA, 18 nt, Artificial Sequence
  Description of Artificial Sequence: Synthetic oligonucleotide
aggcacccuaauccucuc

SEQ ID NO: 35853 - RNA, 18 nt, Artificial Sequence
  Description of Artificial Sequence: Synthetic oligonucleotide
aacagaggcacccuaauc

SEQ ID NO: 35854 - RNA, 18 nt, Artificial Sequence
  Description of Artificial Sequence: Synthetic oligonucleotide
auggaaacagaggcaccc

SEQ ID NO: 35855 - RNA, 18 nt, Artificial Sequence
  Description of Artificial Sequence: Synthetic oligonucleotide
cagccauggaaacagagg

SEQ ID NO: 35856 - RNA, 18 nt, Artificial Sequence
  Description of Artificial Sequence: Synthetic oligonucleotide
cuccccagccauggaaac

SEQ ID NO: 35857 - RNA, 18 nt, Artificial Sequence
  Description of Artificial Sequence: Synthetic oligonucleotide
uguggcuccccagccaug

SEQ ID NO: 35858 - RNA, 18 nt, Artificial Sequence
  Description of Artificial Sequence: Synthetic oligonucleotide
ccuccuguggcuccccag

SEQ ID NO: 35859 - RNA, 18 nt, Artificial Sequence
  Description of Artificial Sequence: Synthetic oligonucleotide
ccaucccuccuguggcuc

SEQ ID NO: 35860 - RNA, 18 nt, Artificial Sequence
  Description of Artificial Sequence: Synthetic oligonucleotide
ggcacccuaauccucucc

SEQ ID NO: 35861 - RNA, 18 nt, Artificial Sequence
  Description of Artificial Sequence: Synthetic oligonucleotide
acagaggcacccuaaucc

SEQ ID NO: 35862 - RNA, 18 nt, Artificial Sequence
  Description of Artificial Sequence: Synthetic oligonucleotide
uggaaacagaggcacccu

SEQ ID NO: 35863 - RNA, 18 nt, Artificial Sequence
  Description of Artificial Sequence: Synthetic oligonucleotide
agccauggaaacagaggc

SEQ ID NO: 35864 - RNA, 18 nt, Artificial Sequence
  Description of Artificial Sequence: Synthetic oligonucleotide
uccccagccauggaaaca

SEQ ID NO: 35865 - RNA, 18 nt, Artificial Sequence
  Description of Artificial Sequence: Synthetic oligonucleotide
guggcuccccagccaugg

SEQ ID NO: 35866 - RNA, 18 nt, Artificial Sequence
  Description of Artificial Sequence: Synthetic oligonucleotide
cuccuguggcuccccagc

SEQ ID NO: 35867 - RNA, 18 nt, Artificial Sequence
  Description of Artificial Sequence: Synthetic oligonucleotide
caucccuccuguggcucc

SEQ ID NO: 35868 - RNA, 18 nt, Artificial Sequence
  Description of Artificial Sequence: Synthetic oligonucleotide
cccuccaucccuccugug

SEQ ID NO: 35869 - RNA, 18 nt, Artificial Sequence
  Description of Artificial Sequence: Synthetic oligonucleotide
ggcugcccuccaucccuc

SEQ ID NO: 35870 - RNA, 18 nt, Artificial Sequence
  Description of Artificial Sequence: Synthetic oligonucleotide
auaagggcugcccuccau

SEQ ID NO: 35871 - RNA, 18 nt, Artificial Sequence
  Description of Artificial Sequence: Synthetic oligonucleotide
gccucauaagggcugccc

SEQ ID NO: 35872 - RNA, 18 nt, Artificial Sequence
  Description of Artificial Sequence: Synthetic oligonucleotide
cacccgccucauaagggc

SEQ ID NO: 35873 - RNA, 18 nt, Artificial Sequence
  Description of Artificial Sequence: Synthetic oligonucleotide
ccaaacacccgccucaua

SEQ ID NO: 35874 - RNA, 18 nt, Artificial Sequence
  Description of Artificial Sequence: Synthetic oligonucleotide
aagagccaaacacccgcc

SEQ ID NO: 35875 - RNA, 18 nt, Artificial Sequence
  Description of Artificial Sequence: Synthetic oligonucleotide
ugagcaagagccaaacac

SEQ ID NO: 35876 - RNA, 18 nt, Artificial Sequence
  Description of Artificial Sequence: Synthetic oligonucleotide
ggaacugagcaagagcca

SEQ ID NO: 35877 - RNA, 18 nt, Artificial Sequence
  Description of Artificial Sequence: Synthetic oligonucleotide
augugggaacugagcaag

SEQ ID NO: 35878 - RNA, 18 nt, Artificial Sequence
  Description of Artificial Sequence: Synthetic oligonucleotide
gccuuaugugggaacuga

SEQ ID NO: 35879 - RNA, 18 nt, Artificial Sequence
  Description of Artificial Sequence: Synthetic oligonucleotide
accaggccuuauguggga

SEQ ID NO: 35880 - RNA, 18 nt, Artificial Sequence
  Description of Artificial Sequence: Synthetic oligonucleotide
acuagaccaggccuuaug

SEQ ID NO: 35881 - RNA, 18 nt, Artificial Sequence
  Description of Artificial Sequence: Synthetic oligonucleotide
ggcccacuagaccaggcc

SEQ ID NO: 35882 - RNA, 18 nt, Artificial Sequence
  Description of Artificial Sequence: Synthetic oligonucleotide
cacagggcccacuagacc

SEQ ID NO: 35883 - RNA, 18 nt, Artificial Sequence
  Description of Artificial Sequence: Synthetic oligonucleotide
cacagcacagggcccacu

SEQ ID NO: 35884 - RNA, 18 nt, Artificial Sequence
  Description of Artificial Sequence: Synthetic oligonucleotide
cuggccacagcacagggc

SEQ ID NO: 35885 - RNA, 18 nt, Artificial Sequence
  Description of Artificial Sequence: Synthetic oligonucleotide
cagaccuggccacagcac

SEQ ID NO: 35886 - RNA, 18 nt, Artificial Sequence
  Description of Artificial Sequence: Synthetic oligonucleotide
ccccacagaccuggccac

SEQ ID NO: 35887 - RNA, 18 nt, Artificial Sequence
  Description of Artificial Sequence: Synthetic oligonucleotide
gcucaccccacagaccug

SEQ ID NO: 35888 - RNA, 18 nt, Artificial Sequence
  Description of Artificial Sequence: Synthetic oligonucleotide
ccccagcucaccccacag

SEQ ID NO: 35889 - RNA, 18 nt, Artificial Sequence
  Description of Artificial Sequence: Synthetic oligonucleotide
agccgccccagcucaccc

SEQ ID NO: 35890 - RNA, 18 nt, Artificial Sequence
  Description of Artificial Sequence: Synthetic oligonucleotide
acuucagccgccccagcu

SEQ ID NO: 35891 - RNA, 18 nt, Artificial Sequence
  Description of Artificial Sequence: Synthetic oligonucleotide
aguccacuucagccgccc

SEQ ID NO: 35892 - RNA, 18 nt, Artificial Sequence
  Description of Artificial Sequence: Synthetic oligonucleotide
aauugaguccacuucagc

SEQ ID NO: 35893 - RNA, 18 nt, Artificial Sequence
  Description of Artificial Sequence: Synthetic oligonucleotide
uuugcagagugcuccuca

SEQ ID NO: 35894 - RNA, 18 nt, Artificial Sequence
  Description of Artificial Sequence: Synthetic oligonucleotide
acggauuugcagagugcu

SEQ ID NO: 35895 - RNA, 18 nt, Artificial Sequence
  Description of Artificial Sequence: Synthetic oligonucleotide
guggaacggauuugcaga

SEQ ID NO: 35896 - RNA, 18 nt, Artificial Sequence
  Description of Artificial Sequence: Synthetic oligonucleotide
ucccaguggaacggauuu

SEQ ID NO: 35897 - RNA, 18 nt, Artificial Sequence
  Description of Artificial Sequence: Synthetic oligonucleotide
ucaggucccaguggaacg

SEQ ID NO: 35898 - RNA, 18 nt, Artificial Sequence
  Description of Artificial Sequence: Synthetic oligonucleotide
cccaaucaggucccagug

SEQ ID NO: 35899 - RNA, 18 nt, Artificial Sequence
  Description of Artificial Sequence: Synthetic oligonucleotide
uucuucccaaucaggucc

SEQ ID NO: 35900 - RNA, 18 nt, Artificial Sequence
  Description of Artificial Sequence: Synthetic oligonucleotide
acagguucuucccaauca

SEQ ID NO: 35901 - RNA, 18 nt, Artificial Sequence
  Description of Artificial Sequence: Synthetic oligonucleotide
ggcaaacagguucuuccc

SEQ ID NO: 35902 - RNA, 18 nt, Artificial Sequence
  Description of Artificial Sequence: Synthetic oligonucleotide
accauggcaaacagguuc

SEQ ID NO: 35903 - RNA, 18 nt, Artificial Sequence
  Description of Artificial Sequence: Synthetic oligonucleotide
ccaccaccauggcaaaca

SEQ ID NO: 35904 - RNA, 18 nt, Artificial Sequence
  Description of Artificial Sequence: Synthetic oligonucleotide
cccuuccaccaccauggc

SEQ ID NO: 35905 - RNA, 18 nt, Artificial Sequence
  Description of Artificial Sequence: Synthetic oligonucleotide
accaccccuuccaccacc

SEQ ID NO: 35906 - RNA, 18 nt, Artificial Sequence
  Description of Artificial Sequence: Synthetic oligonucleotide
aguacaccaccccuucca

SEQ ID NO: 35907 - RNA, 18 nt, Artificial Sequence
  Description of Artificial Sequence: Synthetic oligonucleotide
gaggaaguacaccacccc

SEQ ID NO: 35908 - RNA, 18 nt, Artificial Sequence
  Description of Artificial Sequence: Synthetic oligonucleotide
gucaggaggaaguacacc

SEQ ID NO: 35909 - RNA, 18 nt, Artificial Sequence
  Description of Artificial Sequence: Synthetic oligonucleotide
gcagggucaggaggaagu

SEQ ID NO: 35910 - RNA, 18 nt, Artificial Sequence
  Description of Artificial Sequence: Synthetic oligonucleotide
gaccagcagggucaggag

SEQ ID NO: 35911 - RNA, 18 nt, Artificial Sequence
  Description of Artificial Sequence: Synthetic oligonucleotide
cgcuggaccagcaggguc

SEQ ID NO: 35912 - RNA, 18 nt, Artificial Sequence
  Description of Artificial Sequence: Synthetic oligonucleotide
aguggcgcuggaccagca

SEQ ID NO: 35913 - RNA, 18 nt, Artificial Sequence
  Description of Artificial Sequence: Synthetic oligonucleotide
gaagaaguggcgcuggac

SEQ ID NO: 35914 - RNA, 18 nt, Artificial Sequence
  Description of Artificial Sequence: Synthetic oligonucleotide
gagaggaagaaguggcgc

SEQ ID NO: 35915 - RNA, 18 nt, Artificial Sequence
  Description of Artificial Sequence: Synthetic oligonucleotide
auugggagaggaagaagu

SEQ ID NO: 35916 - RNA, 18 nt, Artificial Sequence
  Description of Artificial Sequence: Synthetic oligonucleotide
ugucagcaauaugaagcc

SEQ ID NO: 35917 - RNA, 18 nt, Artificial Sequence
  Description of Artificial Sequence: Synthetic oligonucleotide
uuuuuugucagcaauaug

SEQ ID NO: 35918 - RNA, 18 nt, Artificial Sequence
  Description of Artificial Sequence: Synthetic oligonucleotide
uuccuuuuuuugucagca

SEQ ID NO: 35919 - RNA, 18 nt, Artificial Sequence
  Description of Artificial Sequence: Synthetic oligonucleotide
acuuuuuccuuuuuuugu

SEQ ID NO: 35920 - RNA, 18 nt, Artificial Sequence
  Description of Artificial Sequence: Synthetic oligonucleotide
gagguacuuuuuccuuuu

SEQ ID NO: 35921 - RNA, 18 nt, Artificial Sequence
  Description of Artificial Sequence: Synthetic oligonucleotide
uuauugagguacuuuuuc

SEQ ID NO: 35922 - RNA, 18 nt, Artificial Sequence
  Description of Artificial Sequence: Synthetic oligonucleotide
auuuauuauugagguacu

SEQ ID NO: 35923 - RNA, 18 nt, Artificial Sequence
  Description of Artificial Sequence: Synthetic oligonucleotide
ucuguauuuauuauugag

SEQ ID NO: 35924 - RNA, 18 nt, Artificial Sequence
  Description of Artificial Sequence: Synthetic oligonucleotide
gaaguucuguauuuauua

SEQ ID NO: 35925 - RNA, 18 nt, Artificial Sequence
  Description of Artificial Sequence: Synthetic oligonucleotide
aaggagaaguucuguauu

SEQ ID NO: 35926 - RNA, 18 nt, Artificial Sequence
  Description of Artificial Sequence: Synthetic oligonucleotide
guugaaaggagaaguucu

SEQ ID NO: 35927 - RNA, 18 nt, Artificial Sequence
  Description of Artificial Sequence: Synthetic oligonucleotide
aagagguugaaaggagaa

SEQ ID NO: 35928 - RNA, 18 nt, Artificial Sequence
  Description of Artificial Sequence: Synthetic oligonucleotide
gauggaagagguugaaag

SEQ ID NO: 35929 - RNA, 18 nt, Artificial Sequence
  Description of Artificial Sequence: Synthetic oligonucleotide
gaugugauggaagagguu

SEQ ID NO: 35930 - RNA, 18 nt, Artificial Sequence
  Description of Artificial Sequence: Synthetic oligonucleotide
guguugaugugauggaag

SEQ ID NO: 35931 - RNA, 18 nt, Artificial Sequence
  Description of Artificial Sequence: Synthetic oligonucleotide
cauagguguugaugugau

SEQ ID NO: 35932 - RNA, 18 nt, Artificial Sequence
  Description of Artificial Sequence: Synthetic oligonucleotide
gucuucauagguguugau

SEQ ID NO: 35933 - RNA, 18 nt, Artificial Sequence
  Description of Artificial Sequence: Synthetic oligonucleotide
ccauugucuucauaggug

SEQ ID NO: 35934 - RNA, 18 nt, Artificial Sequence
  Description of Artificial Sequence: Synthetic oligonucleotide
gaaacccauugucuucau

SEQ ID NO: 35935 - RNA, 18 nt, Artificial Sequence
  Description of Artificial Sequence: Synthetic oligonucleotide
aaucagaaacccauuguc

SEQ ID NO: 35936 - RNA, 18 nt, Artificial Sequence
  Description of Artificial Sequence: Synthetic oligonucleotide
uccacaaucagaaaccca

SEQ ID NO: 35937 - RNA, 18 nt, Artificial Sequence
  Description of Artificial Sequence: Synthetic oligonucleotide
agagauccacaaucagaa

SEQ ID NO: 35938 - RNA, 18 nt, Artificial Sequence
  Description of Artificial Sequence: Synthetic oligonucleotide
gcagcagagauccacaau

SEQ ID NO: 35939 - RNA, 18 nt, Artificial Sequence
  Description of Artificial Sequence: Synthetic oligonucleotide
uuccagcagcagagaucc

SEQ ID NO: 35940 - RNA, 18 nt, Artificial Sequence
  Description of Artificial Sequence: Synthetic oligonucleotide
auuuguccaguguccuuu

SEQ ID NO: 35941 - RNA, 18 nt, Artificial Sequence
  Description of Artificial Sequence: Synthetic oligonucleotide
gucccauuuguccagugu

SEQ ID NO: 35942 - RNA, 18 nt, Artificial Sequence
  Description of Artificial Sequence: Synthetic oligonucleotide
gaggugucccauuugucc

SEQ ID NO: 35943 - RNA, 18 nt, Artificial Sequence
  Description of Artificial Sequence: Synthetic oligonucleotide
aaugggaggugucccauu

SEQ ID NO: 35944 - RNA, 18 nt, Artificial Sequence
  Description of Artificial Sequence: Synthetic oligonucleotide
ggaacaaugggagguguc

SEQ ID NO: 35945 - RNA, 18 nt, Artificial Sequence
  Description of Artificial Sequence: Synthetic oligonucleotide
uuccaggaacaaugggag

SEQ ID NO: 35946 - RNA, 18 nt, Artificial Sequence
  Description of Artificial Sequence: Synthetic oligonucleotide
guaauuuccaggaacaau

SEQ ID NO: 35947 - RNA, 18 nt, Artificial Sequence
  Description of Artificial Sequence: Synthetic oligonucleotide
accccguaauuuccagga

SEQ ID NO: 35948 - RNA, 18 nt, Artificial Sequence
  Description of Artificial Sequence: Synthetic oligonucleotide
uaaaaaccccguaauuuc

SEQ ID NO: 35949 - RNA, 18 nt, Artificial Sequence
  Description of Artificial Sequence: Synthetic oligonucleotide
cucuguaaaaaccccgua

SEQ ID NO: 35950 - RNA, 18 nt, Artificial Sequence
  Description of Artificial Sequence: Synthetic oligonucleotide
agcagcucuguaaaaacc

SEQ ID NO: 35951 - RNA, 18 nt, Artificial Sequence
  Description of Artificial Sequence: Synthetic oligonucleotide
agugcagcagcucuguaa

SEQ ID NO: 35952 - RNA, 18 nt, Artificial Sequence
  Description of Artificial Sequence: Synthetic oligonucleotide
gauugagugcagcagcuc

SEQ ID NO: 35953 - RNA, 18 nt, Artificial Sequence
  Description of Artificial Sequence: Synthetic oligonucleotide
auucagauugagugcagc

SEQ ID NO: 35954 - RNA, 18 nt, Artificial Sequence
  Description of Artificial Sequence: Synthetic oligonucleotide
augugauucagauugagu

SEQ ID NO: 35955 - RNA, 18 nt, Artificial Sequence
  Description of Artificial Sequence: Synthetic oligonucleotide
uuuagaugugauucagau

SEQ ID NO: 35956 - RNA, 18 nt, Artificial Sequence
  Description of Artificial Sequence: Synthetic oligonucleotide
gcuguuuuagaugugauu

SEQ ID NO: 35957 - RNA, 18 nt, Artificial Sequence
  Description of Artificial Sequence: Synthetic oligonucleotide
cucuugcuguuuuagaug

SEQ ID NO: 35958 - RNA, 18 nt, Artificial Sequence
  Description of Artificial Sequence: Synthetic oligonucleotide
cauaacucuugcuguuuu

SEQ ID NO: 35959 - RNA, 18 nt, Artificial Sequence
  Description of Artificial Sequence: Synthetic oligonucleotide
ucucacauaacucuugcu

SEQ ID NO: 35960 - RNA, 18 nt, Artificial Sequence
  Description of Artificial Sequence: Synthetic oligonucleotide
uugacucucacauaacuc

SEQ ID NO: 35961 - RNA, 18 nt, Artificial Sequence
  Description of Artificial Sequence: Synthetic oligonucleotide
cauuuuugacucucacau

SEQ ID NO: 35962 - RNA, 18 nt, Artificial Sequence
  Description of Artificial Sequence: Synthetic oligonucleotide
aauuacauuuuugacucu

SEQ ID NO: 35963 - RNA, 18 nt, Artificial Sequence
  Description of Artificial Sequence: Synthetic oligonucleotide
uuuccaauuacauuuuug

SEQ ID NO: 35964 - RNA, 18 nt, Artificial Sequence
  Description of Artificial Sequence: Synthetic oligonucleotide
cugcuuuuccaauuacau

SEQ ID NO: 35965 - RNA, 18 nt, Artificial Sequence
  Description of Artificial Sequence: Synthetic oligonucleotide
uccuacugcuuuuccaau

SEQ ID NO: 35966 - RNA, 18 nt, Artificial Sequence
  Description of Artificial Sequence: Synthetic oligonucleotide
aaacuuccuacugcuuuu

SEQ ID NO: 35967 - RNA, 18 nt, Artificial Sequence
  Description of Artificial Sequence: Synthetic oligonucleotide
uaccuaaacuuccuacug

SEQ ID NO: 35968 - RNA, 18 nt, Artificial Sequence
  Description of Artificial Sequence: Synthetic oligonucleotide
cagauuaccuaaacuucc

SEQ ID NO: 35969 - RNA, 18 nt, Artificial Sequence
  Description of Artificial Sequence: Synthetic oligonucleotide
auguucagauuaccuaaa

SEQ ID NO: 35970 - RNA, 18 nt, Artificial Sequence
  Description of Artificial Sequence: Synthetic oligonucleotide
uuuugauguucagauuac

SEQ ID NO: 35971 - RNA, 18 nt, Artificial Sequence
  Description of Artificial Sequence: Synthetic oligonucleotide
cauaguuuugauguucag

SEQ ID NO: 35972 - RNA, 18 nt, Artificial Sequence
  Description of Artificial Sequence: Synthetic oligonucleotide
uuaaucauaguuuugaug

SEQ ID NO: 35973 - RNA, 18 nt, Artificial Sequence
  Description of Artificial Sequence: Synthetic oligonucleotide
aaucauuaaucauaguuu

SEQ ID NO: 35974 - RNA, 18 nt, Artificial Sequence
  Description of Artificial Sequence: Synthetic oligonucleotide
uuuucaaucauuaaucau

SEQ ID NO: 35975 - RNA, 18 nt, Artificial Sequence
  Description of Artificial Sequence: Synthetic oligonucleotide
auuaguuuucaaucauua

SEQ ID NO: 35976 - RNA, 18 nt, Artificial Sequence
  Description of Artificial Sequence: Synthetic oligonucleotide
acccgauuaguuuucaau

SEQ ID NO: 35977 - RNA, 18 nt, Artificial Sequence
  Description of Artificial Sequence: Synthetic oligonucleotide
cauggacccgauuaguuu

SEQ ID NO: 35978 - RNA, 18 nt, Artificial Sequence
  Description of Artificial Sequence: Synthetic oligonucleotide
ggguucauggacccgauu

SEQ ID NO: 35979 - RNA, 18 nt, Artificial Sequence
  Description of Artificial Sequence: Synthetic oligonucleotide
gaaucuuuuguuuucagg

SEQ ID NO: 35980 - RNA, 18 nt, Artificial Sequence
  Description of Artificial Sequence: Synthetic oligonucleotide
ucacagaaucuuuuguuu

SEQ ID NO: 35981 - RNA, 18 nt, Artificial Sequence
  Description of Artificial Sequence: Synthetic oligonucleotide
ucaggucacagaaucuuu

SEQ ID NO: 35982 - RNA, 18 nt, Artificial Sequence
  Description of Artificial Sequence: Synthetic oligonucleotide
accucucaggucacagaa

SEQ ID NO: 35983 - RNA, 18 nt, Artificial Sequence
  Description of Artificial Sequence: Synthetic oligonucleotide
aguucaccucucagguca

SEQ ID NO: 35984 - RNA, 18 nt, Artificial Sequence
  Description of Artificial Sequence: Synthetic oligonucleotide
cuuuaaguucaccucuca

SEQ ID NO: 35985 - RNA, 18 nt, Artificial Sequence
  Description of Artificial Sequence: Synthetic oligonucleotide
gucaacuuuaaguucacc

SEQ ID NO: 35986 - RNA, 18 nt, Artificial Sequence
  Description of Artificial Sequence: Synthetic oligonucleotide
auuuugucaacuuuaagu

SEQ ID NO: 35987 - RNA, 18 nt, Artificial Sequence
  Description of Artificial Sequence: Synthetic oligonucleotide
cagggauuuugucaacuu

SEQ ID NO: 35988 - RNA, 18 nt, Artificial Sequence
  Description of Artificial Sequence: Synthetic oligonucleotide
uuccccagggauuuuguc

SEQ ID NO: 35989 - RNA, 18 nt, Artificial Sequence
  Description of Artificial Sequence: Synthetic oligonucleotide
caaguuuccccagggauu

SEQ ID NO: 35990 - RNA, 18 nt, Artificial Sequence
  Description of Artificial Sequence: Synthetic oligonucleotide
gggcucaaguuuccccag

SEQ ID NO: 35991 - RNA, 18 nt, Artificial Sequence
  Description of Artificial Sequence: Synthetic oligonucleotide
cucccuucgcagagaaga

SEQ ID NO: 35992 - RNA, 18 nt, Artificial Sequence
  Description of Artificial Sequence: Synthetic oligonucleotide
uuuuucucccuucgcaga

SEQ ID NO: 35993 - RNA, 18 nt, Artificial Sequence
  Description of Artificial Sequence: Synthetic oligonucleotide
augucuuuuucucccuuc

SEQ ID NO: 35994 - RNA, 18 nt, Artificial Sequence
  Description of Artificial Sequence: Synthetic oligonucleotide
aacgcaugucuuuuucuc

SEQ ID NO: 35995 - RNA, 18 nt, Artificial Sequence
  Description of Artificial Sequence: Synthetic oligonucleotide
ugaaaaacgcaugucuuu

SEQ ID NO: 35996 - RNA, 18 nt, Artificial Sequence
  Description of Artificial Sequence: Synthetic oligonucleotide
uagucugaaaaacgcaug

SEQ ID NO: 35997 - RNA, 18 nt, Artificial Sequence
  Description of Artificial Sequence: Synthetic oligonucleotide
uuggcuagucugaaaaac

SEQ ID NO: 35998 - RNA, 18 nt, Artificial Sequence
  Description of Artificial Sequence: Synthetic oligonucleotide
gugauuuggcuagucuga

SEQ ID NO: 35999 - RNA, 18 nt, Artificial Sequence
  Description of Artificial Sequence: Synthetic oligonucleotide
cuucgcagagaagauggg

SEQ ID NO: 36000 - RNA, 18 nt, Artificial Sequence
  Description of Artificial Sequence: Synthetic oligonucleotide
ccuucgcagagaagaugg

SEQ ID NO: 36001 - RNA, 18 nt, Artificial Sequence
  Description of Artificial Sequence: Synthetic oligonucleotide
uucucccuucgcagagaa

SEQ ID NO: 36002 - RNA, 18 nt, Artificial Sequence
  Description of Artificial Sequence: Synthetic oligonucleotide
ucuuuuucucccuucgca

SEQ ID NO: 36003 - RNA, 18 nt, Artificial Sequence
  Description of Artificial Sequence: Synthetic oligonucleotide
gcaugucuuuuucucccu

SEQ ID NO: 36004 - RNA, 18 nt, Artificial Sequence
  Description of Artificial Sequence: Synthetic oligonucleotide
aaaacgcaugucuuuuuc

SEQ ID NO: 36005 - RNA, 18 nt, Artificial Sequence
  Description of Artificial Sequence: Synthetic oligonucleotide
ucugaaaaacgcaugucu

SEQ ID NO: 36006 - RNA, 18 nt, Artificial Sequence
  Description of Artificial Sequence: Synthetic oligonucleotide
gcuagucugaaaaacgca

SEQ ID NO: 36007 - RNA, 18 nt, Artificial Sequence
  Description of Artificial Sequence: Synthetic oligonucleotide
auuuggcuagucugaaaa

SEQ ID NO: 36008 - RNA, 18 nt, Artificial Sequence
  Description of Artificial Sequence: Synthetic oligonucleotide
uagugauuuggcuagucu

SEQ ID NO: 36009 - RNA, 18 nt, Artificial Sequence
  Description of Artificial Sequence: Synthetic oligonucleotide
cuucuuagugauuuggcu

SEQ ID NO: 36010 - RNA, 18 nt, Artificial Sequence
  Description of Artificial Sequence: Synthetic oligonucleotide
guugucuucuuagugauu

SEQ ID NO: 36011 - RNA, 18 nt, Artificial Sequence
  Description of Artificial Sequence: Synthetic oligonucleotide
gugcuguugucuucuuag

SEQ ID NO: 36012 - RNA, 18 nt, Artificial Sequence
  Description of Artificial Sequence: Synthetic oligonucleotide
cuuaggugcuguugucuu

SEQ ID NO: 36013 - RNA, 18 nt, Artificial Sequence
  Description of Artificial Sequence: Synthetic oligonucleotide
guguccuuaggugcuguu

SEQ ID NO: 36014 - RNA, 18 nt, Artificial Sequence
  Description of Artificial Sequence: Synthetic oligonucleotide
uguuuguguccuuaggug

SEQ ID NO: 36015 - RNA, 18 nt, Artificial Sequence
  Description of Artificial Sequence: Synthetic oligonucleotide
cauucuguuuguguccuu

SEQ ID NO: 36016 - RNA, 18 nt, Artificial Sequence
  Description of Artificial Sequence: Synthetic oligonucleotide
gucaccauucuguuugug

SEQ ID NO: 36017 - RNA, 18 nt, Artificial Sequence
  Description of Artificial Sequence: Synthetic oligonucleotide
uuccugucaccauucugu

SEQ ID NO: 36018 - RNA, 18 nt, Artificial Sequence
  Description of Artificial Sequence: Synthetic oligonucleotide
cugucuuccugucaccau

SEQ ID NO: 36019 - RNA, 18 nt, Artificial Sequence
  Description of Artificial Sequence: Synthetic oligonucleotide
cuguucugucuuccuguc

SEQ ID NO: 36020 - RNA, 18 nt, Artificial Sequence
  Description of Artificial Sequence: Synthetic oligonucleotide
acuuucuguucugucuuc

SEQ ID NO: 36021 - RNA, 18 nt, Artificial Sequence
  Description of Artificial Sequence: Synthetic oligonucleotide
gagauacuuucuguucug

SEQ ID NO: 36022 - RNA, 18 nt, Artificial Sequence
  Description of Artificial Sequence: Synthetic oligonucleotide
gccuugagauacuuucug

SEQ ID NO: 36023 - RNA, 18 nt, Artificial Sequence
  Description of Artificial Sequence: Synthetic oligonucleotide
cagcagccuugagauacu

SEQ ID NO: 36024 - RNA, 18 nt, Artificial Sequence
  Description of Artificial Sequence: Synthetic oligonucleotide
aguaacagcagccuugag

SEQ ID NO: 36025 - RNA, 18 nt, Artificial Sequence
  Description of Artificial Sequence: Synthetic oligonucleotide
guuuaaguaacagcagcc

SEQ ID NO: 36026 - RNA, 18 nt, Artificial Sequence
  Description of Artificial Sequence: Synthetic oligonucleotide
gauuuguuuaaguaacag

SEQ ID NO: 36027 - RNA, 18 nt, Artificial Sequence
  Description of Artificial Sequence: Synthetic oligonucleotide
uaauggauuuguuuaagu

SEQ ID NO: 36028 - RNA, 18 nt, Artificial Sequence
  Description of Artificial Sequence: Synthetic oligonucleotide
cugcuuaauggauuuguu

SEQ ID NO: 36029 - RNA, 18 nt, Artificial Sequence
  Description of Artificial Sequence: Synthetic oligonucleotide
gcaaccugcuuaauggau

SEQ ID NO: 36030 - RNA, 18 nt, Artificial Sequence
  Description of Artificial Sequence: Synthetic oligonucleotide
auaaagcaaccugcuuaa

SEQ ID NO: 36031 - RNA, 18 nt, Artificial Sequence
  Description of Artificial Sequence: Synthetic oligonucleotide
ugaaaauaaagcaaccug

SEQ ID NO: 36032 - RNA, 18 nt, Artificial Sequence
  Description of Artificial Sequence: Synthetic oligonucleotide
caggaugaaaauaaagca

SEQ ID NO: 36033 - RNA, 18 nt, Artificial Sequence
  Description of Artificial Sequence: Synthetic oligonucleotide
ccacacaggaugaaaaua

SEQ ID NO: 36034 - RNA, 18 nt, Artificial Sequence
  Description of Artificial Sequence: Synthetic oligonucleotide
cccgcccacacaggauga

SEQ ID NO: 36035 - RNA, 18 nt, Artificial Sequence
  Description of Artificial Sequence: Synthetic oligonucleotide
uuccucccgcccacacag

SEQ ID NO: 36036 - RNA, 18 nt, Artificial Sequence
  Description of Artificial Sequence: Synthetic oligonucleotide
gccauuuccucccgccca

SEQ ID NO: 36037 - RNA, 18 nt, Artificial Sequence
  Description of Artificial Sequence: Synthetic oligonucleotide
ucagagccauuuccuccc

SEQ ID NO: 36038 - RNA, 18 nt, Artificial Sequence
  Description of Artificial Sequence: Synthetic oligonucleotide
guguaucagagccauuuc

SEQ ID NO: 36039 - RNA, 18 nt, Artificial Sequence
  Description of Artificial Sequence: Synthetic oligonucleotide
gccagguguaucagagcc

SEQ ID NO: 36040 - RNA, 18 nt, Artificial Sequence
  Description of Artificial Sequence: Synthetic oligonucleotide
auugagccagguguauca

SEQ ID NO: 36041 - RNA, 18 nt, Artificial Sequence
  Description of Artificial Sequence: Synthetic oligonucleotide
cugcuauugagccaggug

SEQ ID NO: 36042 - RNA, 18 nt, Artificial Sequence
  Description of Artificial Sequence: Synthetic oligonucleotide
agaaacugcuauugagcc

SEQ ID NO: 36043 - RNA, 18 nt, Artificial Sequence
  Description of Artificial Sequence: Synthetic oligonucleotide
aacccagaaacugcuauu

SEQ ID NO: 36044 - RNA, 18 nt, Artificial Sequence
  Description of Artificial Sequence: Synthetic oligonucleotide
uccacaacccagaaacug

SEQ ID NO: 36045 - RNA, 18 nt, Artificial Sequence
  Description of Artificial Sequence: Synthetic oligonucleotide
uuuauuccacaacccaga

SEQ ID NO: 36046 - RNA, 18 nt, Artificial Sequence
  Description of Artificial Sequence: Synthetic oligonucleotide
uguucuuuauuccacaac

SEQ ID NO: 36047 - RNA, 18 nt, Artificial Sequence
  Description of Artificial Sequence: Synthetic oligonucleotide
cugccuguucuuuauucc

SEQ ID NO: 36048 - RNA, 18 nt, Artificial Sequence
  Description of Artificial Sequence: Synthetic oligonucleotide
agugccugccuguucuuu

SEQ ID NO: 36049 - RNA, 18 nt, Artificial Sequence
  Description of Artificial Sequence: Synthetic oligonucleotide
gcacaagugccugccugu

SEQ ID NO: 36050 - RNA, 18 nt, Artificial Sequence
  Description of Artificial Sequence: Synthetic oligonucleotide
uuuaagcacaagugccug

SEQ ID NO: 36051 - RNA, 18 nt, Artificial Sequence
  Description of Artificial Sequence: Synthetic oligonucleotide
gccuuuuuaagcacaagu

SEQ ID NO: 36052 - RNA, 18 nt, Artificial Sequence
  Description of Artificial Sequence: Synthetic oligonucleotide
uucuugccuuuuuaagca

SEQ ID NO: 36053 - RNA, 18 nt, Artificial Sequence
  Description of Artificial Sequence: Synthetic oligonucleotide
gaugauucuugccuuuuu

SEQ ID NO: 36054 - RNA, 18 nt, Artificial Sequence
  Description of Artificial Sequence: Synthetic oligonucleotide
agagagaugauucuugcc

SEQ ID NO: 36055 - RNA, 18 nt, Artificial Sequence
  Description of Artificial Sequence: Synthetic oligonucleotide
auuuuagagagaugauuc

SEQ ID NO: 36056 - RNA, 18 nt, Artificial Sequence
  Description of Artificial Sequence: Synthetic oligonucleotide
aaauaauuuuagagagau

SEQ ID NO: 36057 - RNA, 18 nt, Artificial Sequence
  Description of Artificial Sequence: Synthetic oligonucleotide
augacaaauaauuuuaga

SEQ ID NO: 36058 - RNA, 18 nt, Artificial Sequence
  Description of Artificial Sequence: Synthetic oligonucleotide
aggcaaugacaaauaauu

SEQ ID NO: 36059 - RNA, 18 nt, Artificial Sequence
  Description of Artificial Sequence: Synthetic oligonucleotide
agcacaggcaaugacaaa

SEQ ID NO: 36060 - RNA, 18 nt, Artificial Sequence
  Description of Artificial Sequence: Synthetic oligonucleotide
acaugagcacaggcaaug

SEQ ID NO: 36061 - RNA, 18 nt, Artificial Sequence
  Description of Artificial Sequence: Synthetic oligonucleotide
gucaaacaugagcacagg

SEQ ID NO: 36062 - RNA, 18 nt, Artificial Sequence
  Description of Artificial Sequence: Synthetic oligonucleotide
auuauaaacaaacucaaa

SEQ ID NO: 36063 - RNA, 18 nt, Artificial Sequence
  Description of Artificial Sequence: Synthetic oligonucleotide
aaguaauuauaaacaaac

SEQ ID NO: 36064 - RNA, 18 nt, Artificial Sequence
  Description of Artificial Sequence: Synthetic oligonucleotide
aauauaaguaauuauaaa

SEQ ID NO: 36065 - RNA, 18 nt, Artificial Sequence
  Description of Artificial Sequence: Synthetic oligonucleotide
ggcuaaauauaaguaauu

SEQ ID NO: 36066 - RNA, 18 nt, Artificial Sequence
  Description of Artificial Sequence: Synthetic oligonucleotide
aaauuggcuaaauauaag

SEQ ID NO: 36067 - RNA, 18 nt, Artificial Sequence
  Description of Artificial Sequence: Synthetic oligonucleotide
cacguaaauuggcuaaau

SEQ ID NO: 36068 - RNA, 18 nt, Artificial Sequence
  Description of Artificial Sequence: Synthetic oligonucleotide
guucucacguaaauuggc

SEQ ID NO: 36069 - RNA, 18 nt, Artificial Sequence
  Description of Artificial Sequence: Synthetic oligonucleotide
ucccaguucucacguaaa

SEQ ID NO: 36070 - RNA, 18 nt, Artificial Sequence
  Description of Artificial Sequence: Synthetic oligonucleotide
ccucuucccaguucucac

SEQ ID NO: 36071 - RNA, 18 nt, Artificial Sequence
  Description of Artificial Sequence: Synthetic oligonucleotide
uuucaccucuucccaguu

SEQ ID NO: 36072 - RNA, 18 nt, Artificial Sequence
  Description of Artificial Sequence: Synthetic oligonucleotide
uuuuuuuucaccucuucc

SEQ ID NO: 36073 - RNA, 18 nt, Artificial Sequence
  Description of Artificial Sequence: Synthetic oligonucleotide
uggcauuuuuuuucaccu

SEQ ID NO: 36074 - RNA, 18 nt, Artificial Sequence
  Description of Artificial Sequence: Synthetic oligonucleotide
cuuucuggcauuuuuuuu

SEQ ID NO: 36075 - RNA, 18 nt, Artificial Sequence
  Description of Artificial Sequence: Synthetic oligonucleotide
ggagccuuucuggcauuu

SEQ ID NO: 36076 - RNA, 18 nt, Artificial Sequence
  Description of Artificial Sequence: Synthetic oligonucleotide
gggagccuuucuggcauu

SEQ ID NO: 36077 - RNA, 18 nt, Artificial Sequence
  Description of Artificial Sequence: Synthetic oligonucleotide
uccuaacuucagguuggg

SEQ ID NO: 36078 - RNA, 18 nt, Artificial Sequence
  Description of Artificial Sequence: Synthetic oligonucleotide
auaucuccuaacuucagg

SEQ ID NO: 36079 - RNA, 18 nt, Artificial Sequence
  Description of Artificial Sequence: Synthetic oligonucleotide
aguacauaucuccuaacu

SEQ ID NO: 36080 - RNA, 18 nt, Artificial Sequence
  Description of Artificial Sequence: Synthetic oligonucleotide
aaggaaguacauaucucc

SEQ ID NO: 36081 - RNA, 18 nt, Artificial Sequence
  Description of Artificial Sequence: Synthetic oligonucleotide
auucaaaggaaguacaua

SEQ ID NO: 36082 - RNA, 18 nt, Artificial Sequence
  Description of Artificial Sequence: Synthetic oligonucleotide
ucaauauucaaaggaagu

SEQ ID NO: 36083 - RNA, 18 nt, Artificial Sequence
  Description of Artificial Sequence: Synthetic oligonucleotide
aauuauaaacaaacucaa

SEQ ID NO: 36084 - RNA, 18 nt, Artificial Sequence
  Description of Artificial Sequence: Synthetic oligonucleotide
uaaguaauuauaaacaaa

SEQ ID NO: 36085 - RNA, 18 nt, Artificial Sequence
  Description of Artificial Sequence: Synthetic oligonucleotide
aaauauaaguaauuauaa

SEQ ID NO: 36086 - RNA, 18 nt, Artificial Sequence
  Description of Artificial Sequence: Synthetic oligonucleotide
uggcuaaauauaaguaau

SEQ ID NO: 36087 - RNA, 18 nt, Artificial Sequence
  Description of Artificial Sequence: Synthetic oligonucleotide
uaaauuggcuaaauauaa

SEQ ID NO: 36088 - RNA, 18 nt, Artificial Sequence
  Description of Artificial Sequence: Synthetic oligonucleotide
ucacguaaauuggcuaaa

SEQ ID NO: 36089 - RNA, 18 nt, Artificial Sequence
  Description of Artificial Sequence: Synthetic oligonucleotide
aguucucacguaaauugg

SEQ ID NO: 36090 - RNA, 18 nt, Artificial Sequence
  Description of Artificial Sequence: Synthetic oligonucleotide
uucccaguucucacguaa

SEQ ID NO: 36091 - RNA, 18 nt, Artificial Sequence
  Description of Artificial Sequence: Synthetic oligonucleotide
accucuucccaguucuca

SEQ ID NO: 36092 - RNA, 18 nt, Artificial Sequence
  Description of Artificial Sequence: Synthetic oligonucleotide
uuuucaccucuucccagu

SEQ ID NO: 36093 - RNA, 18 nt, Artificial Sequence
  Description of Artificial Sequence: Synthetic oligonucleotide
auuuuuuuucaccucuuc

SEQ ID NO: 36094 - RNA, 18 nt, Artificial Sequence
  Description of Artificial Sequence: Synthetic oligonucleotide
cuggcauuuuuuuucacc

SEQ ID NO: 36095 - RNA, 18 nt, Artificial Sequence
  Description of Artificial Sequence: Synthetic oligonucleotide
ccuuucuggcauuuuuuu

SEQ ID NO: 36096 - RNA, 18 nt, Artificial Sequence
  Description of Artificial Sequence: Synthetic oligonucleotide
gggagccuuucuggcauu

SEQ ID NO: 36097 - RNA, 18 nt, Artificial Sequence
  Description of Artificial Sequence: Synthetic oligonucleotide
uccuaacuucagguuggg

SEQ ID NO: 36098 - RNA, 18 nt, Artificial Sequence
  Description of Artificial Sequence: Synthetic oligonucleotide
cuccuaacuucagguugg

SEQ ID NO: 36099 - RNA, 18 nt, Artificial Sequence
  Description of Artificial Sequence: Synthetic oligonucleotide
cauaucuccuaacuucag

SEQ ID NO: 36100 - RNA, 18 nt, Artificial Sequence
  Description of Artificial Sequence: Synthetic oligonucleotide
aaguacauaucuccuaac

SEQ ID NO: 36101 - RNA, 18 nt, Artificial Sequence
  Description of Artificial Sequence: Synthetic oligonucleotide
aaaggaaguacauaucuc

SEQ ID NO: 36102 - RNA, 18 nt, Artificial Sequence
  Description of Artificial Sequence: Synthetic oligonucleotide
uauucaaaggaaguacau

SEQ ID NO: 36103 - RNA, 18 nt, Artificial Sequence
  Description of Artificial Sequence: Synthetic oligonucleotide
gucaauauucaaaggaag

SEQ ID NO: 36104 - RNA, 18 nt, Artificial Sequence
  Description of Artificial Sequence: Synthetic oligonucleotide
aaaucuacagagaagcag

SEQ ID NO: 36105 - RNA, 18 nt, Artificial Sequence
  Description of Artificial Sequence: Synthetic oligonucleotide
aucugaaaucuacagaga

SEQ ID NO: 36106 - RNA, 18 nt, Artificial Sequence
  Description of Artificial Sequence: Synthetic oligonucleotide
guuaaaucugaaaucuac

SEQ ID NO: 36107 - RNA, 18 nt, Artificial Sequence
  Description of Artificial Sequence: Synthetic oligonucleotide
uucugguuaaaucugaaa

SEQ ID NO: 36108 - RNA, 18 nt, Artificial Sequence
  Description of Artificial Sequence: Synthetic oligonucleotide
aaacauucugguuaaauc

SEQ ID NO: 36109 - RNA, 18 nt, Artificial Sequence
  Description of Artificial Sequence: Synthetic oligonucleotide
agaugaaacauucugguu

SEQ ID NO: 36110 - RNA, 18 nt, Artificial Sequence
  Description of Artificial Sequence: Synthetic oligonucleotide
gagagagaugaaacauuc

SEQ ID NO: 36111 - RNA, 18 nt, Artificial Sequence
  Description of Artificial Sequence: Synthetic oligonucleotide
uuccugagagagaugaaa

SEQ ID NO: 36112 - RNA, 18 nt, Artificial Sequence
  Description of Artificial Sequence: Synthetic oligonucleotide
gacaauuccugagagaga

SEQ ID NO: 36113 - RNA, 18 nt, Artificial Sequence
  Description of Artificial Sequence: Synthetic oligonucleotide
aggaggacaauuccugag

SEQ ID NO: 36114 - RNA, 18 nt, Artificial Sequence
  Description of Artificial Sequence: Synthetic oligonucleotide
gaggcaggaggacaauuc

SEQ ID NO: 36115 - RNA, 18 nt, Artificial Sequence
  Description of Artificial Sequence: Synthetic oligonucleotide
aacaugaggcaggaggac

SEQ ID NO: 36116 - RNA, 18 nt, Artificial Sequence
  Description of Artificial Sequence: Synthetic oligonucleotide
guauaaacaugaggcagg

SEQ ID NO: 36117 - RNA, 18 nt, Artificial Sequence
  Description of Artificial Sequence: Synthetic oligonucleotide
uuuauguauaaacaugag

SEQ ID NO: 36118 - RNA, 18 nt, Artificial Sequence
  Description of Artificial Sequence: Synthetic oligonucleotide
aagacuuuauguauaaac

SEQ ID NO: 36119 - RNA, 18 nt, Artificial Sequence
  Description of Artificial Sequence: Synthetic oligonucleotide
auuucaagacuuuaugua

SEQ ID NO: 36120 - RNA, 18 nt, Artificial Sequence
  Description of Artificial Sequence: Synthetic oligonucleotide
cucaaauuucaagacuuu

SEQ ID NO: 36121 - RNA, 18 nt, Artificial Sequence
  Description of Artificial Sequence: Synthetic oligonucleotide
uagcucucaaauuucaag

SEQ ID NO: 36122 - RNA, 18 nt, Artificial Sequence
  Description of Artificial Sequence: Synthetic oligonucleotide
ccuucuagcucucaaauu

SEQ ID NO: 36123 - RNA, 18 nt, Artificial Sequence
  Description of Artificial Sequence: Synthetic oligonucleotide
aagcuccuucuagcucuc

SEQ ID NO: 36124 - RNA, 18 nt, Artificial Sequence
  Description of Artificial Sequence: Synthetic oligonucleotide
uuuuaaagcuccuucuag

SEQ ID NO: 36125 - RNA, 18 nt, Artificial Sequence
  Description of Artificial Sequence: Synthetic oligonucleotide
ccuauuuuuaaagcuccu

SEQ ID NO: 36126 - RNA, 18 nt, Artificial Sequence
  Description of Artificial Sequence: Synthetic oligonucleotide
auuagccuauuuuuaaag

SEQ ID NO: 36127 - RNA, 18 nt, Artificial Sequence
  Description of Artificial Sequence: Synthetic oligonucleotide
guuuaauuagccuauuuu

SEQ ID NO: 36128 - RNA, 18 nt, Artificial Sequence
  Description of Artificial Sequence: Synthetic oligonucleotide
aggaaguuuaauuagccu

SEQ ID NO: 36129 - RNA, 18 nt, Artificial Sequence
  Description of Artificial Sequence: Synthetic oligonucleotide
aaugaaggaaguuuaauu

SEQ ID NO: 36130 - RNA, 18 nt, Artificial Sequence
  Description of Artificial Sequence: Synthetic oligonucleotide
uguaaaaugaaggaaguu

SEQ ID NO: 36131 - RNA, 18 nt, Artificial Sequence
  Description of Artificial Sequence: Synthetic oligonucleotide
ucauuuguaaaaugaagg

SEQ ID NO: 36132 - RNA, 18 nt, Artificial Sequence
  Description of Artificial Sequence: Synthetic oligonucleotide
uaguuucauuuguaaaau

SEQ ID NO: 36133 - RNA, 18 nt, Artificial Sequence
  Description of Artificial Sequence: Synthetic oligonucleotide
agcuuuaguuucauuugu

SEQ ID NO: 36134 - RNA, 18 nt, Artificial Sequence
  Description of Artificial Sequence: Synthetic oligonucleotide
uucugagcuuuaguuuca

SEQ ID NO: 36135 - RNA, 18 nt, Artificial Sequence
  Description of Artificial Sequence: Synthetic oligonucleotide
uacucuucugagcuuuag

SEQ ID NO: 36136 - RNA, 18 nt, Artificial Sequence
  Description of Artificial Sequence: Synthetic oligonucleotide
cacaguacucuucugagc

SEQ ID NO: 36137 - RNA, 18 nt, Artificial Sequence
  Description of Artificial Sequence: Synthetic oligonucleotide
uaagucacaguacucuuc

SEQ ID NO: 36138 - RNA, 18 nt, Artificial Sequence
  Description of Artificial Sequence: Synthetic oligonucleotide
uuugcuaagucacaguac

SEQ ID NO: 36139 - RNA, 18 nt, Artificial Sequence
  Description of Artificial Sequence: Synthetic oligonucleotide
uugcuuuugcuaagucac

SEQ ID NO: 36140 - RNA, 18 nt, Artificial Sequence
  Description of Artificial Sequence: Synthetic oligonucleotide
ugcaguugcuuuugcuaa

SEQ ID NO: 36141 - RNA, 18 nt, Artificial Sequence
  Description of Artificial Sequence: Synthetic oligonucleotide
ucugcugcaguugcuuuu

SEQ ID NO: 36142 - RNA, 18 nt, Artificial Sequence
  Description of Artificial Sequence: Synthetic oligonucleotide
cuggcucugcugcaguug

SEQ ID NO: 36143 - RNA, 18 nt, Artificial Sequence
  Description of Artificial Sequence: Synthetic oligonucleotide
uuauccuggcucugcugc

SEQ ID NO: 36144 - RNA, 18 nt, Artificial Sequence
  Description of Artificial Sequence: Synthetic oligonucleotide
gguucuuauccuggcucu

SEQ ID NO: 36145 - RNA, 18 nt, Artificial Sequence
  Description of Artificial Sequence: Synthetic oligonucleotide
aaccugguucuuauccug

SEQ ID NO: 36146 - RNA, 18 nt, Artificial Sequence
  Description of Artificial Sequence: Synthetic oligonucleotide
uuaaaaaccugguucuua

SEQ ID NO: 36147 - RNA, 18 nt, Artificial Sequence
  Description of Artificial Sequence: Synthetic oligonucleotide
agaauuuaaaaaccuggu

SEQ ID NO: 36148 - RNA, 18 nt, Artificial Sequence
  Description of Artificial Sequence: Synthetic oligonucleotide
gauuuagaauuuaaaaac

SEQ ID NO: 36149 - RNA, 18 nt, Artificial Sequence
  Description of Artificial Sequence: Synthetic oligonucleotide
cggcagauuuagaauuua

SEQ ID NO: 36150 - RNA, 18 nt, Artificial Sequence
  Description of Artificial Sequence: Synthetic oligonucleotide
aagaacggcagauuuaga

SEQ ID NO: 36151 - RNA, 18 nt, Artificial Sequence
  Description of Artificial Sequence: Synthetic oligonucleotide
aauacaagaacggcagau

SEQ ID NO: 36152 - RNA, 18 nt, Artificial Sequence
  Description of Artificial Sequence: Synthetic oligonucleotide
uuguaaauacaagaacgg

SEQ ID NO: 36153 - RNA, 18 nt, Artificial Sequence
  Description of Artificial Sequence: Synthetic oligonucleotide
caauuuuguaaauacaag

SEQ ID NO: 36154 - RNA, 18 nt, Artificial Sequence
  Description of Artificial Sequence: Synthetic oligonucleotide
aaagacaauuuuguaaau

SEQ ID NO: 36155 - RNA, 18 nt, Artificial Sequence
  Description of Artificial Sequence: Synthetic oligonucleotide
auuuuaaagacaauuuug

SEQ ID NO: 36156 - RNA, 18 nt, Artificial Sequence
  Description of Artificial Sequence: Synthetic oligonucleotide
aguauauuuuaaagacaa

SEQ ID NO: 36157 - RNA, 18 nt, Artificial Sequence
  Description of Artificial Sequence: Synthetic oligonucleotide
gaggaaguauauuuuaaa

SEQ ID NO: 36158 - RNA, 18 nt, Artificial Sequence
  Description of Artificial Sequence: Synthetic oligonucleotide
ucaccgaggaaguauauu

SEQ ID NO: 36159 - RNA, 18 nt, Artificial Sequence
  Description of Artificial Sequence: Synthetic oligonucleotide
acuauucaccgaggaagu

SEQ ID NO: 36160 - RNA, 18 nt, Artificial Sequence
  Description of Artificial Sequence: Synthetic oligonucleotide
ucugcacuauucaccgag

SEQ ID NO: 36161 - RNA, 18 nt, Artificial Sequence
  Description of Artificial Sequence: Synthetic oligonucleotide
guggaucugcacuauuca

SEQ ID NO: 36162 - RNA, 18 nt, Artificial Sequence
  Description of Artificial Sequence: Synthetic oligonucleotide
aaucaguggaucugcacu

SEQ ID NO: 36163 - RNA, 18 nt, Artificial Sequence
  Description of Artificial Sequence: Synthetic oligonucleotide
auaggaaucaguggaucu

SEQ ID NO: 36164 - RNA, 18 nt, Artificial Sequence
  Description of Artificial Sequence: Synthetic oligonucleotide
guaucauaggaaucagug

SEQ ID NO: 36165 - RNA, 18 nt, Artificial Sequence
  Description of Artificial Sequence: Synthetic oligonucleotide
auaaaguaucauaggaau

SEQ ID NO: 36166 - RNA, 18 nt, Artificial Sequence
  Description of Artificial Sequence: Synthetic oligonucleotide
uauugauaaaguaucaua

SEQ ID NO: 36167 - RNA, 18 nt, Artificial Sequence
  Description of Artificial Sequence: Synthetic oligonucleotide
uauauuauugauaaagua

SEQ ID NO: 36168 - RNA, 18 nt, Artificial Sequence
  Description of Artificial Sequence: Synthetic oligonucleotide
cuauuuauauuauugaua

SEQ ID NO: 36169 - RNA, 18 nt, Artificial Sequence
  Description of Artificial Sequence: Synthetic oligonucleotide
uuaaacuauuuauauuau

SEQ ID NO: 36170 - RNA, 18 nt, Artificial Sequence
  Description of Artificial Sequence: Synthetic oligonucleotide
auuauuuaaacuauuuau

SEQ ID NO: 36171 - RNA, 18 nt, Artificial Sequence
  Description of Artificial Sequence: Synthetic oligonucleotide
uucaaauuauuuaaacua

SEQ ID NO: 36172 - RNA, 18 nt, Artificial Sequence
  Description of Artificial Sequence: Synthetic oligonucleotide
agaacuucaaauuauuua

SEQ ID NO: 36173 - RNA, 18 nt, Artificial Sequence
  Description of Artificial Sequence: Synthetic oligonucleotide
ucuccagaacuucaaauu

SEQ ID NO: 36174 - RNA, 18 nt, Artificial Sequence
  Description of Artificial Sequence: Synthetic oligonucleotide
ucaucucuccagaacuuc

SEQ ID NO: 36175 - RNA, 18 nt, Artificial Sequence
  Description of Artificial Sequence: Synthetic oligonucleotide
augcuucaucucuccaga

SEQ ID NO: 36176 - RNA, 18 nt, Artificial Sequence
  Description of Artificial Sequence: Synthetic oligonucleotide
uuuugaugcuucaucucu

SEQ ID NO: 36177 - RNA, 18 nt, Artificial Sequence
  Description of Artificial Sequence: Synthetic oligonucleotide
guacuuuuugaugcuuca

SEQ ID NO: 36178 - RNA, 18 nt, Artificial Sequence
  Description of Artificial Sequence: Synthetic oligonucleotide
caagaguacuuuuugaug

SEQ ID NO: 36179 - RNA, 18 nt, Artificial Sequence
  Description of Artificial Sequence: Synthetic oligonucleotide
cccuacaagaguacuuuu

SEQ ID NO: 36180 - RNA, 18 nt, Artificial Sequence
  Description of Artificial Sequence: Synthetic oligonucleotide
gguuucccuacaagagua

SEQ ID NO: 36181 - RNA, 18 nt, Artificial Sequence
  Description of Artificial Sequence: Synthetic oligonucleotide
gaacugguuucccuacaa

SEQ ID NO: 36182 - RNA, 18 nt, Artificial Sequence
  Description of Artificial Sequence: Synthetic oligonucleotide
auaaugaacugguuuccc

SEQ ID NO: 36183 - RNA, 18 nt, Artificial Sequence
  Description of Artificial Sequence: Synthetic oligonucleotide
ccaaaauaaugaacuggu

SEQ ID NO: 36184 - RNA, 18 nt, Artificial Sequence
  Description of Artificial Sequence: Synthetic oligonucleotide
gaaaaccaaaauaaugaa

SEQ ID NO: 36185 - RNA, 18 nt, Artificial Sequence
  Description of Artificial Sequence: Synthetic oligonucleotide
uuauagaaaaccaaaaua

SEQ ID NO: 36186 - RNA, 18 nt, Artificial Sequence
  Description of Artificial Sequence: Synthetic oligonucleotide
aagauuuauagaaaacca

SEQ ID NO: 36187 - RNA, 18 nt, Artificial Sequence
  Description of Artificial Sequence: Synthetic oligonucleotide
uucagaagauuuauagaa

SEQ ID NO: 36188 - RNA, 18 nt, Artificial Sequence
  Description of Artificial Sequence: Synthetic oligonucleotide
uauuuuucagaagauuua

SEQ ID NO: 36189 - RNA, 18 nt, Artificial Sequence
  Description of Artificial Sequence: Synthetic oligonucleotide
agugauauuuuucagaag

SEQ ID NO: 36190 - RNA, 18 nt, Artificial Sequence
  Description of Artificial Sequence: Synthetic oligonucleotide
ccucuagugauauuuuuc

SEQ ID NO: 36191 - RNA, 18 nt, Artificial Sequence
  Description of Artificial Sequence: Synthetic oligonucleotide
uuuaaccucuagugauau

SEQ ID NO: 36192 - RNA, 18 nt, Artificial Sequence
  Description of Artificial Sequence: Synthetic oligonucleotide
ugauuuuuaaccucuagu

SEQ ID NO: 36193 - RNA, 18 nt, Artificial Sequence
  Description of Artificial Sequence: Synthetic oligonucleotide
aguaaugauuuuuaaccu

SEQ ID NO: 36194 - RNA, 18 nt, Artificial Sequence
  Description of Artificial Sequence: Synthetic oligonucleotide
uuguuaguaaugauuuuu

SEQ ID NO: 36195 - RNA, 18 nt, Artificial Sequence
  Description of Artificial Sequence: Synthetic oligonucleotide
gucuauuguuaguaauga

SEQ ID NO: 36196 - RNA, 18 nt, Artificial Sequence
  Description of Artificial Sequence: Synthetic oligonucleotide
ugacugucuauuguuagu

SEQ ID NO: 36197 - RNA, 18 nt, Artificial Sequence
  Description of Artificial Sequence: Synthetic oligonucleotide
agagaugacugucuauug

SEQ ID NO: 36198 - RNA, 18 nt, Artificial Sequence
  Description of Artificial Sequence: Synthetic oligonucleotide
aauaaagagaugacuguc

SEQ ID NO: 36199 - RNA, 18 nt, Artificial Sequence
  Description of Artificial Sequence: Synthetic oligonucleotide
guagaaauaaagagauga

SEQ ID NO: 36200 - RNA, 18 nt, Artificial Sequence
  Description of Artificial Sequence: Synthetic oligonucleotide
aaaaaguagaaauaaaga

SEQ ID NO: 36201 - RNA, 18 nt, Artificial Sequence
  Description of Artificial Sequence: Synthetic oligonucleotide
ggaagaaaaaguagaaau

SEQ ID NO: 36202 - RNA, 18 nt, Artificial Sequence
  Description of Artificial Sequence: Synthetic oligonucleotide
uacagggaagaaaaagua

SEQ ID NO: 36203 - RNA, 18 nt, Artificial Sequence
  Description of Artificial Sequence: Synthetic oligonucleotide
gcuggaccauauguuucc

SEQ ID NO: 36204 - RNA, 18 nt, Artificial Sequence
  Description of Artificial Sequence: Synthetic oligonucleotide
aaaacgcuggaccauaug

SEQ ID NO: 36205 - RNA, 18 nt, Artificial Sequence
  Description of Artificial Sequence: Synthetic oligonucleotide
aaaaaaaaacgcuggacc

SEQ ID NO: 36206 - RNA, 18 nt, Artificial Sequence
  Description of Artificial Sequence: Synthetic oligonucleotide
agaaaaaaaaaaaacgcu

SEQ ID NO: 36207 - RNA, 18 nt, Artificial Sequence
  Description of Artificial Sequence: Synthetic oligonucleotide
caaaaagaaaaaaaaaaa

SEQ ID NO: 36208 - RNA, 18 nt, Artificial Sequence
  Description of Artificial Sequence: Synthetic oligonucleotide
guugacaaaaagaaaaaa

SEQ ID NO: 36209 - RNA, 18 nt, Artificial Sequence
  Description of Artificial Sequence: Synthetic oligonucleotide
guuauguugacaaaaaga

SEQ ID NO: 36210 - RNA, 18 nt, Artificial Sequence
  Description of Artificial Sequence: Synthetic oligonucleotide
uuacaguuauguugacaa

SEQ ID NO: 36211 - RNA, 18 nt, Artificial Sequence
  Description of Artificial Sequence: Synthetic oligonucleotide
aauccuuacaguuauguu

SEQ ID NO: 36212 - RNA, 18 nt, Artificial Sequence
  Description of Artificial Sequence: Synthetic oligonucleotide
aaaaaaauccuuacaguu

SEQ ID NO: 36213 - RNA, 18 nt, Artificial Sequence
  Description of Artificial Sequence: Synthetic oligonucleotide
ugaaaaaaaaaauccuua

SEQ ID NO: 36214 - RNA, 18 nt, Artificial Sequence
  Description of Artificial Sequence: Synthetic oligonucleotide
uugcuugaaaaaaaaaau

SEQ ID NO: 36215 - RNA, 18 nt, Artificial Sequence
  Description of Artificial Sequence: Synthetic oligonucleotide
ugauuuugcuugaaaaaa

SEQ ID NO: 36216 - RNA, 18 nt, Artificial Sequence
  Description of Artificial Sequence: Synthetic oligonucleotide
uguuuugauuuugcuuga

SEQ ID NO: 36217 - RNA, 18 nt, Artificial Sequence
  Description of Artificial Sequence: Synthetic oligonucleotide
gaauauguuuugauuuug

SEQ ID NO: 36218 - RNA, 18 nt, Artificial Sequence
  Description of Artificial Sequence: Synthetic oligonucleotide
acguagaauauguuuuga

SEQ ID NO: 36219 - RNA, 18 nt, Artificial Sequence
  Description of Artificial Sequence: Synthetic oligonucleotide
uucacacguagaauaugu

SEQ ID NO: 36220 - RNA, 18 nt, Artificial Sequence
  Description of Artificial Sequence: Synthetic oligonucleotide
uuucguucacacguagaa

SEQ ID NO: 36221 - RNA, 18 nt, Artificial Sequence
  Description of Artificial Sequence: Synthetic oligonucleotide
guauauuucguucacacg

SEQ ID NO: 36222 - RNA, 18 nt, Artificial Sequence
  Description of Artificial Sequence: Synthetic oligonucleotide
agaauguauauuucguuc

SEQ ID NO: 36223 - RNA, 18 nt, Artificial Sequence
  Description of Artificial Sequence: Synthetic oligonucleotide
augaaagaauguauauuu

SEQ ID NO: 36224 - RNA, 18 nt, Artificial Sequence
  Description of Artificial Sequence: Synthetic oligonucleotide
gagggaugaaagaaugua

SEQ ID NO: 36225 - RNA, 18 nt, Artificial Sequence
  Description of Artificial Sequence: Synthetic oligonucleotide
ugccugagggaugaaaga

SEQ ID NO: 36226 - RNA, 18 nt, Artificial Sequence
  Description of Artificial Sequence: Synthetic oligonucleotide
ucgacugccugagggaug

SEQ ID NO: 36227 - RNA, 18 nt, Artificial Sequence
  Description of Artificial Sequence: Synthetic oligonucleotide
agacuucgacugccugag

SEQ ID NO: 36228 - RNA, 18 nt, Artificial Sequence
  Description of Artificial Sequence: Synthetic oligonucleotide
aacaaagacuucgacugc

SEQ ID NO: 36229 - RNA, 18 nt, Artificial Sequence
  Description of Artificial Sequence: Synthetic oligonucleotide
agaacaacaaagacuucg

SEQ ID NO: 36230 - RNA, 18 nt, Artificial Sequence
  Description of Artificial Sequence: Synthetic oligonucleotide
ucugcagaacaacaaaga

SEQ ID NO: 36231 - RNA, 18 nt, Artificial Sequence
  Description of Artificial Sequence: Synthetic oligonucleotide
guuuuucugcagaacaac

SEQ ID NO: 36232 - RNA, 18 nt, Artificial Sequence
  Description of Artificial Sequence: Synthetic oligonucleotide
uuaauguuuuucugcaga

SEQ ID NO: 36233 - RNA, 18 nt, Artificial Sequence
  Description of Artificial Sequence: Synthetic oligonucleotide
aauaauuaauguuuuucu

SEQ ID NO: 36234 - RNA, 18 nt, Artificial Sequence
  Description of Artificial Sequence: Synthetic oligonucleotide
auaauaauaauuaauguu

SEQ ID NO: 36235 - RNA, 18 nt, Artificial Sequence
  Description of Artificial Sequence: Synthetic oligonucleotide
caauaauaauaauaauua

SEQ ID NO: 36236 - RNA, 18 nt, Artificial Sequence
  Description of Artificial Sequence: Synthetic oligonucleotide
aaaaccaauaauaauaau

SEQ ID NO: 36237 - RNA, 18 nt, Artificial Sequence
  Description of Artificial Sequence: Synthetic oligonucleotide
aucucaaaaccaauaaua

SEQ ID NO: 36238 - RNA, 18 nt, Artificial Sequence
  Description of Artificial Sequence: Synthetic oligonucleotide
caaaaaucucaaaaccaa

SEQ ID NO: 36239 - RNA, 18 nt, Artificial Sequence
  Description of Artificial Sequence: Synthetic oligonucleotide
ccaaacaaaaaucucaaa

SEQ ID NO: 36240 - RNA, 18 nt, Artificial Sequence
  Description of Artificial Sequence: Synthetic oligonucleotide
aaaaaccaaacaaaaauc

SEQ ID NO: 36241 - RNA, 18 nt, Artificial Sequence
  Description of Artificial Sequence: Synthetic oligonucleotide
aaaacaaaaaccaaacaa

SEQ ID NO: 36242 - RNA, 18 nt, Artificial Sequence
  Description of Artificial Sequence: Synthetic oligonucleotide
acaaaaaaacaaaaacca

SEQ ID NO: 36243 - RNA, 18 nt, Artificial Sequence
  Description of Artificial Sequence: Synthetic oligonucleotide
gaaaaacaaaaaaacaaa

SEQ ID NO: 36244 - RNA, 18 nt, Artificial Sequence
  Description of Artificial Sequence: Synthetic oligonucleotide
ccucugaaaaacaaaaaa

SEQ ID NO: 36245 - RNA, 18 nt, Artificial Sequence
  Description of Artificial Sequence: Synthetic oligonucleotide
aaaggccucugaaaaaca

SEQ ID NO: 36246 - RNA, 18 nt, Artificial Sequence
  Description of Artificial Sequence: Synthetic oligonucleotide
caaagaaaggccucugaa

SEQ ID NO: 36247 - RNA, 18 nt, Artificial Sequence
  Description of Artificial Sequence: Synthetic oligonucleotide
ggcuccaaagaaaggccu

SEQ ID NO: 36248 - RNA, 18 nt, Artificial Sequence
  Description of Artificial Sequence: Synthetic oligonucleotide
uuuagggcuccaaagaaa

SEQ ID NO: 36249 - RNA, 18 nt, Artificial Sequence
  Description of Artificial Sequence: Synthetic oligonucleotide
gaaaauuuagggcuccaa

SEQ ID NO: 36250 - RNA, 18 nt, Artificial Sequence
  Description of Artificial Sequence: Synthetic oligonucleotide
uugaagaaaauuuagggc

SEQ ID NO: 36251 - RNA, 18 nt, Artificial Sequence
  Description of Artificial Sequence: Synthetic oligonucleotide
cauccuugaagaaaauuu

SEQ ID NO: 36252 - RNA, 18 nt, Artificial Sequence
  Description of Artificial Sequence: Synthetic oligonucleotide
gagaccauccuugaagaa

SEQ ID NO: 36253 - RNA, 18 nt, Artificial Sequence
  Description of Artificial Sequence: Synthetic oligonucleotide
aaaaugagaccauccuug

SEQ ID NO: 36254 - RNA, 18 nt, Artificial Sequence
  Description of Artificial Sequence: Synthetic oligonucleotide
ucaguaaaaugagaccau

SEQ ID NO: 36255 - RNA, 18 nt, Artificial Sequence
  Description of Artificial Sequence: Synthetic oligonucleotide
ucucuucaguaaaaugag

SEQ ID NO: 36256 - RNA, 18 nt, Artificial Sequence
  Description of Artificial Sequence: Synthetic oligonucleotide
aauuuucucuucaguaaa

SEQ ID NO: 36257 - RNA, 18 nt, Artificial Sequence
  Description of Artificial Sequence: Synthetic oligonucleotide
ccaucaauuuucucuuca

SEQ ID NO: 36258 - RNA, 18 nt, Artificial Sequence
  Description of Artificial Sequence: Synthetic oligonucleotide
uuaggccaucaauuuucu

SEQ ID NO: 36259 - RNA, 18 nt, Artificial Sequence
  Description of Artificial Sequence: Synthetic oligonucleotide
accucuuaggccaucaau

SEQ ID NO: 36260 - RNA, 18 nt, Artificial Sequence
  Description of Artificial Sequence: Synthetic oligonucleotide
acauaaccucuuaggcca

SEQ ID NO: 36261 - RNA, 18 nt, Artificial Sequence
  Description of Artificial Sequence: Synthetic oligonucleotide
aagucacauaaccucuua

SEQ ID NO: 36262 - RNA, 18 nt, Artificial Sequence
  Description of Artificial Sequence: Synthetic oligonucleotide
ugggaaagucacauaacc

SEQ ID NO: 36263 - RNA, 18 nt, Artificial Sequence
  Description of Artificial Sequence: Synthetic oligonucleotide
aucacugggaaagucaca

SEQ ID NO: 36264 - RNA, 18 nt, Artificial Sequence
  Description of Artificial Sequence: Synthetic oligonucleotide
uauguaucacugggaaag

SEQ ID NO: 36265 - RNA, 18 nt, Artificial Sequence
  Description of Artificial Sequence: Synthetic oligonucleotide
cuggcuauguaucacugg

SEQ ID NO: 36266 - RNA, 18 nt, Artificial Sequence
  Description of Artificial Sequence: Synthetic oligonucleotide
agucacuggcuauguauc

SEQ ID NO: 36267 - RNA, 18 nt, Artificial Sequence
  Description of Artificial Sequence: Synthetic oligonucleotide
gugucagucacuggcuau

SEQ ID NO: 36268 - RNA, 18 nt, Artificial Sequence
  Description of Artificial Sequence: Synthetic oligonucleotide
ugccugugucagucacug

SEQ ID NO: 36269 - RNA, 18 nt, Artificial Sequence
  Description of Artificial Sequence: Synthetic oligonucleotide
aucugugccugugucagu

SEQ ID NO: 36270 - RNA, 18 nt, Artificial Sequence
  Description of Artificial Sequence: Synthetic oligonucleotide
aagcuaucugugccugug

SEQ ID NO: 36271 - RNA, 18 nt, Artificial Sequence
  Description of Artificial Sequence: Synthetic oligonucleotide
ugggcaagcuaucugugc

SEQ ID NO: 36272 - RNA, 18 nt, Artificial Sequence
  Description of Artificial Sequence: Synthetic oligonucleotide
gcgacugggcaagcuauc

SEQ ID NO: 36273 - RNA, 18 nt, Artificial Sequence
  Description of Artificial Sequence: Synthetic oligonucleotide
gggacgcgacugggcaag

SEQ ID NO: 36274 - RNA, 18 nt, Artificial Sequence
  Description of Artificial Sequence: Synthetic oligonucleotide
acccugggacgcgacugg

SEQ ID NO: 36275 - RNA, 18 nt, Artificial Sequence
  Description of Artificial Sequence: Synthetic oligonucleotide
gagggacccugggacgcg

SEQ ID NO: 36276 - RNA, 18 nt, Artificial Sequence
  Description of Artificial Sequence: Synthetic oligonucleotide
uagaugagggacccuggg

SEQ ID NO: 36277 - RNA, 18 nt, Artificial Sequence
  Description of Artificial Sequence: Synthetic oligonucleotide
agcuauagaugagggacc

SEQ ID NO: 36278 - RNA, 18 nt, Artificial Sequence
  Description of Artificial Sequence: Synthetic oligonucleotide
caggaagcuauagaugag

SEQ ID NO: 36279 - RNA, 18 nt, Artificial Sequence
  Description of Artificial Sequence: Synthetic oligonucleotide
aacugcaggaagcuauag

SEQ ID NO: 36280 - RNA, 18 nt, Artificial Sequence
  Description of Artificial Sequence: Synthetic oligonucleotide
ggaggaacugcaggaagc

SEQ ID NO: 36281 - RNA, 18 nt, Artificial Sequence
  Description of Artificial Sequence: Synthetic oligonucleotide
ugcagggaggaacugcag

SEQ ID NO: 36282 - RNA, 18 nt, Artificial Sequence
  Description of Artificial Sequence: Synthetic oligonucleotide
caacaugcagggaggaac

SEQ ID NO: 36283 - RNA, 18 nt, Artificial Sequence
  Description of Artificial Sequence: Synthetic oligonucleotide
uaggucaacaugcaggga

SEQ ID NO: 36284 - RNA, 18 nt, Artificial Sequence
  Description of Artificial Sequence: Synthetic oligonucleotide
uuuuuuaggucaacaugc

SEQ ID NO: 36285 - RNA, 18 nt, Artificial Sequence
  Description of Artificial Sequence: Synthetic oligonucleotide
aguucuuuuuuaggucaa

SEQ ID NO: 36286 - RNA, 18 nt, Artificial Sequence
  Description of Artificial Sequence: Synthetic oligonucleotide
uccuaaguucuuuuuuag

SEQ ID NO: 36287 - RNA, 18 nt, Artificial Sequence
  Description of Artificial Sequence: Synthetic oligonucleotide
uuggcuccuaaguucuuu

SEQ ID NO: 36288 - RNA, 18 nt, Artificial Sequence
  Description of Artificial Sequence: Synthetic oligonucleotide
aagucuuggcuccuaagu

SEQ ID NO: 36289 - RNA, 18 nt, Artificial Sequence
  Description of Artificial Sequence: Synthetic oligonucleotide
uucuuaagucuuggcucc

SEQ ID NO: 36290 - RNA, 18 nt, Artificial Sequence
  Description of Artificial Sequence: Synthetic oligonucleotide
cagaguucuuaagucuug

SEQ ID NO: 36291 - RNA, 18 nt, Artificial Sequence
  Description of Artificial Sequence: Synthetic oligonucleotide
aaaugcagaguucuuaag

SEQ ID NO: 36292 - RNA, 18 nt, Artificial Sequence
  Description of Artificial Sequence: Synthetic oligonucleotide
gccagaaaugcagaguuc

SEQ ID NO: 36293 - RNA, 18 nt, Artificial Sequence
  Description of Artificial Sequence: Synthetic oligonucleotide
aaacagccagaaaugcag

SEQ ID NO: 36294 - RNA, 18 nt, Artificial Sequence
  Description of Artificial Sequence: Synthetic oligonucleotide
aauucaaacagccagaaa

SEQ ID NO: 36295 - RNA, 18 nt, Artificial Sequence
  Description of Artificial Sequence: Synthetic oligonucleotide
gaaagaauucaaacagcc

SEQ ID NO: 36296 - RNA, 18 nt, Artificial Sequence
  Description of Artificial Sequence: Synthetic oligonucleotide
agcaggaaagaauucaaa

SEQ ID NO: 36297 - RNA, 18 nt, Artificial Sequence
  Description of Artificial Sequence: Synthetic oligonucleotide
cagugagcaggaaagaau

SEQ ID NO: 36298 - RNA, 18 nt, Artificial Sequence
  Description of Artificial Sequence: Synthetic oligonucleotide
aaccucagugagcaggaa

SEQ ID NO: 36299 - RNA, 18 nt, Artificial Sequence
  Description of Artificial Sequence: Synthetic oligonucleotide
acagaaaccucagugagc

SEQ ID NO: 36300 - RNA, 18 nt, Artificial Sequence
  Description of Artificial Sequence: Synthetic oligonucleotide
aauucuugccugugucag

SEQ ID NO: 36301 - RNA, 18 nt, Artificial Sequence
  Description of Artificial Sequence: Synthetic oligonucleotide
gacuaaauucuugccugu

SEQ ID NO: 36302 - RNA, 18 nt, Artificial Sequence
  Description of Artificial Sequence: Synthetic oligonucleotide
agcgugacuaaauucuug

SEQ ID NO: 36303 - RNA, 18 nt, Artificial Sequence
  Description of Artificial Sequence: Synthetic oligonucleotide
gggagcgugacuaaauuc

SEQ ID NO: 36304 - RNA, 18 nt, Artificial Sequence
  Description of Artificial Sequence: Synthetic oligonucleotide
aguggcaguuguauuggg

SEQ ID NO: 36305 - RNA, 18 nt, Artificial Sequence
  Description of Artificial Sequence: Synthetic oligonucleotide
auugcaguggcaguugua

SEQ ID NO: 36306 - RNA, 18 nt, Artificial Sequence
  Description of Artificial Sequence: Synthetic oligonucleotide
acagaauugcaguggcag

SEQ ID NO: 36307 - RNA, 18 nt, Artificial Sequence
  Description of Artificial Sequence: Synthetic oligonucleotide
acugcacagaauugcagu

SEQ ID NO: 36308 - RNA, 18 nt, Artificial Sequence
  Description of Artificial Sequence: Synthetic oligonucleotide
ucgucacugcacagaauu

SEQ ID NO: 36309 - RNA, 18 nt, Artificial Sequence
  Description of Artificial Sequence: Synthetic oligonucleotide
uagucucgucacugcaca

SEQ ID NO: 36310 - RNA, 18 nt, Artificial Sequence
  Description of Artificial Sequence: Synthetic oligonucleotide
ccagauagucucgucacu

SEQ ID NO: 36311 - RNA, 18 nt, Artificial Sequence
  Description of Artificial Sequence: Synthetic oligonucleotide
uccagccagauagucucg

SEQ ID NO: 36312 - RNA, 18 nt, Artificial Sequence
  Description of Artificial Sequence: Synthetic oligonucleotide
caggcuccagccagauag

SEQ ID NO: 36313 - RNA, 18 nt, Artificial Sequence
  Description of Artificial Sequence: Synthetic oligonucleotide
aacuucaggcuccagcca

SEQ ID NO: 36314 - RNA, 18 nt, Artificial Sequence
  Description of Artificial Sequence: Synthetic oligonucleotide
aagagaacuucaggcucc

SEQ ID NO: 36315 - RNA, 18 nt, Artificial Sequence
  Description of Artificial Sequence: Synthetic oligonucleotide
cugaaaagagaacuucag

SEQ ID NO: 36316 - RNA, 18 nt, Artificial Sequence
  Description of Artificial Sequence: Synthetic oligonucleotide
aggcccugaaaagagaac

SEQ ID NO: 36317 - RNA, 18 nt, Artificial Sequence
  Description of Artificial Sequence: Synthetic oligonucleotide
ugacgaggcccugaaaag

SEQ ID NO: 36318 - RNA, 18 nt, Artificial Sequence
  Description of Artificial Sequence: Synthetic oligonucleotide
ugcagaggcuuggugagg

SEQ ID NO: 36319 - RNA, 18 nt, Artificial Sequence
  Description of Artificial Sequence: Synthetic oligonucleotide
cucauugcagaggcuugg

SEQ ID NO: 36320 - RNA, 18 nt, Artificial Sequence
  Description of Artificial Sequence: Synthetic oligonucleotide
agaaccucauugcagagg

SEQ ID NO: 36321 - RNA, 18 nt, Artificial Sequence
  Description of Artificial Sequence: Synthetic oligonucleotide
acagaagaaccucauugc

SEQ ID NO: 36322 - RNA, 18 nt, Artificial Sequence
  Description of Artificial Sequence: Synthetic oligonucleotide
cgugcacagaagaaccuc

SEQ ID NO: 36323 - RNA, 18 nt, Artificial Sequence
  Description of Artificial Sequence: Synthetic oligonucleotide
agcaacgugcacagaaga

SEQ ID NO: 36324 - RNA, 18 nt, Artificial Sequence
  Description of Artificial Sequence: Synthetic oligonucleotide
gcugcagcaacgugcaca

SEQ ID NO: 36325 - RNA, 18 nt, Artificial Sequence
  Description of Artificial Sequence: Synthetic oligonucleotide
ccaaagcugcagcaacgu

SEQ ID NO: 36326 - RNA, 18 nt, Artificial Sequence
  Description of Artificial Sequence: Synthetic oligonucleotide
caggcccaaagcugcagc

SEQ ID NO: 36327 - RNA, 18 nt, Artificial Sequence
  Description of Artificial Sequence: Synthetic oligonucleotide
caucucaggcccaaagcu

SEQ ID NO: 36328 - RNA, 18 nt, Artificial Sequence
  Description of Artificial Sequence: Synthetic oligonucleotide
gcuggcaucucaggccca

SEQ ID NO: 36329 - RNA, 18 nt, Artificial Sequence
  Description of Artificial Sequence: Synthetic oligonucleotide
ggacagcuggcaucucag

SEQ ID NO: 36330 - RNA, 18 nt, Artificial Sequence
  Description of Artificial Sequence: Synthetic oligonucleotide
cagcuggacagcuggcau

SEQ ID NO: 36331 - RNA, 18 nt, Artificial Sequence
  Description of Artificial Sequence: Synthetic oligonucleotide
agcagcagcuggacagcu

SEQ ID NO: 36332 - RNA, 18 nt, Artificial Sequence
  Description of Artificial Sequence: Synthetic oligonucleotide
ccagaagcagcagcugga

SEQ ID NO: 36333 - RNA, 18 nt, Artificial Sequence
  Description of Artificial Sequence: Synthetic oligonucleotide
gcaggccagaagcagcag

SEQ ID NO: 36334 - RNA, 18 nt, Artificial Sequence
  Description of Artificial Sequence: Synthetic oligonucleotide
accaggcaggccagaagc

SEQ ID NO: 36335 - RNA, 18 nt, Artificial Sequence
  Description of Artificial Sequence: Synthetic oligonucleotide
cccacaccaggcaggcca

SEQ ID NO: 36336 - RNA, 18 nt, Artificial Sequence
  Description of Artificial Sequence: Synthetic oligonucleotide
cacaucccacaccaggca

SEQ ID NO: 36337 - RNA, 18 nt, Artificial Sequence
  Description of Artificial Sequence: Synthetic oligonucleotide
gcccccacaucccacacc

SEQ ID NO: 36338 - RNA, 18 nt, Artificial Sequence
  Description of Artificial Sequence: Synthetic oligonucleotide
uccuggcccccacauccc

SEQ ID NO: 36339 - RNA, 18 nt, Artificial Sequence
  Description of Artificial Sequence: Synthetic oligonucleotide
agcuguccuggcccccac

SEQ ID NO: 36340 - RNA, 18 nt, Artificial Sequence
  Description of Artificial Sequence: Synthetic oligonucleotide
agcugagcuguccuggcc

SEQ ID NO: 36341 - RNA, 18 nt, Artificial Sequence
  Description of Artificial Sequence: Synthetic oligonucleotide
uccugagcugagcugucc

SEQ ID NO: 36342 - RNA, 18 nt, Artificial Sequence
  Description of Artificial Sequence: Synthetic oligonucleotide
ggccuuccugagcugagc

SEQ ID NO: 36343 - RNA, 18 nt, Artificial Sequence
  Description of Artificial Sequence: Synthetic oligonucleotide
ucauuggccuuccugagc

SEQ ID NO: 36344 - RNA, 18 nt, Artificial Sequence
  Description of Artificial Sequence: Synthetic oligonucleotide
ucuggucauuggccuucc

SEQ ID NO: 36345 - RNA, 18 nt, Artificial Sequence
  Description of Artificial Sequence: Synthetic oligonucleotide
gccacucuggucauuggc

SEQ ID NO: 36346 - RNA, 18 nt, Artificial Sequence
  Description of Artificial Sequence: Synthetic oligonucleotide
caucggccacucugguca

SEQ ID NO: 36347 - RNA, 18 nt, Artificial Sequence
  Description of Artificial Sequence: Synthetic oligonucleotide
acuggcaucggccacucu

SEQ ID NO: 36348 - RNA, 18 nt, Artificial Sequence
  Description of Artificial Sequence: Synthetic oligonucleotide
gguauacuggcaucggcc

SEQ ID NO: 36349 - RNA, 18 nt, Artificial Sequence
  Description of Artificial Sequence: Synthetic oligonucleotide
cugaagguauacuggcau

SEQ ID NO: 36350 - RNA, 18 nt, Artificial Sequence
  Description of Artificial Sequence: Synthetic oligonucleotide
ccacacugaagguauacu

SEQ ID NO: 36351 - RNA, 18 nt, Artificial Sequence
  Description of Artificial Sequence: Synthetic oligonucleotide
acuggccacacugaaggu

SEQ ID NO: 36352 - RNA, 18 nt, Artificial Sequence
  Description of Artificial Sequence: Synthetic oligonucleotide
uugggacuggccacacug

SEQ ID NO: 36353 - RNA, 18 nt, Artificial Sequence
  Description of Artificial Sequence: Synthetic oligonucleotide
auucauugggacuggcca

SEQ ID NO: 36354 - RNA, 18 nt, Artificial Sequence
  Description of Artificial Sequence: Synthetic oligonucleotide
gcuggauucauugggacu

SEQ ID NO: 36355 - RNA, 18 nt, Artificial Sequence
  Description of Artificial Sequence: Synthetic oligonucleotide
gggcagcuggauucauug

SEQ ID NO: 36356 - RNA, 18 nt, Artificial Sequence
  Description of Artificial Sequence: Synthetic oligonucleotide
gcucugggcagcuggauu

SEQ ID NO: 36357 - RNA, 18 nt, Artificial Sequence
  Description of Artificial Sequence: Synthetic oligonucleotide
gcucugcucugggcagcu

SEQ ID NO: 36358 - RNA, 18 nt, Artificial Sequence
  Description of Artificial Sequence: Synthetic oligonucleotide
gccuggcucugcucuggg

SEQ ID NO: 36359 - RNA, 18 nt, Artificial Sequence
  Description of Artificial Sequence: Synthetic oligonucleotide
acauggccuggcucugcu

SEQ ID NO: 36360 - RNA, 18 nt, Artificial Sequence
  Description of Artificial Sequence: Synthetic oligonucleotide
gacugacauggccuggcu

SEQ ID NO: 36361 - RNA, 18 nt, Artificial Sequence
  Description of Artificial Sequence: Synthetic oligonucleotide
uggaugacugacauggcc

SEQ ID NO: 36362 - RNA, 18 nt, Artificial Sequence
  Description of Artificial Sequence: Synthetic oligonucleotide
aguuauggaugacugaca

SEQ ID NO: 36363 - RNA, 18 nt, Artificial Sequence
  Description of Artificial Sequence: Synthetic oligonucleotide
cuguaaguuauggaugac

SEQ ID NO: 36364 - RNA, 18 nt, Artificial Sequence
  Description of Artificial Sequence: Synthetic oligonucleotide
ucucucuguaaguuaugg

SEQ ID NO: 36365 - RNA, 18 nt, Artificial Sequence
  Description of Artificial Sequence: Synthetic oligonucleotide
ugcugucucucuguaagu

SEQ ID NO: 36366 - RNA, 18 nt, Artificial Sequence
  Description of Artificial Sequence: Synthetic oligonucleotide
ggugcugcugucucucug

SEQ ID NO: 36367 - RNA, 18 nt, Artificial Sequence
  Description of Artificial Sequence: Synthetic oligonucleotide
cguugggugcugcugucu

SEQ ID NO: 36368 - RNA, 18 nt, Artificial Sequence
  Description of Artificial Sequence: Synthetic oligonucleotide
cuaagcguugggugcugc

SEQ ID NO: 36369 - RNA, 18 nt, Artificial Sequence
  Description of Artificial Sequence: Synthetic oligonucleotide
caggucuaagcguugggu

SEQ ID NO: 36370 - RNA, 18 nt, Artificial Sequence
  Description of Artificial Sequence: Synthetic oligonucleotide
gccuccaggucuaagcgu

SEQ ID NO: 36371 - RNA, 18 nt, Artificial Sequence
  Description of Artificial Sequence: Synthetic oligonucleotide
ugguggccuccaggucua

SEQ ID NO: 36372 - RNA, 18 nt, Artificial Sequence
  Description of Artificial Sequence: Synthetic oligonucleotide
agcuuugguggccuccag

SEQ ID NO: 36373 - RNA, 18 nt, Artificial Sequence
  Description of Artificial Sequence: Synthetic oligonucleotide
agucgagcuuugguggcc

SEQ ID NO: 36374 - RNA, 18 nt, Artificial Sequence
  Description of Artificial Sequence: Synthetic oligonucleotide
agcugagucgagcuuugg

SEQ ID NO: 36375 - RNA, 18 nt, Artificial Sequence
  Description of Artificial Sequence: Synthetic oligonucleotide
cagggagcugagucgagc

SEQ ID NO: 36376 - RNA, 18 nt, Artificial Sequence
  Description of Artificial Sequence: Synthetic oligonucleotide
cucuccagggagcugagu

SEQ ID NO: 36377 - RNA, 18 nt, Artificial Sequence
  Description of Artificial Sequence: Synthetic oligonucleotide
ggaggcucuccagggagc

SEQ ID NO: 36378 - RNA, 18 nt, Artificial Sequence
  Description of Artificial Sequence: Synthetic oligonucleotide
guggaggaggcucuccag

SEQ ID NO: 36379 - RNA, 18 nt, Artificial Sequence
  Description of Artificial Sequence: Synthetic oligonucleotide
aauugguggaggaggcuc

SEQ ID NO: 36380 - RNA, 18 nt, Artificial Sequence
  Description of Artificial Sequence: Synthetic oligonucleotide
aggucaauugguggagga

SEQ ID NO: 36381 - RNA, 18 nt, Artificial Sequence
  Description of Artificial Sequence: Synthetic oligonucleotide
guccaaggucaauuggug

SEQ ID NO: 36382 - RNA, 18 nt, Artificial Sequence
  Description of Artificial Sequence: Synthetic oligonucleotide
gccugguccaaggucaau

SEQ ID NO: 36383 - RNA, 18 nt, Artificial Sequence
  Description of Artificial Sequence: Synthetic oligonucleotide
uggcagccugguccaagg

SEQ ID NO: 36384 - RNA, 18 nt, Artificial Sequence
  Description of Artificial Sequence: Synthetic oligonucleotide
gggccuggcagccugguc

SEQ ID NO: 36385 - RNA, 18 nt, Artificial Sequence
  Description of Artificial Sequence: Synthetic oligonucleotide
ccuccugggucuccuggg

SEQ ID NO: 36386 - RNA, 18 nt, Artificial Sequence
  Description of Artificial Sequence: Synthetic oligonucleotide
ccccuccugggucuccug

SEQ ID NO: 36387 - RNA, 18 nt, Artificial Sequence
  Description of Artificial Sequence: Synthetic oligonucleotide
ugcagccccuccuggguc

SEQ ID NO: 36388 - RNA, 18 nt, Artificial Sequence
  Description of Artificial Sequence: Synthetic oligonucleotide
cccucugcagccccuccu

SEQ ID NO: 36389 - RNA, 18 nt, Artificial Sequence
  Description of Artificial Sequence: Synthetic oligonucleotide
cagcucccucugcagccc

SEQ ID NO: 36390 - RNA, 18 nt, Artificial Sequence
  Description of Artificial Sequence: Synthetic oligonucleotide
gugcccagcucccucugc

SEQ ID NO: 36391 - RNA, 18 nt, Artificial Sequence
  Description of Artificial Sequence: Synthetic oligonucleotide
ucagggugcccagcuccc

SEQ ID NO: 36392 - RNA, 18 nt, Artificial Sequence
  Description of Artificial Sequence: Synthetic oligonucleotide
ccgccucagggugcccag

SEQ ID NO: 36393 - RNA, 18 nt, Artificial Sequence
  Description of Artificial Sequence: Synthetic oligonucleotide
cgcucccgccucagggug

SEQ ID NO: 36394 - RNA, 18 nt, Artificial Sequence
  Description of Artificial Sequence: Synthetic oligonucleotide
ggucccgcucccgccuca

SEQ ID NO: 36395 - RNA, 18 nt, Artificial Sequence
  Description of Artificial Sequence: Synthetic oligonucleotide
cagcuggucccgcucccg

SEQ ID NO: 36396 - RNA, 18 nt, Artificial Sequence
  Description of Artificial Sequence: Synthetic oligonucleotide
guuuccagcuggucccgc

SEQ ID NO: 36397 - RNA, 18 nt, Artificial Sequence
  Description of Artificial Sequence: Synthetic oligonucleotide
uuuggguuuccagcuggu

SEQ ID NO: 36398 - RNA, 18 nt, Artificial Sequence
  Description of Artificial Sequence: Synthetic oligonucleotide
ucugguuuggguuuccag

SEQ ID NO: 36399 - RNA, 18 nt, Artificial Sequence
  Description of Artificial Sequence: Synthetic oligonucleotide
aacucucugguuuggguu

SEQ ID NO: 36400 - RNA, 18 nt, Artificial Sequence
  Description of Artificial Sequence: Synthetic oligonucleotide
ucuccaacucucugguuu

SEQ ID NO: 36401 - RNA, 18 nt, Artificial Sequence
  Description of Artificial Sequence: Synthetic oligonucleotide
ggcagucuccaacucucu

SEQ ID NO: 36402 - RNA, 18 nt, Artificial Sequence
  Description of Artificial Sequence: Synthetic oligonucleotide
cuguaggcagucuccaac

SEQ ID NO: 36403 - RNA, 18 nt, Artificial Sequence
  Description of Artificial Sequence: Synthetic oligonucleotide
gguugcuguaggcagucu

SEQ ID NO: 36404 - RNA, 18 nt, Artificial Sequence
  Description of Artificial Sequence: Synthetic oligonucleotide
gaggagguugcuguaggc

SEQ ID NO: 36405 - RNA, 18 nt, Artificial Sequence
  Description of Artificial Sequence: Synthetic oligonucleotide
ucucggaggagguugcug

SEQ ID NO: 36406 - RNA, 18 nt, Artificial Sequence
  Description of Artificial Sequence: Synthetic oligonucleotide
acuugucucggaggaggu

SEQ ID NO: 36407 - RNA, 18 nt, Artificial Sequence
  Description of Artificial Sequence: Synthetic oligonucleotide
aacugacuugucucggag

SEQ ID NO: 36408 - RNA, 18 nt, Artificial Sequence
  Description of Artificial Sequence: Synthetic oligonucleotide
uccagaacugacuugucu

SEQ ID NO: 36409 - RNA, 18 nt, Artificial Sequence
  Description of Artificial Sequence: Synthetic oligonucleotide
cuuccuccagaacugacu

SEQ ID NO: 36410 - RNA, 18 nt, Artificial Sequence
  Description of Artificial Sequence: Synthetic oligonucleotide
cuucucuuccuccagaac

SEQ ID NO: 36411 - RNA, 18 nt, Artificial Sequence
  Description of Artificial Sequence: Synthetic oligonucleotide
cgcuucuucucuuccucc

SEQ ID NO: 36412 - RNA, 18 nt, Artificial Sequence
  Description of Artificial Sequence: Synthetic oligonucleotide
uuagucgcuucuucucuu

SEQ ID NO: 36413 - RNA, 18 nt, Artificial Sequence
  Description of Artificial Sequence: Synthetic oligonucleotide
uugccuuagucgcuucuu

SEQ ID NO: 36414 - RNA, 18 nt, Artificial Sequence
  Description of Artificial Sequence: Synthetic oligonucleotide
uuuucuugccuuagucgc

SEQ ID NO: 36415 - RNA, 18 nt, Artificial Sequence
  Description of Artificial Sequence: Synthetic oligonucleotide
ucucauuuucuugccuua

SEQ ID NO: 36416 - RNA, 18 nt, Artificial Sequence
  Description of Artificial Sequence: Synthetic oligonucleotide
cagauucucauuuucuug

SEQ ID NO: 36417 - RNA, 18 nt, Artificial Sequence
  Description of Artificial Sequence: Synthetic oligonucleotide
cuggccagauucucauuu

SEQ ID NO: 36418 - RNA, 18 nt, Artificial Sequence
  Description of Artificial Sequence: Synthetic oligonucleotide
accuccuggccagauucu

SEQ ID NO: 36419 - RNA, 18 nt, Artificial Sequence
  Description of Artificial Sequence: Synthetic oligonucleotide
uuccaaccuccuggccag

SEQ ID NO: 36420 - RNA, 18 nt, Artificial Sequence
  Description of Artificial Sequence: Synthetic oligonucleotide
cugcuuuccaaccuccug

SEQ ID NO: 36421 - RNA, 18 nt, Artificial Sequence
  Description of Artificial Sequence: Synthetic oligonucleotide
ggcugcugcuuuccaacc

SEQ ID NO: 36422 - RNA, 18 nt, Artificial Sequence
  Description of Artificial Sequence: Synthetic oligonucleotide
cuccuggcugcugcuuuc

SEQ ID NO: 36423 - RNA, 18 nt, Artificial Sequence
  Description of Artificial Sequence: Synthetic oligonucleotide
gcuaccuccuggcugcug

SEQ ID NO: 36424 - RNA, 18 nt, Artificial Sequence
  Description of Artificial Sequence: Synthetic oligonucleotide
gccuugcuaccuccuggc

SEQ ID NO: 36425 - RNA, 18 nt, Artificial Sequence
  Description of Artificial Sequence: Synthetic oligonucleotide
ucucagccuugcuaccuc

SEQ ID NO: 36426 - RNA, 18 nt, Artificial Sequence
  Description of Artificial Sequence: Synthetic oligonucleotide
ccccuucucagccuugcu

SEQ ID NO: 36427 - RNA, 18 nt, Artificial Sequence
  Description of Artificial Sequence: Synthetic oligonucleotide
acuggccccuucucagcc

SEQ ID NO: 36428 - RNA, 18 nt, Artificial Sequence
  Description of Artificial Sequence: Synthetic oligonucleotide
gggacacuggccccuucu

SEQ ID NO: 36429 - RNA, 18 nt, Artificial Sequence
  Description of Artificial Sequence: Synthetic oligonucleotide
cagugucucgggucuggg

SEQ ID NO: 36430 - RNA, 18 nt, Artificial Sequence
  Description of Artificial Sequence: Synthetic oligonucleotide
agcagugucucgggucug

SEQ ID NO: 36431 - RNA, 18 nt, Artificial Sequence
  Description of Artificial Sequence: Synthetic oligonucleotide
gcccgagcagugucucgg

SEQ ID NO: 36432 - RNA, 18 nt, Artificial Sequence
  Description of Artificial Sequence: Synthetic oligonucleotide
gcacagcccgagcagugu

SEQ ID NO: 36433 - RNA, 18 nt, Artificial Sequence
  Description of Artificial Sequence: Synthetic oligonucleotide
ugguggcacagcccgagc

SEQ ID NO: 36434 - RNA, 18 nt, Artificial Sequence
  Description of Artificial Sequence: Synthetic oligonucleotide
gagccugguggcacagcc

SEQ ID NO: 36435 - RNA, 18 nt, Artificial Sequence
  Description of Artificial Sequence: Synthetic oligonucleotide
cucuggagccugguggca

SEQ ID NO: 36436 - RNA, 18 nt, Artificial Sequence
  Description of Artificial Sequence: Synthetic oligonucleotide
guccccccacucugcauu

SEQ ID NO: 36437 - RNA, 18 nt, Artificial Sequence
  Description of Artificial Sequence: Synthetic oligonucleotide
ucagaguccccccacucu

SEQ ID NO: 36438 - RNA, 18 nt, Artificial Sequence
  Description of Artificial Sequence: Synthetic oligonucleotide
ugaacucagagucccccc

SEQ ID NO: 36439 - RNA, 18 nt, Artificial Sequence
  Description of Artificial Sequence: Synthetic oligonucleotide
ccugcugaacucagaguc

SEQ ID NO: 36440 - RNA, 18 nt, Artificial Sequence
  Description of Artificial Sequence: Synthetic oligonucleotide
uaucaccugcugaacuca

SEQ ID NO: 36441 - RNA, 18 nt, Artificial Sequence
  Description of Artificial Sequence: Synthetic oligonucleotide
agccauaucaccugcuga

SEQ ID NO: 36442 - RNA, 18 nt, Artificial Sequence
  Description of Artificial Sequence: Synthetic oligonucleotide
cuacgagccauaucaccu

SEQ ID NO: 36443 - RNA, 18 nt, Artificial Sequence
  Description of Artificial Sequence: Synthetic oligonucleotide
ggucacuacgagccauau

SEQ ID NO: 36444 - RNA, 18 nt, Artificial Sequence
  Description of Artificial Sequence: Synthetic oligonucleotide
uagcaggucacuacgagc

SEQ ID NO: 36445 - RNA, 18 nt, Artificial Sequence
  Description of Artificial Sequence: Synthetic oligonucleotide
gccuguagcaggucacua

SEQ ID NO: 36446 - RNA, 18 nt, Artificial Sequence
  Description of Artificial Sequence: Synthetic oligonucleotide
ggagcgccuguagcaggu

SEQ ID NO: 36447 - RNA, 18 nt, Artificial Sequence
  Description of Artificial Sequence: Synthetic oligonucleotide
ggccuggagcgccuguag

SEQ ID NO: 36448 - RNA, 18 nt, Artificial Sequence
  Description of Artificial Sequence: Synthetic oligonucleotide
agggaggccuggagcgcc

SEQ ID NO: 36449 - RNA, 18 nt, Artificial Sequence
  Description of Artificial Sequence: Synthetic oligonucleotide
caggcagggaggccugga

SEQ ID NO: 36450 - RNA, 18 nt, Artificial Sequence
  Description of Artificial Sequence: Synthetic oligonucleotide
aagggcaggcagggaggc

SEQ ID NO: 36451 - RNA, 18 nt, Artificial Sequence
  Description of Artificial Sequence: Synthetic oligonucleotide
ggagaaagggcaggcagg

SEQ ID NO: 36452 - RNA, 18 nt, Artificial Sequence
  Description of Artificial Sequence: Synthetic oligonucleotide
cucuaggagaaagggcag

SEQ ID NO: 36453 - RNA, 18 nt, Artificial Sequence
  Description of Artificial Sequence: Synthetic oligonucleotide
gcagucucuaggagaaag

SEQ ID NO: 36454 - RNA, 18 nt, Artificial Sequence
  Description of Artificial Sequence: Synthetic oligonucleotide
gcugugcagucucuagga

SEQ ID NO: 36455 - RNA, 18 nt, Artificial Sequence
  Description of Artificial Sequence: Synthetic oligonucleotide
ugcuagcugugcagucuc

SEQ ID NO: 36456 - RNA, 18 nt, Artificial Sequence
  Description of Artificial Sequence: Synthetic oligonucleotide
ucuugugcuagcugugca

SEQ ID NO: 36457 - RNA, 18 nt, Artificial Sequence
  Description of Artificial Sequence: Synthetic oligonucleotide
aucugucuugugcuagcu

SEQ ID NO: 36458 - RNA, 18 nt, Artificial Sequence
  Description of Artificial Sequence: Synthetic oligonucleotide
aauucaucugucuugugc

SEQ ID NO: 36459 - RNA, 18 nt, Artificial Sequence
  Description of Artificial Sequence: Synthetic oligonucleotide
uccuuaauucaucugucu

SEQ ID NO: 36460 - RNA, 18 nt, Artificial Sequence
  Description of Artificial Sequence: Synthetic oligonucleotide
ugcuuuccuuaauucauc

SEQ ID NO: 36461 - RNA, 18 nt, Artificial Sequence
  Description of Artificial Sequence: Synthetic oligonucleotide
cgcugugcuuuccuuaau

SEQ ID NO: 36462 - RNA, 18 nt, Artificial Sequence
  Description of Artificial Sequence: Synthetic oligonucleotide
gugaucgcugugcuuucc

SEQ ID NO: 36463 - RNA, 18 nt, Artificial Sequence
  Description of Artificial Sequence: Synthetic oligonucleotide
ugaaggugaucgcugugc

SEQ ID NO: 36464 - RNA, 18 nt, Artificial Sequence
  Description of Artificial Sequence: Synthetic oligonucleotide
auacuugaaggugaucgc

SEQ ID NO: 36465 - RNA, 18 nt, Artificial Sequence
  Description of Artificial Sequence: Synthetic oligonucleotide
uaguaauacuugaaggug

SEQ ID NO: 36466 - RNA, 18 nt, Artificial Sequence
  Description of Artificial Sequence: Synthetic oligonucleotide
auuacuaguaauacuuga

SEQ ID NO: 36467 - RNA, 18 nt, Artificial Sequence
  Description of Artificial Sequence: Synthetic oligonucleotide
gcuaaauuacuaguaaua

SEQ ID NO: 36468 - RNA, 18 nt, Artificial Sequence
  Description of Artificial Sequence: Synthetic oligonucleotide
caggagcuaaauuacuag

SEQ ID NO: 36469 - RNA, 18 nt, Artificial Sequence
  Description of Artificial Sequence: Synthetic oligonucleotide
gcucucaggagcuaaauu

SEQ ID NO: 36470 - RNA, 18 nt, Artificial Sequence
  Description of Artificial Sequence: Synthetic oligonucleotide
augaagcucucaggagcu

SEQ ID NO: 36471 - RNA, 18 nt, Artificial Sequence
  Description of Artificial Sequence: Synthetic oligonucleotide
ucuaaaugaagcucucag

SEQ ID NO: 36472 - RNA, 18 nt, Artificial Sequence
  Description of Artificial Sequence: Synthetic oligonucleotide
acuaaucuaaaugaagcu

SEQ ID NO: 36473 - RNA, 18 nt, Artificial Sequence
  Description of Artificial Sequence: Synthetic oligonucleotide
gaaccacuaaucuaaaug

SEQ ID NO: 36474 - RNA, 18 nt, Artificial Sequence
  Description of Artificial Sequence: Synthetic oligonucleotide
acucugaaccacuaaucu

SEQ ID NO: 36475 - RNA, 18 nt, Artificial Sequence
  Description of Artificial Sequence: Synthetic oligonucleotide
caagaacucugaaccacu

SEQ ID NO: 36476 - RNA, 18 nt, Artificial Sequence
  Description of Artificial Sequence: Synthetic oligonucleotide
gggcacaagaacucugaa

SEQ ID NO: 36477 - RNA, 18 nt, Artificial Sequence
  Description of Artificial Sequence: Synthetic oligonucleotide
cugugaaaacugacaugg

SEQ ID NO: 36478 - RNA, 18 nt, Artificial Sequence
  Description of Artificial Sequence: Synthetic oligonucleotide
auggacugugaaaacuga

SEQ ID NO: 36479 - RNA, 18 nt, Artificial Sequence
  Description of Artificial Sequence: Synthetic oligonucleotide
uugcuauggacugugaaa

SEQ ID NO: 36480 - RNA, 18 nt, Artificial Sequence
  Description of Artificial Sequence: Synthetic oligonucleotide
uccuuuugcuauggacug

SEQ ID NO: 36481 - RNA, 18 nt, Artificial Sequence
  Description of Artificial Sequence: Synthetic oligonucleotide
auuucuccuuuugcuaug

SEQ ID NO: 36482 - RNA, 18 nt, Artificial Sequence
  Description of Artificial Sequence: Synthetic oligonucleotide
cuuuuauuucuccuuuug

SEQ ID NO: 36483 - RNA, 18 nt, Artificial Sequence
  Description of Artificial Sequence: Synthetic oligonucleotide
cgguccuuuuauuucucc

SEQ ID NO: 36484 - RNA, 18 nt, Artificial Sequence
  Description of Artificial Sequence: Synthetic oligonucleotide
ucacccgguccuuuuauu

SEQ ID NO: 36485 - RNA, 18 nt, Artificial Sequence
  Description of Artificial Sequence: Synthetic oligonucleotide
acaucucacccgguccuu

SEQ ID NO: 36486 - RNA, 18 nt, Artificial Sequence
  Description of Artificial Sequence: Synthetic oligonucleotide
cagacacaucucacccgg

SEQ ID NO: 36487 - RNA, 18 nt, Artificial Sequence
  Description of Artificial Sequence: Synthetic oligonucleotide
auaugcagacacaucuca

SEQ ID NO: 36488 - RNA, 18 nt, Artificial Sequence
  Description of Artificial Sequence: Synthetic oligonucleotide
ugcucauaugcagacaca

SEQ ID NO: 36489 - RNA, 18 nt, Artificial Sequence
  Description of Artificial Sequence: Synthetic oligonucleotide
ucuacugcucauaugcag

SEQ ID NO: 36490 - RNA, 18 nt, Artificial Sequence
  Description of Artificial Sequence: Synthetic oligonucleotide
aacuuucuacugcucaua

SEQ ID NO: 36491 - RNA, 18 nt, Artificial Sequence
  Description of Artificial Sequence: Synthetic oligonucleotide
uugacaacuuucuacugc

SEQ ID NO: 36492 - RNA, 18 nt, Artificial Sequence
  Description of Artificial Sequence: Synthetic oligonucleotide
gacaauugacaacuuucu

SEQ ID NO: 36493 - RNA, 18 nt, Artificial Sequence
  Description of Artificial Sequence: Synthetic oligonucleotide
aaagggacaauugacaac

SEQ ID NO: 36494 - RNA, 18 nt, Artificial Sequence
  Description of Artificial Sequence: Synthetic oligonucleotide
uuucaaaagggacaauug

SEQ ID NO: 36495 - RNA, 18 nt, Artificial Sequence
  Description of Artificial Sequence: Synthetic oligonucleotide
uaguuuuucaaaagggac

SEQ ID NO: 36496 - RNA, 18 nt, Artificial Sequence
  Description of Artificial Sequence: Synthetic oligonucleotide
aaggauaguuuuucaaaa

SEQ ID NO: 36497 - RNA, 18 nt, Artificial Sequence
  Description of Artificial Sequence: Synthetic oligonucleotide
caaaaaaggauaguuuuu

SEQ ID NO: 36498 - RNA, 18 nt, Artificial Sequence
  Description of Artificial Sequence: Synthetic oligonucleotide
agguucaaaaaaggauag

SEQ ID NO: 36499 - RNA, 18 nt, Artificial Sequence
  Description of Artificial Sequence: Synthetic oligonucleotide
agcaaagguucaaaaaag

SEQ ID NO: 36500 - RNA, 18 nt, Artificial Sequence
  Description of Artificial Sequence: Synthetic oligonucleotide
aucugagcaaagguucaa

SEQ ID NO: 36501 - RNA, 18 nt, Artificial Sequence
  Description of Artificial Sequence: Synthetic oligonucleotide
uaacaaucugagcaaagg

SEQ ID NO: 36502 - RNA, 18 nt, Artificial Sequence
  Description of Artificial Sequence: Synthetic oligonucleotide
acaaauaacaaucugagc

SEQ ID NO: 36503 - RNA, 18 nt, Artificial Sequence
  Description of Artificial Sequence: Synthetic oligonucleotide
aagguacaaauaacaauc

SEQ ID NO: 36504 - RNA, 18 nt, Artificial Sequence
  Description of Artificial Sequence: Synthetic oligonucleotide
aucaaaagguacaaauaa

SEQ ID NO: 36505 - RNA, 18 nt, Artificial Sequence
  Description of Artificial Sequence: Synthetic oligonucleotide
uuaacaucaaaagguaca

SEQ ID NO: 36506 - RNA, 18 nt, Artificial Sequence
  Description of Artificial Sequence: Synthetic oligonucleotide
ucauuuuaacaucaaaag

SEQ ID NO: 36507 - RNA, 18 nt, Artificial Sequence
  Description of Artificial Sequence: Synthetic oligonucleotide
aaaggucauuuuaacauc

SEQ ID NO: 36508 - RNA, 18 nt, Artificial Sequence
  Description of Artificial Sequence: Synthetic oligonucleotide
uaaauaaaggucauuuua

SEQ ID NO: 36509 - RNA, 18 nt, Artificial Sequence
  Description of Artificial Sequence: Synthetic oligonucleotide
uuucauaaauaaagguca

SEQ ID NO: 36510 - RNA, 18 nt, Artificial Sequence
  Description of Artificial Sequence: Synthetic oligonucleotide
uguaauuucauaaauaaa

SEQ ID NO: 36511 - RNA, 18 nt, Artificial Sequence
  Description of Artificial Sequence: Synthetic oligonucleotide
ucuauuguaauuucauaa

SEQ ID NO: 36512 - RNA, 18 nt, Artificial Sequence
  Description of Artificial Sequence: Synthetic oligonucleotide
ccaaaucuauuguaauuu

SEQ ID NO: 36513 - RNA, 18 nt, Artificial Sequence
  Description of Artificial Sequence: Synthetic oligonucleotide
auuucccaaaucuauugu

SEQ ID NO: 36514 - RNA, 18 nt, Artificial Sequence
  Description of Artificial Sequence: Synthetic oligonucleotide
uuaucauuucccaaaucu

SEQ ID NO: 36515 - RNA, 18 nt, Artificial Sequence
  Description of Artificial Sequence: Synthetic oligonucleotide
acuuauuaucauuuccca

SEQ ID NO: 36516 - RNA, 18 nt, Artificial Sequence
  Description of Artificial Sequence: Synthetic oligonucleotide
uuaccacuuauuaucauu

SEQ ID NO: 36517 - RNA, 18 nt, Artificial Sequence
  Description of Artificial Sequence: Synthetic oligonucleotide
aaaacuuaccacuuauua

SEQ ID NO: 36518 - RNA, 18 nt, Artificial Sequence
  Description of Artificial Sequence: Synthetic oligonucleotide
aaacaaaaacuuaccacu

SEQ ID NO: 36519 - RNA, 18 nt, Artificial Sequence
  Description of Artificial Sequence: Synthetic oligonucleotide
aaaauaaacaaaaacuua

SEQ ID NO: 36520 - RNA, 18 nt, Artificial Sequence
  Description of Artificial Sequence: Synthetic oligonucleotide
auuuaaaaauaaacaaaa

SEQ ID NO: 36521 - RNA, 18 nt, Artificial Sequence
  Description of Artificial Sequence: Synthetic oligonucleotide
agaacauuuaaaaauaaa

SEQ ID NO: 36522 - RNA, 18 nt, Artificial Sequence
  Description of Artificial Sequence: Synthetic oligonucleotide
agggaagaacauuuaaaa

SEQ ID NO: 36523 - RNA, 18 nt, Artificial Sequence
  Description of Artificial Sequence: Synthetic oligonucleotide
uugccagggaagaacauu

SEQ ID NO: 36524 - RNA, 18 nt, Artificial Sequence
  Description of Artificial Sequence: Synthetic oligonucleotide
uuauuuugccagggaaga

SEQ ID NO: 36525 - RNA, 18 nt, Artificial Sequence
  Description of Artificial Sequence: Synthetic oligonucleotide
ucucuuuauuuugccagg

SEQ ID NO: 36526 - RNA, 18 nt, Artificial Sequence
  Description of Artificial Sequence: Synthetic oligonucleotide
ugccaucucuuuauuuug

SEQ ID NO: 36527 - RNA, 18 nt, Artificial Sequence
  Description of Artificial Sequence: Synthetic oligonucleotide
agaggugccaucucuuua

SEQ ID NO: 36528 - RNA, 18 nt, Artificial Sequence
  Description of Artificial Sequence: Synthetic oligonucleotide
gacagagaggugccaucu

SEQ ID NO: 36529 - RNA, 18 nt, Artificial Sequence
  Description of Artificial Sequence: Synthetic oligonucleotide
aaacugacagagaggugc

SEQ ID NO: 36530 - RNA, 18 nt, Artificial Sequence
  Description of Artificial Sequence: Synthetic oligonucleotide
uaagaaaacugacagaga

SEQ ID NO: 36531 - RNA, 18 nt, Artificial Sequence
  Description of Artificial Sequence: Synthetic oligonucleotide
cauauuaagaaaacugac

SEQ ID NO: 36532 - RNA, 18 nt, Artificial Sequence
  Description of Artificial Sequence: Synthetic oligonucleotide
gauaacaguugggccuga

SEQ ID NO: 36533 - RNA, 18 nt, Artificial Sequence
  Description of Artificial Sequence: Synthetic oligonucleotide
gugcugauaacaguuggg

SEQ ID NO: 36534 - RNA, 18 nt, Artificial Sequence
  Description of Artificial Sequence: Synthetic oligonucleotide
ggacugugcugauaacag

SEQ ID NO: 36535 - RNA, 18 nt, Artificial Sequence
  Description of Artificial Sequence: Synthetic oligonucleotide
ugauuggacugugcugau

SEQ ID NO: 36536 - RNA, 18 nt, Artificial Sequence
  Description of Artificial Sequence: Synthetic oligonucleotide
aaacaugauuggacugug

SEQ ID NO: 36537 - RNA, 18 nt, Artificial Sequence
  Description of Artificial Sequence: Synthetic oligonucleotide
agauaaaacaugauugga

SEQ ID NO: 36538 - RNA, 18 nt, Artificial Sequence
  Description of Artificial Sequence: Synthetic oligonucleotide
agggaagauaaaacauga

SEQ ID NO: 36539 - RNA, 18 nt, Artificial Sequence
  Description of Artificial Sequence: Synthetic oligonucleotide
agagaagggaagauaaaa

SEQ ID NO: 36540 - RNA, 18 nt, Artificial Sequence
  Description of Artificial Sequence: Synthetic oligonucleotide
gggucagagaagggaaga

SEQ ID NO: 36541 - RNA, 18 nt, Artificial Sequence
  Description of Artificial Sequence: Synthetic oligonucleotide
uuuuagauaaggacuggg

SEQ ID NO: 36542 - RNA, 18 nt, Artificial Sequence
  Description of Artificial Sequence: Synthetic oligonucleotide
uugauuuuagauaaggac

SEQ ID NO: 36543 - RNA, 18 nt, Artificial Sequence
  Description of Artificial Sequence: Synthetic oligonucleotide
gagauuugauuuuagaua

SEQ ID NO: 36544 - RNA, 18 nt, Artificial Sequence
  Description of Artificial Sequence: Synthetic oligonucleotide
uguuugagauuugauuuu

SEQ ID NO: 36545 - RNA, 18 nt, Artificial Sequence
  Description of Artificial Sequence: Synthetic oligonucleotide
uaugguguuugagauuug

SEQ ID NO: 36546 - RNA, 18 nt, Artificial Sequence
  Description of Artificial Sequence: Synthetic oligonucleotide
aaagauaugguguuugag

SEQ ID NO: 36547 - RNA, 18 nt, Artificial Sequence
  Description of Artificial Sequence: Synthetic oligonucleotide
cucccaaagauauggugu

SEQ ID NO: 36548 - RNA, 18 nt, Artificial Sequence
  Description of Artificial Sequence: Synthetic oligonucleotide
auaggcucccaaagauau

SEQ ID NO: 36549 - RNA, 18 nt, Artificial Sequence
  Description of Artificial Sequence: Synthetic oligonucleotide
aauaaauaggcucccaaa

SEQ ID NO: 36550 - RNA, 18 nt, Artificial Sequence
  Description of Artificial Sequence: Synthetic oligonucleotide
aacuaaauaaauaggcuc

SEQ ID NO: 36551 - RNA, 18 nt, Artificial Sequence
  Description of Artificial Sequence: Synthetic oligonucleotide
uaacuaacuaaauaaaua

SEQ ID NO: 36552 - RNA, 18 nt, Artificial Sequence
  Description of Artificial Sequence: Synthetic oligonucleotide
aaaacuaacuaacuaaau

SEQ ID NO: 36553 - RNA, 18 nt, Artificial Sequence
  Description of Artificial Sequence: Synthetic oligonucleotide
gucugaaaacuaacuaac

SEQ ID NO: 36554 - RNA, 18 nt, Artificial Sequence
  Description of Artificial Sequence: Synthetic oligonucleotide
acucugucugaaaacuaa

SEQ ID NO: 36555 - RNA, 18 nt, Artificial Sequence
  Description of Artificial Sequence: Synthetic oligonucleotide
aagaaacucugucugaaa

SEQ ID NO: 36556 - RNA, 18 nt, Artificial Sequence
  Description of Artificial Sequence: Synthetic oligonucleotide
caagaaagaaacucuguc

SEQ ID NO: 36557 - RNA, 18 nt, Artificial Sequence
  Description of Artificial Sequence: Synthetic oligonucleotide
ggcaacaagaaagaaacu

SEQ ID NO: 36558 - RNA, 18 nt, Artificial Sequence
  Description of Artificial Sequence: Synthetic oligonucleotide
gcuugggcaacaagaaag

SEQ ID NO: 36559 - RNA, 18 nt, Artificial Sequence
  Description of Artificial Sequence: Synthetic oligonucleotide
cuccagcuugggcaacaa

SEQ ID NO: 36560 - RNA, 18 nt, Artificial Sequence
  Description of Artificial Sequence: Synthetic oligonucleotide
uuguacuccagcuugggc

SEQ ID NO: 36561 - RNA, 18 nt, Artificial Sequence
  Description of Artificial Sequence: Synthetic oligonucleotide
cacuauuguacuccagcu

SEQ ID NO: 36562 - RNA, 18 nt, Artificial Sequence
  Description of Artificial Sequence: Synthetic oligonucleotide
gacuacacuauuguacuc

SEQ ID NO: 36563 - RNA, 18 nt, Artificial Sequence
  Description of Artificial Sequence: Synthetic oligonucleotide
gccgagacuacacuauug

SEQ ID NO: 36564 - RNA, 18 nt, Artificial Sequence
  Description of Artificial Sequence: Synthetic oligonucleotide
ugugagccgagacuacac

SEQ ID NO: 36565 - RNA, 18 nt, Artificial Sequence
  Description of Artificial Sequence: Synthetic oligonucleotide
auugcugugagccgagac

SEQ ID NO: 36566 - RNA, 18 nt, Artificial Sequence
  Description of Artificial Sequence: Synthetic oligonucleotide
gggagauugcugugagcc

SEQ ID NO: 36567 - RNA, 18 nt, Artificial Sequence
  Description of Artificial Sequence: Synthetic oligonucleotide
ugcuugaaccaaggaggg

SEQ ID NO: 36568 - RNA, 18 nt, Artificial Sequence
  Description of Artificial Sequence: Synthetic oligonucleotide
auugcuugaaccaaggag

SEQ ID NO: 36569 - RNA, 18 nt, Artificial Sequence
  Description of Artificial Sequence: Synthetic oligonucleotide
ggagaauugcuugaacca

SEQ ID NO: 36570 - RNA, 18 nt, Artificial Sequence
  Description of Artificial Sequence: Synthetic oligonucleotide
aggcaggagaauugcuug

SEQ ID NO: 36571 - RNA, 18 nt, Artificial Sequence
  Description of Artificial Sequence: Synthetic oligonucleotide
gacugaggcaggagaauu

SEQ ID NO: 36572 - RNA, 18 nt, Artificial Sequence
  Description of Artificial Sequence: Synthetic oligonucleotide
ugggagacugaggcagga

SEQ ID NO: 36573 - RNA, 18 nt, Artificial Sequence
  Description of Artificial Sequence: Synthetic oligonucleotide
cuucuugggagacugagg

SEQ ID NO: 36574 - RNA, 18 nt, Artificial Sequence
  Description of Artificial Sequence: Synthetic oligonucleotide
cccagcuucuugggagac

SEQ ID NO: 36575 - RNA, 18 nt, Artificial Sequence
  Description of Artificial Sequence: Synthetic oligonucleotide
auaaucccagcuucuugg

SEQ ID NO: 36576 - RNA, 18 nt, Artificial Sequence
  Description of Artificial Sequence: Synthetic oligonucleotide
ugccuauaaucccagcuu

SEQ ID NO: 36577 - RNA, 18 nt, Artificial Sequence
  Description of Artificial Sequence: Synthetic oligonucleotide
gcaggugccuauaauccc

SEQ ID NO: 36578 - RNA, 18 nt, Artificial Sequence
  Description of Artificial Sequence: Synthetic oligonucleotide
ugguggcaggugccuaua

SEQ ID NO: 36579 - RNA, 18 nt, Artificial Sequence
  Description of Artificial Sequence: Synthetic oligonucleotide
ggaugugguggcaggugc

SEQ ID NO: 36580 - RNA, 18 nt, Artificial Sequence
  Description of Artificial Sequence: Synthetic oligonucleotide
uagcuggaugugguggca

SEQ ID NO: 36581 - RNA, 18 nt, Artificial Sequence
  Description of Artificial Sequence: Synthetic oligonucleotide
agaauuagcuggaugugg

SEQ ID NO: 36582 - RNA, 18 nt, Artificial Sequence
  Description of Artificial Sequence: Synthetic oligonucleotide
acaaaagaauuagcugga

SEQ ID NO: 36583 - RNA, 18 nt, Artificial Sequence
  Description of Artificial Sequence: Synthetic oligonucleotide
aaaacacaaaagaauuag

SEQ ID NO: 36584 - RNA, 18 nt, Artificial Sequence
  Description of Artificial Sequence: Synthetic oligonucleotide
ugcuaaaaacacaaaaga

SEQ ID NO: 36585 - RNA, 18 nt, Artificial Sequence
  Description of Artificial Sequence: Synthetic oligonucleotide
gucuuugcuaaaaacaca

SEQ ID NO: 36586 - RNA, 18 nt, Artificial Sequence
  Description of Artificial Sequence: Synthetic oligonucleotide
acccugucuuugcuaaaa

SEQ ID NO: 36587 - RNA, 18 nt, Artificial Sequence
  Description of Artificial Sequence: Synthetic oligonucleotide
gugaaacccugucuuugc

SEQ ID NO: 36588 - RNA, 18 nt, Artificial Sequence
  Description of Artificial Sequence: Synthetic oligonucleotide
acauggugaaacccuguc

SEQ ID NO: 36589 - RNA, 18 nt, Artificial Sequence
  Description of Artificial Sequence: Synthetic oligonucleotide
ggccaacauggugaaacc

SEQ ID NO: 36590 - RNA, 18 nt, Artificial Sequence
  Description of Artificial Sequence: Synthetic oligonucleotide
agccuggccaacauggug

SEQ ID NO: 36591 - RNA, 18 nt, Artificial Sequence
  Description of Artificial Sequence: Synthetic oligonucleotide
agaccagccuggccaaca

SEQ ID NO: 36592 - RNA, 18 nt, Artificial Sequence
  Description of Artificial Sequence: Synthetic oligonucleotide
guucgagaccagccuggc

SEQ ID NO: 36593 - RNA, 18 nt, Artificial Sequence
  Description of Artificial Sequence: Synthetic oligonucleotide
caggaguucgagaccagc

SEQ ID NO: 36594 - RNA, 18 nt, Artificial Sequence
  Description of Artificial Sequence: Synthetic oligonucleotide
gaggucaggaguucgaga

SEQ ID NO: 36595 - RNA, 18 nt, Artificial Sequence
  Description of Artificial Sequence: Synthetic oligonucleotide
caccugaggucaggaguu

SEQ ID NO: 36596 - RNA, 18 nt, Artificial Sequence
  Description of Artificial Sequence: Synthetic oligonucleotide
cggaucaccugaggucag

SEQ ID NO: 36597 - RNA, 18 nt, Artificial Sequence
  Description of Artificial Sequence: Synthetic oligonucleotide
gcaggcggaucaccugag

SEQ ID NO: 36598 - RNA, 18 nt, Artificial Sequence
  Description of Artificial Sequence: Synthetic oligonucleotide
ccgaggcaggcggaucac

SEQ ID NO: 36599 - RNA, 18 nt, Artificial Sequence
  Description of Artificial Sequence: Synthetic oligonucleotide
ggaggccgaggcaggcgg

SEQ ID NO: 36600 - RNA, 18 nt, Artificial Sequence
  Description of Artificial Sequence: Synthetic oligonucleotide
cuuugggaggccgaggca

SEQ ID NO: 36601 - RNA, 18 nt, Artificial Sequence
  Description of Artificial Sequence: Synthetic oligonucleotide
cagcacuuugggaggccg

SEQ ID NO: 36602 - RNA, 18 nt, Artificial Sequence
  Description of Artificial Sequence: Synthetic oligonucleotide
aaucccagcacuuuggga

SEQ ID NO: 36603 - RNA, 18 nt, Artificial Sequence
  Description of Artificial Sequence: Synthetic oligonucleotide
ccuguaaucccagcacuu

SEQ ID NO: 36604 - RNA, 18 nt, Artificial Sequence
  Description of Artificial Sequence: Synthetic oligonucleotide
ucaugccuguaaucccag

SEQ ID NO: 36605 - RNA, 18 nt, Artificial Sequence
  Description of Artificial Sequence: Synthetic oligonucleotide
guggcucaugccuguaau

SEQ ID NO: 36606 - RNA, 18 nt, Artificial Sequence
  Description of Artificial Sequence: Synthetic oligonucleotide
gcgugguggcucaugccu

SEQ ID NO: 36607 - RNA, 18 nt, Artificial Sequence
  Description of Artificial Sequence: Synthetic oligonucleotide
gccaggcgugguggcuca

SEQ ID NO: 36608 - RNA, 18 nt, Artificial Sequence
  Description of Artificial Sequence: Synthetic oligonucleotide
ugccggccaggcguggug

SEQ ID NO: 36609 - RNA, 18 nt, Artificial Sequence
  Description of Artificial Sequence: Synthetic oligonucleotide
uaggcugccggccaggcg

SEQ ID NO: 36610 - RNA, 18 nt, Artificial Sequence
  Description of Artificial Sequence: Synthetic oligonucleotide
uuaaauaggcugccggcc

SEQ ID NO: 36611 - RNA, 18 nt, Artificial Sequence
  Description of Artificial Sequence: Synthetic oligonucleotide
gacauuuaaauaggcugc

SEQ ID NO: 36612 - RNA, 18 nt, Artificial Sequence
  Description of Artificial Sequence: Synthetic oligonucleotide
aggaugacauuuaaauag

SEQ ID NO: 36613 - RNA, 18 nt, Artificial Sequence
  Description of Artificial Sequence: Synthetic oligonucleotide
uguugaggaugacauuua

SEQ ID NO: 36614 - RNA, 18 nt, Artificial Sequence
  Description of Artificial Sequence: Synthetic oligonucleotide
gacuauguugaggaugac

SEQ ID NO: 36615 - RNA, 18 nt, Artificial Sequence
  Description of Artificial Sequence: Synthetic oligonucleotide
ggauugacuauguugagg

SEQ ID NO: 36616 - RNA, 18 nt, Artificial Sequence
  Description of Artificial Sequence: Synthetic oligonucleotide
cccaaggauugacuaugu

SEQ ID NO: 36617 - RNA, 18 nt, Artificial Sequence
  Description of Artificial Sequence: Synthetic oligonucleotide
aauggcccaaggauugac

SEQ ID NO: 36618 - RNA, 18 nt, Artificial Sequence
  Description of Artificial Sequence: Synthetic oligonucleotide
gaaaaaauggcccaagga

SEQ ID NO: 36619 - RNA, 18 nt, Artificial Sequence
  Description of Artificial Sequence: Synthetic oligonucleotide
uguaagaaaaaauggccc

SEQ ID NO: 36620 - RNA, 18 nt, Artificial Sequence
  Description of Artificial Sequence: Synthetic oligonucleotide
uuuacuguaagaaaaaau

SEQ ID NO: 36621 - RNA, 18 nt, Artificial Sequence
  Description of Artificial Sequence: Synthetic oligonucleotide
aaaauuuuacuguaagaa

SEQ ID NO: 36622 - RNA, 18 nt, Artificial Sequence
  Description of Artificial Sequence: Synthetic oligonucleotide
gagacaaaauuuuacugu

SEQ ID NO: 36623 - RNA, 18 nt, Artificial Sequence
  Description of Artificial Sequence: Synthetic oligonucleotide
uccaaauuccacguagaa

SEQ ID NO: 36624 - RNA, 18 nt, Artificial Sequence
  Description of Artificial Sequence: Synthetic oligonucleotide
aaguguccaaauuccacg

SEQ ID NO: 36625 - RNA, 18 nt, Artificial Sequence
  Description of Artificial Sequence: Synthetic oligonucleotide
ggccaaaguguccaaauu

SEQ ID NO: 36626 - RNA, 18 nt, Artificial Sequence
  Description of Artificial Sequence: Synthetic oligonucleotide
uggaaggccaaagugucc

SEQ ID NO: 36627 - RNA, 18 nt, Artificial Sequence
  Description of Artificial Sequence: Synthetic oligonucleotide
guuccuggaaggccaaag

SEQ ID NO: 36628 - RNA, 18 nt, Artificial Sequence
  Description of Artificial Sequence: Synthetic oligonucleotide
cuucaguuccuggaaggc

SEQ ID NO: 36629 - RNA, 18 nt, Artificial Sequence
  Description of Artificial Sequence: Synthetic oligonucleotide
ucggacuucaguuccugg

SEQ ID NO: 36630 - RNA, 18 nt, Artificial Sequence
  Description of Artificial Sequence: Synthetic oligonucleotide
uuagcucggacuucaguu

SEQ ID NO: 36631 - RNA, 18 nt, Artificial Sequence
  Description of Artificial Sequence: Synthetic oligonucleotide
uucaguuagcucggacuu

SEQ ID NO: 36632 - RNA, 18 nt, Artificial Sequence
  Description of Artificial Sequence: Synthetic oligonucleotide
ggaacuucaguuagcucg

SEQ ID NO: 36633 - RNA, 18 nt, Artificial Sequence
  Description of Artificial Sequence: Synthetic oligonucleotide
aagcaggaacuucaguua

SEQ ID NO: 36634 - RNA, 18 nt, Artificial Sequence
  Description of Artificial Sequence: Synthetic oligonucleotide
ucgggaagcaggaacuuc

SEQ ID NO: 36635 - RNA, 18 nt, Artificial Sequence
  Description of Artificial Sequence: Synthetic oligonucleotide
aaaauucgggaagcagga

SEQ ID NO: 36636 - RNA, 18 nt, Artificial Sequence
  Description of Artificial Sequence: Synthetic oligonucleotide
ccuucaaaauucgggaag

SEQ ID NO: 36637 - RNA, 18 nt, Artificial Sequence
  Description of Artificial Sequence: Synthetic oligonucleotide
gcucuccuucaaaauucg

SEQ ID NO: 36638 - RNA, 18 nt, Artificial Sequence
  Description of Artificial Sequence: Synthetic oligonucleotide
gaugggcucuccuucaaa

SEQ ID NO: 36639 - RNA, 18 nt, Artificial Sequence
  Description of Artificial Sequence: Synthetic oligonucleotide
agccagaugggcucuccu

SEQ ID NO: 36640 - RNA, 18 nt, Artificial Sequence
  Description of Artificial Sequence: Synthetic oligonucleotide
gagauagccagaugggcu

SEQ ID NO: 36641 - RNA, 18 nt, Artificial Sequence
  Description of Artificial Sequence: Synthetic oligonucleotide
cuccugagauagccagau

SEQ ID NO: 36642 - RNA, 18 nt, Artificial Sequence
  Description of Artificial Sequence: Synthetic oligonucleotide
cuccacuccugagauagc

SEQ ID NO: 36643 - RNA, 18 nt, Artificial Sequence
  Description of Artificial Sequence: Synthetic oligonucleotide
ucccucuccacuccugag

SEQ ID NO: 36644 - RNA, 18 nt, Artificial Sequence
  Description of Artificial Sequence: Synthetic oligonucleotide
gugucucccucuccacuc

SEQ ID NO: 36645 - RNA, 18 nt, Artificial Sequence
  Description of Artificial Sequence: Synthetic oligonucleotide
ccaaauuccacguagaaa

SEQ ID NO: 36646 - RNA, 18 nt, Artificial Sequence
  Description of Artificial Sequence: Synthetic oligonucleotide
aguguccaaauuccacgu

SEQ ID NO: 36647 - RNA, 18 nt, Artificial Sequence
  Description of Artificial Sequence: Synthetic oligonucleotide
gccaaaguguccaaauuc

SEQ ID NO: 36648 - RNA, 18 nt, Artificial Sequence
  Description of Artificial Sequence: Synthetic oligonucleotide
ggaaggccaaagugucca

SEQ ID NO: 36649 - RNA, 18 nt, Artificial Sequence
  Description of Artificial Sequence: Synthetic oligonucleotide
uuccuggaaggccaaagu

SEQ ID NO: 36650 - RNA, 18 nt, Artificial Sequence
  Description of Artificial Sequence: Synthetic oligonucleotide
uucaguuccuggaaggcc

SEQ ID NO: 36651 - RNA, 18 nt, Artificial Sequence
  Description of Artificial Sequence: Synthetic oligonucleotide
cggacuucaguuccugga

SEQ ID NO: 36652 - RNA, 18 nt, Artificial Sequence
  Description of Artificial Sequence: Synthetic oligonucleotide
uagcucggacuucaguuc

SEQ ID NO: 36653 - RNA, 18 nt, Artificial Sequence
  Description of Artificial Sequence: Synthetic oligonucleotide
ucaguuagcucggacuuc

SEQ ID NO: 36654 - RNA, 18 nt, Artificial Sequence
  Description of Artificial Sequence: Synthetic oligonucleotide
gaacuucaguuagcucgg

SEQ ID NO: 36655 - RNA, 18 nt, Artificial Sequence
  Description of Artificial Sequence: Synthetic oligonucleotide
agcaggaacuucaguuag

SEQ ID NO: 36656 - RNA, 18 nt, Artificial Sequence
  Description of Artificial Sequence: Synthetic oligonucleotide
cgggaagcaggaacuuca

SEQ ID NO: 36657 - RNA, 18 nt, Artificial Sequence
  Description of Artificial Sequence: Synthetic oligonucleotide
aaauucgggaagcaggaa

SEQ ID NO: 36658 - RNA, 18 nt, Artificial Sequence
  Description of Artificial Sequence: Synthetic oligonucleotide
cuucaaaauucgggaagc

SEQ ID NO: 36659 - RNA, 18 nt, Artificial Sequence
  Description of Artificial Sequence: Synthetic oligonucleotide
cucuccuucaaaauucgg

SEQ ID NO: 36660 - RNA, 18 nt, Artificial Sequence
  Description of Artificial Sequence: Synthetic oligonucleotide
augggcucuccuucaaaa

SEQ ID NO: 36661 - RNA, 18 nt, Artificial Sequence
  Description of Artificial Sequence: Synthetic oligonucleotide
gccagaugggcucuccuu

SEQ ID NO: 36662 - RNA, 18 nt, Artificial Sequence
  Description of Artificial Sequence: Synthetic oligonucleotide
agauagccagaugggcuc

SEQ ID NO: 36663 - RNA, 18 nt, Artificial Sequence
  Description of Artificial Sequence: Synthetic oligonucleotide
uccugagauagccagaug

SEQ ID NO: 36664 - RNA, 18 nt, Artificial Sequence
  Description of Artificial Sequence: Synthetic oligonucleotide
uccacuccugagauagcc

SEQ ID NO: 36665 - RNA, 18 nt, Artificial Sequence
  Description of Artificial Sequence: Synthetic oligonucleotide
cccucuccacuccugaga

SEQ ID NO: 36666 - RNA, 18 nt, Artificial Sequence
  Description of Artificial Sequence: Synthetic oligonucleotide
ugucucccucuccacucc

SEQ ID NO: 36667 - RNA, 18 nt, Artificial Sequence
  Description of Artificial Sequence: Synthetic oligonucleotide
agggaagaaacuuaacuu

SEQ ID NO: 36668 - RNA, 18 nt, Artificial Sequence
  Description of Artificial Sequence: Synthetic oligonucleotide
acaaaagggaagaaacuu

SEQ ID NO: 36669 - RNA, 18 nt, Artificial Sequence
  Description of Artificial Sequence: Synthetic oligonucleotide
ugggcacaaaagggaaga

SEQ ID NO: 36670 - RNA, 18 nt, Artificial Sequence
  Description of Artificial Sequence: Synthetic oligonucleotide
ccacgugggcacaaaagg

SEQ ID NO: 36671 - RNA, 18 nt, Artificial Sequence
  Description of Artificial Sequence: Synthetic oligonucleotide
aaagaccacgugggcaca

SEQ ID NO: 36672 - RNA, 18 nt, Artificial Sequence
  Description of Artificial Sequence: Synthetic oligonucleotide
ugaauaaagaccacgugg

SEQ ID NO: 36673 - RNA, 18 nt, Artificial Sequence
  Description of Artificial Sequence: Synthetic oligonucleotide
agacaugaauaaagacca

SEQ ID NO: 36674 - RNA, 18 nt, Artificial Sequence
  Description of Artificial Sequence: Synthetic oligonucleotide
gcacuagacaugaauaaa

SEQ ID NO: 36675 - RNA, 18 nt, Artificial Sequence
  Description of Artificial Sequence: Synthetic oligonucleotide
acacagcacuagacauga

SEQ ID NO: 36676 - RNA, 18 nt, Artificial Sequence
  Description of Artificial Sequence: Synthetic oligonucleotide
ucugaacacagcacuaga

SEQ ID NO: 36677 - RNA, 18 nt, Artificial Sequence
  Description of Artificial Sequence: Synthetic oligonucleotide
gauucucugaacacagca

SEQ ID NO: 36678 - RNA, 18 nt, Artificial Sequence
  Description of Artificial Sequence: Synthetic oligonucleotide
auacugauucucugaaca

SEQ ID NO: 36679 - RNA, 18 nt, Artificial Sequence
  Description of Artificial Sequence: Synthetic oligonucleotide
acccuauacugauucucu

SEQ ID NO: 36680 - RNA, 18 nt, Artificial Sequence
  Description of Artificial Sequence: Synthetic oligonucleotide
cauuuacccuauacugau

SEQ ID NO: 36681 - RNA, 18 nt, Artificial Sequence
  Description of Artificial Sequence: Synthetic oligonucleotide
gugggcauuuacccuaua

SEQ ID NO: 36682 - RNA, 18 nt, Artificial Sequence
  Description of Artificial Sequence: Synthetic oligonucleotide
cuugggugggcauuuacc

SEQ ID NO: 36683 - RNA, 18 nt, Artificial Sequence
  Description of Artificial Sequence: Synthetic oligonucleotide
ucccccuugggugggcau

SEQ ID NO: 36684 - RNA, 18 nt, Artificial Sequence
  Description of Artificial Sequence: Synthetic oligonucleotide
uaauuucccccuugggug

SEQ ID NO: 36685 - RNA, 18 nt, Artificial Sequence
  Description of Artificial Sequence: Synthetic oligonucleotide
gaaguuaauuucccccuu

SEQ ID NO: 36686 - RNA, 18 nt, Artificial Sequence
  Description of Artificial Sequence: Synthetic oligonucleotide
ccagggaaguuaauuucc

SEQ ID NO: 36687 - RNA, 18 nt, Artificial Sequence
  Description of Artificial Sequence: Synthetic oligonucleotide
ugcucccagggaaguuaa

SEQ ID NO: 36688 - RNA, 18 nt, Artificial Sequence
  Description of Artificial Sequence: Synthetic oligonucleotide
cccucugcucccagggaa

SEQ ID NO: 36689 - RNA, 18 nt, Artificial Sequence
  Description of Artificial Sequence: Synthetic oligonucleotide
ccccucccucugcuccca

SEQ ID NO: 36690 - RNA, 18 nt, Artificial Sequence
  Description of Artificial Sequence: Synthetic oligonucleotide
cuccuccccucccucugc

SEQ ID NO: 36691 - RNA, 18 nt, Artificial Sequence
  Description of Artificial Sequence: Synthetic oligonucleotide
cucuucuccuccccuccc

SEQ ID NO: 36692 - RNA, 18 nt, Artificial Sequence
  Description of Artificial Sequence: Synthetic oligonucleotide
uguuccucuucuccuccc

SEQ ID NO: 36693 - RNA, 18 nt, Artificial Sequence
  Description of Artificial Sequence: Synthetic oligonucleotide
aguucuguuccucuucuc

SEQ ID NO: 36694 - RNA, 18 nt, Artificial Sequence
  Description of Artificial Sequence: Synthetic oligonucleotide
gagagaguucuguuccuc

SEQ ID NO: 36695 - RNA, 18 nt, Artificial Sequence
  Description of Artificial Sequence: Synthetic oligonucleotide
agagagagagaguucugu

SEQ ID NO: 36696 - RNA, 18 nt, Artificial Sequence
  Description of Artificial Sequence: Synthetic oligonucleotide
cagagagagagagagagu

SEQ ID NO: 36697 - RNA, 18 nt, Artificial Sequence
  Description of Artificial Sequence: Synthetic oligonucleotide
gggaacagagagagagag

SEQ ID NO: 36698 - RNA, 18 nt, Artificial Sequence
  Description of Artificial Sequence: Synthetic oligonucleotide
gacaagggaacagagaga

SEQ ID NO: 36699 - RNA, 18 nt, Artificial Sequence
  Description of Artificial Sequence: Synthetic oligonucleotide
gcucugacaagggaacag

SEQ ID NO: 36700 - RNA, 18 nt, Artificial Sequence
  Description of Artificial Sequence: Synthetic oligonucleotide
gaccugcucugacaaggg

SEQ ID NO: 36701 - RNA, 18 nt, Artificial Sequence
  Description of Artificial Sequence: Synthetic oligonucleotide
cugcagaccugcucugac

SEQ ID NO: 36702 - RNA, 18 nt, Artificial Sequence
  Description of Artificial Sequence: Synthetic oligonucleotide
gacuccugcagaccugcu

SEQ ID NO: 36703 - RNA, 18 nt, Artificial Sequence
  Description of Artificial Sequence: Synthetic oligonucleotide
aggcugacuccugcagac

SEQ ID NO: 36704 - RNA, 18 nt, Artificial Sequence
  Description of Artificial Sequence: Synthetic oligonucleotide
gggaaaggcugacuccug

SEQ ID NO: 36705 - RNA, 18 nt, Artificial Sequence
  Description of Artificial Sequence: Synthetic oligonucleotide
uguuagggaaaggcugac

SEQ ID NO: 36706 - RNA, 18 nt, Artificial Sequence
  Description of Artificial Sequence: Synthetic oligonucleotide
ggcuuuguuagggaaagg

SEQ ID NO: 36707 - RNA, 18 nt, Artificial Sequence
  Description of Artificial Sequence: Synthetic oligonucleotide
uagagggcuuuguuaggg

SEQ ID NO: 36708 - RNA, 18 nt, Artificial Sequence
  Description of Artificial Sequence: Synthetic oligonucleotide
uaggauagagggcuuugu

SEQ ID NO: 36709 - RNA, 18 nt, Artificial Sequence
  Description of Artificial Sequence: Synthetic oligonucleotide
ggugauaggauagagggc

SEQ ID NO: 36710 - RNA, 18 nt, Artificial Sequence
  Description of Artificial Sequence: Synthetic oligonucleotide
gugugggugauaggauag

SEQ ID NO: 36711 - RNA, 18 nt, Artificial Sequence
  Description of Artificial Sequence: Synthetic oligonucleotide
cccaagugugggugauag

SEQ ID NO: 36712 - RNA, 18 nt, Artificial Sequence
  Description of Artificial Sequence: Synthetic oligonucleotide
agccucccaagugugggu

SEQ ID NO: 36713 - RNA, 18 nt, Artificial Sequence
  Description of Artificial Sequence: Synthetic oligonucleotide
agcccagccucccaagug

SEQ ID NO: 36714 - RNA, 18 nt, Artificial Sequence
  Description of Artificial Sequence: Synthetic oligonucleotide
agcccagcccagccuccc

SEQ ID NO: 36715 - RNA, 18 nt, Artificial Sequence
  Description of Artificial Sequence: Synthetic oligonucleotide
ugugcagcccagcccagc

SEQ ID NO: 36716 - RNA, 18 nt, Artificial Sequence
  Description of Artificial Sequence: Synthetic oligonucleotide
ugcccugugcagcccagc

SEQ ID NO: 36717 - RNA, 18 nt, Artificial Sequence
  Description of Artificial Sequence: Synthetic oligonucleotide
caucuugcccugugcagc

SEQ ID NO: 36718 - RNA, 18 nt, Artificial Sequence
  Description of Artificial Sequence: Synthetic oligonucleotide
ucucucaucuugcccugu

SEQ ID NO: 36719 - RNA, 18 nt, Artificial Sequence
  Description of Artificial Sequence: Synthetic oligonucleotide
acacaucucucaucuugc

SEQ ID NO: 36720 - RNA, 18 nt, Artificial Sequence
  Description of Artificial Sequence: Synthetic oligonucleotide
aaucaacacaucucucau

SEQ ID NO: 36721 - RNA, 18 nt, Artificial Sequence
  Description of Artificial Sequence: Synthetic oligonucleotide
gaugaaaucaacacaucu

SEQ ID NO: 36722 - RNA, 18 nt, Artificial Sequence
  Description of Artificial Sequence: Synthetic oligonucleotide
aaguggaugaaaucaaca

SEQ ID NO: 36723 - RNA, 18 nt, Artificial Sequence
  Description of Artificial Sequence: Synthetic oligonucleotide
caaucaaguggaugaaau

SEQ ID NO: 36724 - RNA, 18 nt, Artificial Sequence
  Description of Artificial Sequence: Synthetic oligonucleotide
caugacaaucaaguggau

SEQ ID NO: 36725 - RNA, 18 nt, Artificial Sequence
  Description of Artificial Sequence: Synthetic oligonucleotide
uucuacaugacaaucaag

SEQ ID NO: 36726 - RNA, 18 nt, Artificial Sequence
  Description of Artificial Sequence: Synthetic oligonucleotide
ucuaauucuacaugacaa

SEQ ID NO: 36727 - RNA, 18 nt, Artificial Sequence
  Description of Artificial Sequence: Synthetic oligonucleotide
guauaucuaauucuacau

SEQ ID NO: 36728 - RNA, 18 nt, Artificial Sequence
  Description of Artificial Sequence: Synthetic oligonucleotide
cucaaguauaucuaauuc

SEQ ID NO: 36729 - RNA, 18 nt, Artificial Sequence
  Description of Artificial Sequence: Synthetic oligonucleotide
aacuucucaaguauaucu

SEQ ID NO: 36730 - RNA, 18 nt, Artificial Sequence
  Description of Artificial Sequence: Synthetic oligonucleotide
aauguaacuucucaagua

SEQ ID NO: 36731 - RNA, 18 nt, Artificial Sequence
  Description of Artificial Sequence: Synthetic oligonucleotide
ugaaaaauguaacuucuc

SEQ ID NO: 36732 - RNA, 18 nt, Artificial Sequence
  Description of Artificial Sequence: Synthetic oligonucleotide
gcuacugaaaaauguaac

SEQ ID NO: 36733 - RNA, 18 nt, Artificial Sequence
  Description of Artificial Sequence: Synthetic oligonucleotide
aaggcgcuacugaaaaau

SEQ ID NO: 36734 - RNA, 18 nt, Artificial Sequence
  Description of Artificial Sequence: Synthetic oligonucleotide
auaugaaggcgcuacuga

SEQ ID NO: 36735 - RNA, 18 nt, Artificial Sequence
  Description of Artificial Sequence: Synthetic oligonucleotide
uaaagauaugaaggcgcu

SEQ ID NO: 36736 - RNA, 18 nt, Artificial Sequence
  Description of Artificial Sequence: Synthetic oligonucleotide
uaaaauaaagauaugaag

SEQ ID NO: 36737 - RNA, 18 nt, Artificial Sequence
  Description of Artificial Sequence: Synthetic oligonucleotide
gucccuaaaauaaagaua

SEQ ID NO: 36738 - RNA, 18 nt, Artificial Sequence
  Description of Artificial Sequence: Synthetic oligonucleotide
uaccugucccuaaaauaa

SEQ ID NO: 36739 - RNA, 18 nt, Artificial Sequence
  Description of Artificial Sequence: Synthetic oligonucleotide
guguauaccugucccuaa

SEQ ID NO: 36740 - RNA, 18 nt, Artificial Sequence
  Description of Artificial Sequence: Synthetic oligonucleotide
gcuugguguauaccuguc

SEQ ID NO: 36741 - RNA, 18 nt, Artificial Sequence
  Description of Artificial Sequence: Synthetic oligonucleotide
auggugcuugguguauac

SEQ ID NO: 36742 - RNA, 18 nt, Artificial Sequence
  Description of Artificial Sequence: Synthetic oligonucleotide
cugagauggugcuuggug

SEQ ID NO: 36743 - RNA, 18 nt, Artificial Sequence
  Description of Artificial Sequence: Synthetic oligonucleotide
uguggcugagauggugcu

SEQ ID NO: 36744 - RNA, 18 nt, Artificial Sequence
  Description of Artificial Sequence: Synthetic oligonucleotide
cagauuguggcugagaug

SEQ ID NO: 36745 - RNA, 18 nt, Artificial Sequence
  Description of Artificial Sequence: Synthetic oligonucleotide
aguaacagauuguggcug

SEQ ID NO: 36746 - RNA, 18 nt, Artificial Sequence
  Description of Artificial Sequence: Synthetic oligonucleotide
cuguuaguaacagauugu

SEQ ID NO: 36747 - RNA, 18 nt, Artificial Sequence
  Description of Artificial Sequence: Synthetic oligonucleotide
acauacuguuaguaacag

SEQ ID NO: 36748 - RNA, 18 nt, Artificial Sequence
  Description of Artificial Sequence: Synthetic oligonucleotide
agaaaacauacuguuagu

SEQ ID NO: 36749 - RNA, 18 nt, Artificial Sequence
  Description of Artificial Sequence: Synthetic oligonucleotide
aguucagaaaacauacug

SEQ ID NO: 36750 - RNA, 18 nt, Artificial Sequence
  Description of Artificial Sequence: Synthetic oligonucleotide
gccaaaguucagaaaaca

SEQ ID NO: 36751 - RNA, 18 nt, Artificial Sequence
  Description of Artificial Sequence: Synthetic oligonucleotide
aaguggccaaaguucaga

SEQ ID NO: 36752 - RNA, 18 nt, Artificial Sequence
  Description of Artificial Sequence: Synthetic oligonucleotide
uuccuaaguggccaaagu

SEQ ID NO: 36753 - RNA, 18 nt, Artificial Sequence
  Description of Artificial Sequence: Synthetic oligonucleotide
uacuuuuccuaaguggcc

SEQ ID NO: 36754 - RNA, 18 nt, Artificial Sequence
  Description of Artificial Sequence: Synthetic oligonucleotide
aacuguacuuuuccuaag

SEQ ID NO: 36755 - RNA, 18 nt, Artificial Sequence
  Description of Artificial Sequence: Synthetic oligonucleotide
agccaaacuguacuuuuc

SEQ ID NO: 36756 - RNA, 18 nt, Artificial Sequence
  Description of Artificial Sequence: Synthetic oligonucleotide
gagagagccaaacuguac

SEQ ID NO: 36757 - RNA, 18 nt, Artificial Sequence
  Description of Artificial Sequence: Synthetic oligonucleotide
cuuuggagagagccaaac

SEQ ID NO: 36758 - RNA, 18 nt, Artificial Sequence
  Description of Artificial Sequence: Synthetic oligonucleotide
gaacacuuuggagagagc

SEQ ID NO: 36759 - RNA, 18 nt, Artificial Sequence
  Description of Artificial Sequence: Synthetic oligonucleotide
ucagggaacacuuuggag

SEQ ID NO: 36760 - RNA, 18 nt, Artificial Sequence
  Description of Artificial Sequence: Synthetic oligonucleotide
gacuuucagggaacacuu

SEQ ID NO: 36761 - RNA, 18 nt, Artificial Sequence
  Description of Artificial Sequence: Synthetic oligonucleotide
aguuggacuuucagggaa

SEQ ID NO: 36762 - RNA, 18 nt, Artificial Sequence
  Description of Artificial Sequence: Synthetic oligonucleotide
cauaaaguuggacuuuca

SEQ ID NO: 36763 - RNA, 18 nt, Artificial Sequence
  Description of Artificial Sequence: Synthetic oligonucleotide
uuagucauaaaguuggac

SEQ ID NO: 36764 - RNA, 18 nt, Artificial Sequence
  Description of Artificial Sequence: Synthetic oligonucleotide
caguauuagucauaaagu

SEQ ID NO: 36765 - RNA, 18 nt, Artificial Sequence
  Description of Artificial Sequence: Synthetic oligonucleotide
aaucacaguauuagucau

SEQ ID NO: 36766 - RNA, 18 nt, Artificial Sequence
  Description of Artificial Sequence: Synthetic oligonucleotide
uguucauuguauuacuua

SEQ ID NO: 36767 - RNA, 18 nt, Artificial Sequence
  Description of Artificial Sequence: Synthetic oligonucleotide
auggguguucauuguauu

SEQ ID NO: 36768 - RNA, 18 nt, Artificial Sequence
  Description of Artificial Sequence: Synthetic oligonucleotide
gacccauggguguucauu

SEQ ID NO: 36769 - RNA, 18 nt, Artificial Sequence
  Description of Artificial Sequence: Synthetic oligonucleotide
gcagggacccaugggugu

SEQ ID NO: 36770 - RNA, 18 nt, Artificial Sequence
  Description of Artificial Sequence: Synthetic oligonucleotide
gcugggcagggacccaug

SEQ ID NO: 36771 - RNA, 18 nt, Artificial Sequence
  Description of Artificial Sequence: Synthetic oligonucleotide
cuuaagcugggcagggac

SEQ ID NO: 36772 - RNA, 18 nt, Artificial Sequence
  Description of Artificial Sequence: Synthetic oligonucleotide
uucuacuuaagcugggca

SEQ ID NO: 36773 - RNA, 18 nt, Artificial Sequence
  Description of Artificial Sequence: Synthetic oligonucleotide
uaauauucuacuuaagcu

SEQ ID NO: 36774 - RNA, 18 nt, Artificial Sequence
  Description of Artificial Sequence: Synthetic oligonucleotide
auuuguaauauucuacuu

SEQ ID NO: 36775 - RNA, 18 nt, Artificial Sequence
  Description of Artificial Sequence: Synthetic oligonucleotide
acugcauuuguaauauuc

SEQ ID NO: 36776 - RNA, 18 nt, Artificial Sequence
  Description of Artificial Sequence: Synthetic oligonucleotide
cuucaacugcauuuguaa

SEQ ID NO: 36777 - RNA, 18 nt, Artificial Sequence
  Description of Artificial Sequence: Synthetic oligonucleotide
gagggcuucaacugcauu

SEQ ID NO: 36778 - RNA, 18 nt, Artificial Sequence
  Description of Artificial Sequence: Synthetic oligonucleotide
gcacagagggcuucaacu

SEQ ID NO: 36779 - RNA, 18 nt, Artificial Sequence
  Description of Artificial Sequence: Synthetic oligonucleotide
aaguugcacagagggcuu

SEQ ID NO: 36780 - RNA, 18 nt, Artificial Sequence
  Description of Artificial Sequence: Synthetic oligonucleotide
gaugaaaguugcacagag

SEQ ID NO: 36781 - RNA, 18 nt, Artificial Sequence
  Description of Artificial Sequence: Synthetic oligonucleotide
guaaggaugaaaguugca

SEQ ID NO: 36782 - RNA, 18 nt, Artificial Sequence
  Description of Artificial Sequence: Synthetic oligonucleotide
caguuguaaggaugaaag

SEQ ID NO: 36783 - RNA, 18 nt, Artificial Sequence
  Description of Artificial Sequence: Synthetic oligonucleotide
aguaucaguuguaaggau

SEQ ID NO: 36784 - RNA, 18 nt, Artificial Sequence
  Description of Artificial Sequence: Synthetic oligonucleotide
cacucaguaucaguugua

SEQ ID NO: 36785 - RNA, 18 nt, Artificial Sequence
  Description of Artificial Sequence: Synthetic oligonucleotide
caauucacucaguaucag

SEQ ID NO: 36786 - RNA, 18 nt, Artificial Sequence
  Description of Artificial Sequence: Synthetic oligonucleotide
aaguacaauucacucagu

SEQ ID NO: 36787 - RNA, 18 nt, Artificial Sequence
  Description of Artificial Sequence: Synthetic oligonucleotide
auuuaaaguacaauucac

SEQ ID NO: 36788 - RNA, 18 nt, Artificial Sequence
  Description of Artificial Sequence: Synthetic oligonucleotide
aaaauauuuaaaguacaa

SEQ ID NO: 36789 - RNA, 18 nt, Artificial Sequence
  Description of Artificial Sequence: Synthetic oligonucleotide
gcuauaaaauauuuaaag

SEQ ID NO: 36790 - RNA, 18 nt, Artificial Sequence
  Description of Artificial Sequence: Synthetic oligonucleotide
ugggagcuauaaaauauu

SEQ ID NO: 36791 - RNA, 18 nt, Artificial Sequence
  Description of Artificial Sequence: Synthetic oligonucleotide
gggagugggagcuauaaa

SEQ ID NO: 36792 - RNA, 18 nt, Artificial Sequence
  Description of Artificial Sequence: Synthetic oligonucleotide
ugcaugggagugggagcu

SEQ ID NO: 36793 - RNA, 18 nt, Artificial Sequence
  Description of Artificial Sequence: Synthetic oligonucleotide
gggcaugcaugggagugg

SEQ ID NO: 36794 - RNA, 18 nt, Artificial Sequence
  Description of Artificial Sequence: Synthetic oligonucleotide
uauugcuaucacugaggg

SEQ ID NO: 36795 - RNA, 18 nt, Artificial Sequence
  Description of Artificial Sequence: Synthetic oligonucleotide
aauuauugcuaucacuga

SEQ ID NO: 36796 - RNA, 18 nt, Artificial Sequence
  Description of Artificial Sequence: Synthetic oligonucleotide
uugacaauuauugcuauc

SEQ ID NO: 36797 - RNA, 18 nt, Artificial Sequence
  Description of Artificial Sequence: Synthetic oligonucleotide
uguuauugacaauuauug

SEQ ID NO: 36798 - RNA, 18 nt, Artificial Sequence
  Description of Artificial Sequence: Synthetic oligonucleotide
uuucauguuauugacaau

SEQ ID NO: 36799 - RNA, 18 nt, Artificial Sequence
  Description of Artificial Sequence: Synthetic oligonucleotide
cuguguuucauguuauug

SEQ ID NO: 36800 - RNA, 18 nt, Artificial Sequence
  Description of Artificial Sequence: Synthetic oligonucleotide
ucaaucuguguuucaugu

SEQ ID NO: 36801 - RNA, 18 nt, Artificial Sequence
  Description of Artificial Sequence: Synthetic oligonucleotide
uaugaucaaucuguguuu

SEQ ID NO: 36802 - RNA, 18 nt, Artificial Sequence
  Description of Artificial Sequence: Synthetic oligonucleotide
ugcuauaugaucaaucug

SEQ ID NO: 36803 - RNA, 18 nt, Artificial Sequence
  Description of Artificial Sequence: Synthetic oligonucleotide
guaaaugcuauaugauca

SEQ ID NO: 36804 - RNA, 18 nt, Artificial Sequence
  Description of Artificial Sequence: Synthetic oligonucleotide
auaugguaaaugcuauau

SEQ ID NO: 36805 - RNA, 18 nt, Artificial Sequence
  Description of Artificial Sequence: Synthetic oligonucleotide
uaaauauaugguaaaugc

SEQ ID NO: 36806 - RNA, 18 nt, Artificial Sequence
  Description of Artificial Sequence: Synthetic oligonucleotide
uagaguaaauauauggua

SEQ ID NO: 36807 - RNA, 18 nt, Artificial Sequence
  Description of Artificial Sequence: Synthetic oligonucleotide
ugguauagaguaaauaua

SEQ ID NO: 36808 - RNA, 18 nt, Artificial Sequence
  Description of Artificial Sequence: Synthetic oligonucleotide
gugcuugguauagaguaa

SEQ ID NO: 36809 - RNA, 18 nt, Artificial Sequence
  Description of Artificial Sequence: Synthetic oligonucleotide
guuaagugcuugguauag

SEQ ID NO: 36810 - RNA, 18 nt, Artificial Sequence
  Description of Artificial Sequence: Synthetic oligonucleotide
uauauguuaagugcuugg

SEQ ID NO: 36811 - RNA, 18 nt, Artificial Sequence
  Description of Artificial Sequence: Synthetic oligonucleotide
aauuauauauguuaagug

SEQ ID NO: 36812 - RNA, 18 nt, Artificial Sequence
  Description of Artificial Sequence: Synthetic oligonucleotide
aauguaauuauauauguu

SEQ ID NO: 36813 - RNA, 18 nt, Artificial Sequence
  Description of Artificial Sequence: Synthetic oligonucleotide
uuuuaaauguaauuauau

SEQ ID NO: 36814 - RNA, 18 nt, Artificial Sequence
  Description of Artificial Sequence: Synthetic oligonucleotide
guaaauuuuaaauguaau

SEQ ID NO: 36815 - RNA, 18 nt, Artificial Sequence
  Description of Artificial Sequence: Synthetic oligonucleotide
cuguuguaaauuuuaaau

SEQ ID NO: 36816 - RNA, 18 nt, Artificial Sequence
  Description of Artificial Sequence: Synthetic oligonucleotide
uagggcuguuguaaauuu

SEQ ID NO: 36817 - RNA, 18 nt, Artificial Sequence
  Description of Artificial Sequence: Synthetic oligonucleotide
gguaguagggcuguugua

SEQ ID NO: 36818 - RNA, 18 nt, Artificial Sequence
  Description of Artificial Sequence: Synthetic oligonucleotide
uuuuggguaguagggcug

SEQ ID NO: 36819 - RNA, 18 nt, Artificial Sequence
  Description of Artificial Sequence: Synthetic oligonucleotide
uaguguuuuggguaguag

SEQ ID NO: 36820 - RNA, 18 nt, Artificial Sequence
  Description of Artificial Sequence: Synthetic oligonucleotide
acuaauaguguuuugggu

SEQ ID NO: 36821 - RNA, 18 nt, Artificial Sequence
  Description of Artificial Sequence: Synthetic oligonucleotide
gggauacuaauaguguuu

SEQ ID NO: 36822 - RNA, 18 nt, Artificial Sequence
  Description of Artificial Sequence: Synthetic oligonucleotide
aucgcauuuguaaaaggg

SEQ ID NO: 36823 - RNA, 18 nt, Artificial Sequence
  Description of Artificial Sequence: Synthetic oligonucleotide
uuaucgcauuuguaaaag

SEQ ID NO: 36824 - RNA, 18 nt, Artificial Sequence
  Description of Artificial Sequence: Synthetic oligonucleotide
cucaguuaucgcauuugu

SEQ ID NO: 36825 - RNA, 18 nt, Artificial Sequence
  Description of Artificial Sequence: Synthetic oligonucleotide
uacgccucaguuaucgca

SEQ ID NO: 36826 - RNA, 18 nt, Artificial Sequence
  Description of Artificial Sequence: Synthetic oligonucleotide
cucucuacgccucaguua

SEQ ID NO: 36827 - RNA, 18 nt, Artificial Sequence
  Description of Artificial Sequence: Synthetic oligonucleotide
cuuagcucucuacgccuc

SEQ ID NO: 36828 - RNA, 18 nt, Artificial Sequence
  Description of Artificial Sequence: Synthetic oligonucleotide
aguuacuuagcucucuac

SEQ ID NO: 36829 - RNA, 18 nt, Artificial Sequence
  Description of Artificial Sequence: Synthetic oligonucleotide
caguaaguuacuuagcuc

SEQ ID NO: 36830 - RNA, 18 nt, Artificial Sequence
  Description of Artificial Sequence: Synthetic oligonucleotide
acuuucaguaaguuacuu

SEQ ID NO: 36831 - RNA, 18 nt, Artificial Sequence
  Description of Artificial Sequence: Synthetic oligonucleotide
gugugacuuucaguaagu

SEQ ID NO: 36832 - RNA, 18 nt, Artificial Sequence
  Description of Artificial Sequence: Synthetic oligonucleotide
uggcugugugacuuucag

SEQ ID NO: 36833 - RNA, 18 nt, Artificial Sequence
  Description of Artificial Sequence: Synthetic oligonucleotide
cccgcuggcugugugacu

SEQ ID NO: 36834 - RNA, 18 nt, Artificial Sequence
  Description of Artificial Sequence: Synthetic oligonucleotide
uaccacccgcuggcugug

SEQ ID NO: 36835 - RNA, 18 nt, Artificial Sequence
  Description of Artificial Sequence: Synthetic oligonucleotide
ggcucuaccacccgcugg

SEQ ID NO: 36836 - RNA, 18 nt, Artificial Sequence
  Description of Artificial Sequence: Synthetic oligonucleotide
agcuaggcucuaccaccc

SEQ ID NO: 36837 - RNA, 18 nt, Artificial Sequence
  Description of Artificial Sequence: Synthetic oligonucleotide
uuuaaagcuaggcucuac

SEQ ID NO: 36838 - RNA, 18 nt, Artificial Sequence
  Description of Artificial Sequence: Synthetic oligonucleotide
cuggguuuaaagcuaggc

SEQ ID NO: 36839 - RNA, 18 nt, Artificial Sequence
  Description of Artificial Sequence: Synthetic oligonucleotide
aucgucuggguuuaaagc

SEQ ID NO: 36840 - RNA, 18 nt, Artificial Sequence
  Description of Artificial Sequence: Synthetic oligonucleotide
gacaaaucgucuggguuu

SEQ ID NO: 36841 - RNA, 18 nt, Artificial Sequence
  Description of Artificial Sequence: Synthetic oligonucleotide
cuggagacaaaucgucug

SEQ ID NO: 36842 - RNA, 18 nt, Artificial Sequence
  Description of Artificial Sequence: Synthetic oligonucleotide
cagcccuggagacaaauc

SEQ ID NO: 36843 - RNA, 18 nt, Artificial Sequence
  Description of Artificial Sequence: Synthetic oligonucleotide
ugugacagcccuggagac

SEQ ID NO: 36844 - RNA, 18 nt, Artificial Sequence
  Description of Artificial Sequence: Synthetic oligonucleotide
guagaugugacagcccug

SEQ ID NO: 36845 - RNA, 18 nt, Artificial Sequence
  Description of Artificial Sequence: Synthetic oligonucleotide
agccaguagaugugacag

SEQ ID NO: 36846 - RNA, 18 nt, Artificial Sequence
  Description of Artificial Sequence: Synthetic oligonucleotide
ggcagagccaguagaugu

SEQ ID NO: 36847 - RNA, 18 nt, Artificial Sequence
  Description of Artificial Sequence: Synthetic oligonucleotide
agcuuggcagagccagua

SEQ ID NO: 36848 - RNA, 18 nt, Artificial Sequence
  Description of Artificial Sequence: Synthetic oligonucleotide
gcggaagcuuggcagagc

SEQ ID NO: 36849 - RNA, 18 nt, Artificial Sequence
  Description of Artificial Sequence: Synthetic oligonucleotide
aucaugcggaagcuuggc

SEQ ID NO: 36850 - RNA, 18 nt, Artificial Sequence
  Description of Artificial Sequence: Synthetic oligonucleotide
caaugaucaugcggaagc

SEQ ID NO: 36851 - RNA, 18 nt, Artificial Sequence
  Description of Artificial Sequence: Synthetic oligonucleotide
acagacaaugaucaugcg

SEQ ID NO: 36852 - RNA, 18 nt, Artificial Sequence
  Description of Artificial Sequence: Synthetic oligonucleotide
caaacacagacaaugauc

SEQ ID NO: 36853 - RNA, 18 nt, Artificial Sequence
  Description of Artificial Sequence: Synthetic oligonucleotide
cuuuccaaacacagacaa

SEQ ID NO: 36854 - RNA, 18 nt, Artificial Sequence
  Description of Artificial Sequence: Synthetic oligonucleotide
auaaucuuuccaaacaca

SEQ ID NO: 36855 - RNA, 18 nt, Artificial Sequence
  Description of Artificial Sequence: Synthetic oligonucleotide
aauccauaaucuuuccaa

SEQ ID NO: 36856 - RNA, 18 nt, Artificial Sequence
  Description of Artificial Sequence: Synthetic oligonucleotide
cacuuaauccauaaucuu

SEQ ID NO: 36857 - RNA, 18 nt, Artificial Sequence
  Description of Artificial Sequence: Synthetic oligonucleotide
agcaccacuuaauccaua

SEQ ID NO: 36858 - RNA, 18 nt, Artificial Sequence
  Description of Artificial Sequence: Synthetic oligonucleotide
aacgaagcaccacuuaau

SEQ ID NO: 36859 - RNA, 18 nt, Artificial Sequence
  Description of Artificial Sequence: Synthetic oligonucleotide
aagaaaacgaagcaccac

SEQ ID NO: 36860 - RNA, 18 nt, Artificial Sequence
  Description of Artificial Sequence: Synthetic oligonucleotide
caaacuaguucuccacau

SEQ ID NO: 36861 - RNA, 18 nt, Artificial Sequence
  Description of Artificial Sequence: Synthetic oligonucleotide
cuacccaaacuaguucuc

SEQ ID NO: 36862 - RNA, 18 nt, Artificial Sequence
  Description of Artificial Sequence: Synthetic oligonucleotide
cucuccuacccaaacuag

SEQ ID NO: 36863 - RNA, 18 nt, Artificial Sequence
  Description of Artificial Sequence: Synthetic oligonucleotide
agaggcucuccuacccaa

SEQ ID NO: 36864 - RNA, 18 nt, Artificial Sequence
  Description of Artificial Sequence: Synthetic oligonucleotide
gcgugagaggcucuccua

SEQ ID NO: 36865 - RNA, 18 nt, Artificial Sequence
  Description of Artificial Sequence: Synthetic oligonucleotide
ucucagcgugagaggcuc

SEQ ID NO: 36866 - RNA, 18 nt, Artificial Sequence
  Description of Artificial Sequence: Synthetic oligonucleotide
gcuguucucagcgugaga

SEQ ID NO: 36867 - RNA, 18 nt, Artificial Sequence
  Description of Artificial Sequence: Synthetic oligonucleotide
uuucugcuguucucagcg

SEQ ID NO: 36868 - RNA, 18 nt, Artificial Sequence
  Description of Artificial Sequence: Synthetic oligonucleotide
aauuguuucugcuguucu

SEQ ID NO: 36869 - RNA, 18 nt, Artificial Sequence
  Description of Artificial Sequence: Synthetic oligonucleotide
ccaguaauuguuucugcu

SEQ ID NO: 36870 - RNA, 18 nt, Artificial Sequence
  Description of Artificial Sequence: Synthetic oligonucleotide
acuugccaguaauuguuu

SEQ ID NO: 36871 - RNA, 18 nt, Artificial Sequence
  Description of Artificial Sequence: Synthetic oligonucleotide
accauacuugccaguaau

SEQ ID NO: 36872 - RNA, 18 nt, Artificial Sequence
  Description of Artificial Sequence: Synthetic oligonucleotide
cacacaccauacuugcca

SEQ ID NO: 36873 - RNA, 18 nt, Artificial Sequence
  Description of Artificial Sequence: Synthetic oligonucleotide
gcauccacacaccauacu

SEQ ID NO: 36874 - RNA, 18 nt, Artificial Sequence
  Description of Artificial Sequence: Synthetic oligonucleotide
gucucgcauccacacacc

SEQ ID NO: 36875 - RNA, 18 nt, Artificial Sequence
  Description of Artificial Sequence: Synthetic oligonucleotide
gggucucgcauccacaca

SEQ ID NO: 36876 - RNA, 18 nt, Artificial Sequence
  Description of Artificial Sequence: Synthetic oligonucleotide
ggucuccuggguguaggg

SEQ ID NO: 36877 - RNA, 18 nt, Artificial Sequence
  Description of Artificial Sequence: Synthetic oligonucleotide
cacguggucuccugggug

SEQ ID NO: 36878 - RNA, 18 nt, Artificial Sequence
  Description of Artificial Sequence: Synthetic oligonucleotide
uucuccacguggucuccu

SEQ ID NO: 36879 - RNA, 18 nt, Artificial Sequence
  Description of Artificial Sequence: Synthetic oligonucleotide
gucgauucuccacguggu

SEQ ID NO: 36880 - RNA, 18 nt, Artificial Sequence
  Description of Artificial Sequence: Synthetic oligonucleotide
acugugucgauucuccac

SEQ ID NO: 36881 - RNA, 18 nt, Artificial Sequence
  Description of Artificial Sequence: Synthetic oligonucleotide
ugccaacugugucgauuc

SEQ ID NO: 36882 - RNA, 18 nt, Artificial Sequence
  Description of Artificial Sequence: Synthetic oligonucleotide
auccgugccaacuguguc

SEQ ID NO: 36883 - RNA, 18 nt, Artificial Sequence
  Description of Artificial Sequence: Synthetic oligonucleotide
cggacauccgugccaacu

SEQ ID NO: 36884 - RNA, 18 nt, Artificial Sequence
  Description of Artificial Sequence: Synthetic oligonucleotide
ccuggcggacauccgugc

SEQ ID NO: 36885 - RNA, 18 nt, Artificial Sequence
  Description of Artificial Sequence: Synthetic oligonucleotide
aaaaaccuggcggacauc

SEQ ID NO: 36886 - RNA, 18 nt, Artificial Sequence
  Description of Artificial Sequence: Synthetic oligonucleotide
uacucaaaaaccuggcgg

SEQ ID NO: 36887 - RNA, 18 nt, Artificial Sequence
  Description of Artificial Sequence: Synthetic oligonucleotide
ggucauacucaaaaaccu

SEQ ID NO: 36888 - RNA, 18 nt, Artificial Sequence
  Description of Artificial Sequence: Synthetic oligonucleotide
gaugaggucauacucaaa

SEQ ID NO: 36889 - RNA, 18 nt, Artificial Sequence
  Description of Artificial Sequence: Synthetic oligonucleotide
uggcugaugaggucauac

SEQ ID NO: 36890 - RNA, 18 nt, Artificial Sequence
  Description of Artificial Sequence: Synthetic oligonucleotide
uaaacuggcugaugaggu

SEQ ID NO: 36891 - RNA, 18 nt, Artificial Sequence
  Description of Artificial Sequence: Synthetic oligonucleotide
cugcauaaacuggcugau

SEQ ID NO: 36892 - RNA, 18 nt, Artificial Sequence
  Description of Artificial Sequence: Synthetic oligonucleotide
uagcccugcauaaacugg

SEQ ID NO: 36893 - RNA, 18 nt, Artificial Sequence
  Description of Artificial Sequence: Synthetic oligonucleotide
aaggguagcccugcauaa

SEQ ID NO: 36894 - RNA, 18 nt, Artificial Sequence
  Description of Artificial Sequence: Synthetic oligonucleotide
cuuagaaggguagcccug

SEQ ID NO: 36895 - RNA, 18 nt, Artificial Sequence
  Description of Artificial Sequence: Synthetic oligonucleotide
ugaaccuuagaaggguag

SEQ ID NO: 36896 - RNA, 18 nt, Artificial Sequence
  Description of Artificial Sequence: Synthetic oligonucleotide
guaugugaaccuuagaag

SEQ ID NO: 36897 - RNA, 18 nt, Artificial Sequence
  Description of Artificial Sequence: Synthetic oligonucleotide
aggcaguaugugaaccuu

SEQ ID NO: 36898 - RNA, 18 nt, Artificial Sequence
  Description of Artificial Sequence: Synthetic oligonucleotide
ggccuaggcaguauguga

SEQ ID NO: 36899 - RNA, 18 nt, Artificial Sequence
  Description of Artificial Sequence: Synthetic oligonucleotide
ccaguggccuaggcagua

SEQ ID NO: 36900 - RNA, 18 nt, Artificial Sequence
  Description of Artificial Sequence: Synthetic oligonucleotide
gcuuuccaguggccuagg

SEQ ID NO: 36901 - RNA, 18 nt, Artificial Sequence
  Description of Artificial Sequence: Synthetic oligonucleotide
cccgugcuuuccaguggc

SEQ ID NO: 36902 - RNA, 18 nt, Artificial Sequence
  Description of Artificial Sequence: Synthetic oligonucleotide
cagcacccgugcuuucca

SEQ ID NO: 36903 - RNA, 18 nt, Artificial Sequence
  Description of Artificial Sequence: Synthetic oligonucleotide
caccacagcacccgugcu

SEQ ID NO: 36904 - RNA, 18 nt, Artificial Sequence
  Description of Artificial Sequence: Synthetic oligonucleotide
gaguacaccacagcaccc

SEQ ID NO: 36905 - RNA, 18 nt, Artificial Sequence
  Description of Artificial Sequence: Synthetic oligonucleotide
uccccgaguacaccacag

SEQ ID NO: 36906 - RNA, 18 nt, Artificial Sequence
  Description of Artificial Sequence: Synthetic oligonucleotide
gaggcuccccgaguacac

SEQ ID NO: 36907 - RNA, 18 nt, Artificial Sequence
  Description of Artificial Sequence: Synthetic oligonucleotide
aaauagaggcuccccgag

SEQ ID NO: 36908 - RNA, 18 nt, Artificial Sequence
  Description of Artificial Sequence: Synthetic oligonucleotide
ccuggaaauagaggcucc

SEQ ID NO: 36909 - RNA, 18 nt, Artificial Sequence
  Description of Artificial Sequence: Synthetic oligonucleotide
agcgcccuggaaauagag

SEQ ID NO: 36910 - RNA, 18 nt, Artificial Sequence
  Description of Artificial Sequence: Synthetic oligonucleotide
gacucagcgcccuggaaa

SEQ ID NO: 36911 - RNA, 18 nt, Artificial Sequence
  Description of Artificial Sequence: Synthetic oligonucleotide
uucuggacucagcgcccu

SEQ ID NO: 36912 - RNA, 18 nt, Artificial Sequence
  Description of Artificial Sequence: Synthetic oligonucleotide
gacaguucuggacucagc

SEQ ID NO: 36913 - RNA, 18 nt, Artificial Sequence
  Description of Artificial Sequence: Synthetic oligonucleotide
cuuaugacaguucuggac

SEQ ID NO: 36914 - RNA, 18 nt, Artificial Sequence
  Description of Artificial Sequence: Synthetic oligonucleotide
cauaucuuaugacaguuc

SEQ ID NO: 36915 - RNA, 18 nt, Artificial Sequence
  Description of Artificial Sequence: Synthetic oligonucleotide
cagcucauaucuuaugac

SEQ ID NO: 36916 - RNA, 18 nt, Artificial Sequence
  Description of Artificial Sequence: Synthetic oligonucleotide
guauucagcucauaucuu

SEQ ID NO: 36917 - RNA, 18 nt, Artificial Sequence
  Description of Artificial Sequence: Synthetic oligonucleotide
ucucgguauucagcucau

SEQ ID NO: 36918 - RNA, 18 nt, Artificial Sequence
  Description of Artificial Sequence: Synthetic oligonucleotide
cacugucucgguauucag

SEQ ID NO: 36919 - RNA, 18 nt, Artificial Sequence
  Description of Artificial Sequence: Synthetic oligonucleotide
gccuucacugucucggua

SEQ ID NO: 36920 - RNA, 18 nt, Artificial Sequence
  Description of Artificial Sequence: Synthetic oligonucleotide
ucucagccuucacugucu

SEQ ID NO: 36921 - RNA, 18 nt, Artificial Sequence
  Description of Artificial Sequence: Synthetic oligonucleotide
uuccuucucagccuucac

SEQ ID NO: 36922 - RNA, 18 nt, Artificial Sequence
  Description of Artificial Sequence: Synthetic oligonucleotide
gggauuuccuucucagcc

SEQ ID NO: 36923 - RNA, 18 nt, Artificial Sequence
  Description of Artificial Sequence: Synthetic oligonucleotide
cuccagggauuuccuucu

SEQ ID NO: 36924 - RNA, 18 nt, Artificial Sequence
  Description of Artificial Sequence: Synthetic oligonucleotide
gccagcuccagggauuuc

SEQ ID NO: 36925 - RNA, 18 nt, Artificial Sequence
  Description of Artificial Sequence: Synthetic oligonucleotide
ugguagccagcuccaggg

SEQ ID NO: 36926 - RNA, 18 nt, Artificial Sequence
  Description of Artificial Sequence: Synthetic oligonucleotide
guccgugguagccagcuc

SEQ ID NO: 36927 - RNA, 18 nt, Artificial Sequence
  Description of Artificial Sequence: Synthetic oligonucleotide
gaacuguccgugguagcc

SEQ ID NO: 36928 - RNA, 18 nt, Artificial Sequence
  Description of Artificial Sequence: Synthetic oligonucleotide
uacgggaacuguccgugg

SEQ ID NO: 36929 - RNA, 18 nt, Artificial Sequence
  Description of Artificial Sequence: Synthetic oligonucleotide
aagaauacgggaacuguc

SEQ ID NO: 36930 - RNA, 18 nt, Artificial Sequence
  Description of Artificial Sequence: Synthetic oligonucleotide
accccaagaauacgggaa

SEQ ID NO: 36931 - RNA, 18 nt, Artificial Sequence
  Description of Artificial Sequence: Synthetic oligonucleotide
uagccaccccaagaauac

SEQ ID NO: 36932 - RNA, 18 nt, Artificial Sequence
  Description of Artificial Sequence: Synthetic oligonucleotide
ccguguagccaccccaag

SEQ ID NO: 36933 - RNA, 18 nt, Artificial Sequence
  Description of Artificial Sequence: Synthetic oligonucleotide
aauguccguguagccacc

SEQ ID NO: 36934 - RNA, 18 nt, Artificial Sequence
  Description of Artificial Sequence: Synthetic oligonucleotide
aagucaauguccguguag

SEQ ID NO: 36935 - RNA, 18 nt, Artificial Sequence
  Description of Artificial Sequence: Synthetic oligonucleotide
cagccaagucaauguccg

SEQ ID NO: 36936 - RNA, 18 nt, Artificial Sequence
  Description of Artificial Sequence: Synthetic oligonucleotide
auccacagccaagucaau

SEQ ID NO: 36937 - RNA, 18 nt, Artificial Sequence
  Description of Artificial Sequence: Synthetic oligonucleotide
gcuucauccacagccaag

SEQ ID NO: 36938 - RNA, 18 nt, Artificial Sequence
  Description of Artificial Sequence: Synthetic oligonucleotide
ggccugcuucauccacag

SEQ ID NO: 36939 - RNA, 18 nt, Artificial Sequence
  Description of Artificial Sequence: Synthetic oligonucleotide
ccagaggccugcuucauc

SEQ ID NO: 36940 - RNA, 18 nt, Artificial Sequence
  Description of Artificial Sequence: Synthetic oligonucleotide
augacccagaggccugcu

SEQ ID NO: 36941 - RNA, 18 nt, Artificial Sequence
  Description of Artificial Sequence: Synthetic oligonucleotide
uguaaaugacccagaggc

SEQ ID NO: 36942 - RNA, 18 nt, Artificial Sequence
  Description of Artificial Sequence: Synthetic oligonucleotide
ggugcuguaaaugaccca

SEQ ID NO: 36943 - RNA, 18 nt, Artificial Sequence
  Description of Artificial Sequence: Synthetic oligonucleotide
ucaucggugcuguaaaug

SEQ ID NO: 36944 - RNA, 18 nt, Artificial Sequence
  Description of Artificial Sequence: Synthetic oligonucleotide
uggccucaucggugcugu

SEQ ID NO: 36945 - RNA, 18 nt, Artificial Sequence
  Description of Artificial Sequence: Synthetic oligonucleotide
accuuuggccucaucggu

SEQ ID NO: 36946 - RNA, 18 nt, Artificial Sequence
  Description of Artificial Sequence: Synthetic oligonucleotide
auggcaccuuuggccuca

SEQ ID NO: 36947 - RNA, 18 nt, Artificial Sequence
  Description of Artificial Sequence: Synthetic oligonucleotide
ggacaauggcaccuuugg

SEQ ID NO: 36948 - RNA, 18 nt, Artificial Sequence
  Description of Artificial Sequence: Synthetic oligonucleotide
ggagaggacaauggcacc

SEQ ID NO: 36949 - RNA, 18 nt, Artificial Sequence
  Description of Artificial Sequence: Synthetic oligonucleotide
aguuuggagaggacaaug

SEQ ID NO: 36950 - RNA, 18 nt, Artificial Sequence
  Description of Artificial Sequence: Synthetic oligonucleotide
gguucaguuuggagagga

SEQ ID NO: 36951 - RNA, 18 nt, Artificial Sequence
  Description of Artificial Sequence: Synthetic oligonucleotide
cucuggguucaguuugga

SEQ ID NO: 36952 - RNA, 18 nt, Artificial Sequence
  Description of Artificial Sequence: Synthetic oligonucleotide
agauucucuggguucagu

SEQ ID NO: 36953 - RNA, 18 nt, Artificial Sequence
  Description of Artificial Sequence: Synthetic oligonucleotide
guuccagauucucugggu

SEQ ID NO: 36954 - RNA, 18 nt, Artificial Sequence
  Description of Artificial Sequence: Synthetic oligonucleotide
uucgaguuccagauucuc

SEQ ID NO: 36955 - RNA, 18 nt, Artificial Sequence
  Description of Artificial Sequence: Synthetic oligonucleotide
guuuguucgaguuccaga

SEQ ID NO: 36956 - RNA, 18 nt, Artificial Sequence
  Description of Artificial Sequence: Synthetic oligonucleotide
cccagguuuguucgaguu

SEQ ID NO: 36957 - RNA, 18 nt, Artificial Sequence
  Description of Artificial Sequence: Synthetic oligonucleotide
ugucucccagguuuguuc

SEQ ID NO: 36958 - RNA, 18 nt, Artificial Sequence
  Description of Artificial Sequence: Synthetic oligonucleotide
auguuugucucccagguu

SEQ ID NO: 36959 - RNA, 18 nt, Artificial Sequence
  Description of Artificial Sequence: Synthetic oligonucleotide
uacggauguuugucuccc

SEQ ID NO: 36960 - RNA, 18 nt, Artificial Sequence
  Description of Artificial Sequence: Synthetic oligonucleotide
cugcuuacggauguuugu

SEQ ID NO: 36961 - RNA, 18 nt, Artificial Sequence
  Description of Artificial Sequence: Synthetic oligonucleotide
acugacugcuuacggaug

SEQ ID NO: 36962 - RNA, 18 nt, Artificial Sequence
  Description of Artificial Sequence: Synthetic oligonucleotide
uggcgacugacugcuuac

SEQ ID NO: 36963 - RNA, 18 nt, Artificial Sequence
  Description of Artificial Sequence: Synthetic oligonucleotide
ggcauuggcgacugacug

SEQ ID NO: 36964 - RNA, 18 nt, Artificial Sequence
  Description of Artificial Sequence: Synthetic oligonucleotide
augaaggcauuggcgacu

SEQ ID NO: 36965 - RNA, 18 nt, Artificial Sequence
  Description of Artificial Sequence: Synthetic oligonucleotide
agaugaugaaggcauugg

SEQ ID NO: 36966 - RNA, 18 nt, Artificial Sequence
  Description of Artificial Sequence: Synthetic oligonucleotide
gccacagaugaugaaggc

SEQ ID NO: 36967 - RNA, 18 nt, Artificial Sequence
  Description of Artificial Sequence: Synthetic oligonucleotide
aaggugccacagaugaug

SEQ ID NO: 36968 - RNA, 18 nt, Artificial Sequence
  Description of Artificial Sequence: Synthetic oligonucleotide
uguacaaggugccacaga

SEQ ID NO: 36969 - RNA, 18 nt, Artificial Sequence
  Description of Artificial Sequence: Synthetic oligonucleotide
gacgguguacaaggugcc

SEQ ID NO: 36970 - RNA, 18 nt, Artificial Sequence
  Description of Artificial Sequence: Synthetic oligonucleotide
cugcugacgguguacaag

SEQ ID NO: 36971 - RNA, 18 nt, Artificial Sequence
  Description of Artificial Sequence: Synthetic oligonucleotide
uguagcugcugacggugu

SEQ ID NO: 36972 - RNA, 18 nt, Artificial Sequence
  Description of Artificial Sequence: Synthetic oligonucleotide
ugagguguagcugcugac

SEQ ID NO: 36973 - RNA, 18 nt, Artificial Sequence
  Description of Artificial Sequence: Synthetic oligonucleotide
ucugcugagguguagcug

SEQ ID NO: 36974 - RNA, 18 nt, Artificial Sequence
  Description of Artificial Sequence: Synthetic oligonucleotide
uagcaucugcugaggugu

SEQ ID NO: 36975 - RNA, 18 nt, Artificial Sequence
  Description of Artificial Sequence: Synthetic oligonucleotide
gacgguagcaucugcuga

SEQ ID NO: 36976 - RNA, 18 nt, Artificial Sequence
  Description of Artificial Sequence: Synthetic oligonucleotide
aaguugacgguagcaucu

SEQ ID NO: 36977 - RNA, 18 nt, Artificial Sequence
  Description of Artificial Sequence: Synthetic oligonucleotide
aagcaaaguugacgguag

SEQ ID NO: 36978 - RNA, 18 nt, Artificial Sequence
  Description of Artificial Sequence: Synthetic oligonucleotide
gucauaagcaaaguugac

SEQ ID NO: 36979 - RNA, 18 nt, Artificial Sequence
  Description of Artificial Sequence: Synthetic oligonucleotide
ccugugucauaagcaaag

SEQ ID NO: 36980 - RNA, 18 nt, Artificial Sequence
  Description of Artificial Sequence: Synthetic oligonucleotide
cugugccugugucauaag

SEQ ID NO: 36981 - RNA, 18 nt, Artificial Sequence
  Description of Artificial Sequence: Synthetic oligonucleotide
gauaccugugccuguguc

SEQ ID NO: 36982 - RNA, 18 nt, Artificial Sequence
  Description of Artificial Sequence: Synthetic oligonucleotide
uugcugauaccugugccu

SEQ ID NO: 36983 - RNA, 18 nt, Artificial Sequence
  Description of Artificial Sequence: Synthetic oligonucleotide
gggucuugcugauaccug

SEQ ID NO: 36984 - RNA, 18 nt, Artificial Sequence
  Description of Artificial Sequence: Synthetic oligonucleotide
ggucagggucuugcugau

SEQ ID NO: 36985 - RNA, 18 nt, Artificial Sequence
  Description of Artificial Sequence: Synthetic oligonucleotide
gggauggucagggucuug

SEQ ID NO: 36986 - RNA, 18 nt, Artificial Sequence
  Description of Artificial Sequence: Synthetic oligonucleotide
ugaaugggauggucaggg

SEQ ID NO: 36987 - RNA, 18 nt, Artificial Sequence
  Description of Artificial Sequence: Synthetic oligonucleotide
guucuugaaugggauggu

SEQ ID NO: 36988 - RNA, 18 nt, Artificial Sequence
  Description of Artificial Sequence: Synthetic oligonucleotide
uagcgguucuugaauggg

SEQ ID NO: 36989 - RNA, 18 nt, Artificial Sequence
  Description of Artificial Sequence: Synthetic oligonucleotide
acuuauagcgguucuuga

SEQ ID NO: 36990 - RNA, 18 nt, Artificial Sequence
  Description of Artificial Sequence: Synthetic oligonucleotide
gcuguacuuauagcgguu

SEQ ID NO: 36991 - RNA, 18 nt, Artificial Sequence
  Description of Artificial Sequence: Synthetic oligonucleotide
augcugcuguacuuauag

SEQ ID NO: 36992 - RNA, 18 nt, Artificial Sequence
  Description of Artificial Sequence: Synthetic oligonucleotide
caaucaugcugcuguacu

SEQ ID NO: 36993 - RNA, 18 nt, Artificial Sequence
  Description of Artificial Sequence: Synthetic oligonucleotide
guagucaaucaugcugcu

SEQ ID NO: 36994 - RNA, 18 nt, Artificial Sequence
  Description of Artificial Sequence: Synthetic oligonucleotide
ggguuguagucaaucaug

SEQ ID NO: 36995 - RNA, 18 nt, Artificial Sequence
  Description of Artificial Sequence: Synthetic oligonucleotide
caaagagcuucuucucca

SEQ ID NO: 36996 - RNA, 18 nt, Artificial Sequence
  Description of Artificial Sequence: Synthetic oligonucleotide
ccaggcaaagagcuucuu

SEQ ID NO: 36997 - RNA, 18 nt, Artificial Sequence
  Description of Artificial Sequence: Synthetic oligonucleotide
uugucccaggcaaagagc

SEQ ID NO: 36998 - RNA, 18 nt, Artificial Sequence
  Description of Artificial Sequence: Synthetic oligonucleotide
ucaaguugucccaggcaa

SEQ ID NO: 36999 - RNA, 18 nt, Artificial Sequence
  Description of Artificial Sequence: Synthetic oligonucleotide
cauguucaaguuguccca

SEQ ID NO: 37000 - RNA, 18 nt, Artificial Sequence
  Description of Artificial Sequence: Synthetic oligonucleotide
gugaccauguucaaguug

SEQ ID NO: 37001 - RNA, 18 nt, Artificial Sequence
  Description of Artificial Sequence: Synthetic oligonucleotide
cauaagugaccauguuca

SEQ ID NO: 37002 - RNA, 18 nt, Artificial Sequence
  Description of Artificial Sequence: Synthetic oligonucleotide
gaugucauaagugaccau

SEQ ID NO: 37003 - RNA, 18 nt, Artificial Sequence
  Description of Artificial Sequence: Synthetic oligonucleotide
agcuugaugucauaagug

SEQ ID NO: 37004 - RNA, 18 nt, Artificial Sequence
  Description of Artificial Sequence: Synthetic oligonucleotide
uggagagcuugaugucau

SEQ ID NO: 37005 - RNA, 18 nt, Artificial Sequence
  Description of Artificial Sequence: Synthetic oligonucleotide
caucuuggagagcuugau

SEQ ID NO: 37006 - RNA, 18 nt, Artificial Sequence
  Description of Artificial Sequence: Synthetic oligonucleotide
uuucacaucuuggagagc

SEQ ID NO: 37007 - RNA, 18 nt, Artificial Sequence
  Description of Artificial Sequence: Synthetic oligonucleotide
aggcuuuucacaucuugg

SEQ ID NO: 37008 - RNA, 18 nt, Artificial Sequence
  Description of Artificial Sequence: Synthetic oligonucleotide
cuuggaggcuuuucacau

SEQ ID NO: 37009 - RNA, 18 nt, Artificial Sequence
  Description of Artificial Sequence: Synthetic oligonucleotide
uacagcuuggaggcuuuu

SEQ ID NO: 37010 - RNA, 18 nt, Artificial Sequence
  Description of Artificial Sequence: Synthetic oligonucleotide
gccuguacagcuuggagg

SEQ ID NO: 37011 - RNA, 18 nt, Artificial Sequence
  Description of Artificial Sequence: Synthetic oligonucleotide
ccauugccuguacagcuu

SEQ ID NO: 37012 - RNA, 18 nt, Artificial Sequence
  Description of Artificial Sequence: Synthetic oligonucleotide
uucugccauugccuguac

SEQ ID NO: 37013 - RNA, 18 nt, Artificial Sequence
  Description of Artificial Sequence: Synthetic oligonucleotide
ucuccuucugccauugcc

SEQ ID NO: 37014 - RNA, 18 nt, Artificial Sequence
  Description of Artificial Sequence: Synthetic oligonucleotide
gagcaucuccuucugcca

SEQ ID NO: 37015 - RNA, 18 nt, Artificial Sequence
  Description of Artificial Sequence: Synthetic oligonucleotide
gcccugagcaucuccuuc

SEQ ID NO: 37016 - RNA, 18 nt, Artificial Sequence
  Description of Artificial Sequence: Synthetic oligonucleotide
caggagcccugagcaucu

SEQ ID NO: 37017 - RNA, 18 nt, Artificial Sequence
  Description of Artificial Sequence: Synthetic oligonucleotide
ccccccaggagcccugag

SEQ ID NO: 37018 - RNA, 18 nt, Artificial Sequence
  Description of Artificial Sequence: Synthetic oligonucleotide
cugcuccccccaggagcc

SEQ ID NO: 37019 - RNA, 18 nt, Artificial Sequence
  Description of Artificial Sequence: Synthetic oligonucleotide
ucagccugcuccccccag

SEQ ID NO: 37020 - RNA, 18 nt, Artificial Sequence
  Description of Artificial Sequence: Synthetic oligonucleotide
ucccuucagccugcuccc

SEQ ID NO: 37021 - RNA, 18 nt, Artificial Sequence
  Description of Artificial Sequence: Synthetic oligonucleotide
ggcucucccuucagccug

SEQ ID NO: 37022 - RNA, 18 nt, Artificial Sequence
  Description of Artificial Sequence: Synthetic oligonucleotide
uggcuggcucucccuuca

SEQ ID NO: 37023 - RNA, 18 nt, Artificial Sequence
  Description of Artificial Sequence: Synthetic oligonucleotide
cuggcuggcuggcucucc

SEQ ID NO: 37024 - RNA, 18 nt, Artificial Sequence
  Description of Artificial Sequence: Synthetic oligonucleotide
gggcccuggcuggcuggc

SEQ ID NO: 37025 - RNA, 18 nt, Artificial Sequence
  Description of Artificial Sequence: Synthetic oligonucleotide
ugccugggcccuggcugg

SEQ ID NO: 37026 - RNA, 18 nt, Artificial Sequence
  Description of Artificial Sequence: Synthetic oligonucleotide
aaagcugccugggcccug

SEQ ID NO: 37027 - RNA, 18 nt, Artificial Sequence
  Description of Artificial Sequence: Synthetic oligonucleotide
cagucaaagcugccuggg

SEQ ID NO: 37028 - RNA, 18 nt, Artificial Sequence
  Description of Artificial Sequence: Synthetic oligonucleotide
gaaagcagucaaagcugc

SEQ ID NO: 37029 - RNA, 18 nt, Artificial Sequence
  Description of Artificial Sequence: Synthetic oligonucleotide
acuuggaaagcagucaaa

SEQ ID NO: 37030 - RNA, 18 nt, Artificial Sequence
  Description of Artificial Sequence: Synthetic oligonucleotide
ugaaaacuuggaaagcag

SEQ ID NO: 37031 - RNA, 18 nt, Artificial Sequence
  Description of Artificial Sequence: Synthetic oligonucleotide
auuaaugaaaacuuggaa

SEQ ID NO: 37032 - RNA, 18 nt, Artificial Sequence
  Description of Artificial Sequence: Synthetic oligonucleotide
ucuggauuaaugaaaacu

SEQ ID NO: 37033 - RNA, 18 nt, Artificial Sequence
  Description of Artificial Sequence: Synthetic oligonucleotide
auccuucuggauuaauga

SEQ ID NO: 37034 - RNA, 18 nt, Artificial Sequence
  Description of Artificial Sequence: Synthetic oligonucleotide
uguucauccuucuggauu

SEQ ID NO: 37035 - RNA, 18 nt, Artificial Sequence
  Description of Artificial Sequence: Synthetic oligonucleotide
gaccauguucauccuucu

SEQ ID NO: 37036 - RNA, 18 nt, Artificial Sequence
  Description of Artificial Sequence: Synthetic oligonucleotide
auggugaccauguucauc

SEQ ID NO: 37037 - RNA, 18 nt, Artificial Sequence
  Description of Artificial Sequence: Synthetic oligonucleotide
guuagauggugaccaugu

SEQ ID NO: 37038 - RNA, 18 nt, Artificial Sequence
  Description of Artificial Sequence: Synthetic oligonucleotide
gaauaguuagauggugac

SEQ ID NO: 37039 - RNA, 18 nt, Artificial Sequence
  Description of Artificial Sequence: Synthetic oligonucleotide
uuccugaauaguuagaug

SEQ ID NO: 37040 - RNA, 18 nt, Artificial Sequence
  Description of Artificial Sequence: Synthetic oligonucleotide
uacaauuccugaauaguu

SEQ ID NO: 37041 - RNA, 18 nt, Artificial Sequence
  Description of Artificial Sequence: Synthetic oligonucleotide
cagacuacaauuccugaa

SEQ ID NO: 37042 - RNA, 18 nt, Artificial Sequence
  Description of Artificial Sequence: Synthetic oligonucleotide
gcccucagacuacaauuc

SEQ ID NO: 37043 - RNA, 18 nt, Artificial Sequence
  Description of Artificial Sequence: Synthetic oligonucleotide
ucuacgcccucagacuac

SEQ ID NO: 37044 - RNA, 18 nt, Artificial Sequence
  Description of Artificial Sequence: Synthetic oligonucleotide
aauugucuacgcccucag

SEQ ID NO: 37045 - RNA, 18 nt, Artificial Sequence
  Description of Artificial Sequence: Synthetic oligonucleotide
uaugaaauugucuacgcc

SEQ ID NO: 37046 - RNA, 18 nt, Artificial Sequence
  Description of Artificial Sequence: Synthetic oligonucleotide
uauuauaugaaauugucu

SEQ ID NO: 37047 - RNA, 18 nt, Artificial Sequence
  Description of Artificial Sequence: Synthetic oligonucleotide
auauuuauuauaugaaau

SEQ ID NO: 37048 - RNA, 18 nt, Artificial Sequence
  Description of Artificial Sequence: Synthetic oligonucleotide
aaaggauauuuauuauau

SEQ ID NO: 37049 - RNA, 18 nt, Artificial Sequence
  Description of Artificial Sequence: Synthetic oligonucleotide
aagauaaaggauauuuau

SEQ ID NO: 37050 - RNA, 18 nt, Artificial Sequence
  Description of Artificial Sequence: Synthetic oligonucleotide
gacagaagauaaaggaua

SEQ ID NO: 37051 - RNA, 18 nt, Artificial Sequence
  Description of Artificial Sequence: Synthetic oligonucleotide
augcugacagaagauaaa

SEQ ID NO: 37052 - RNA, 18 nt, Artificial Sequence
  Description of Artificial Sequence: Synthetic oligonucleotide
cauaaaugcugacagaag

SEQ ID NO: 37053 - RNA, 18 nt, Artificial Sequence
  Description of Artificial Sequence: Synthetic oligonucleotide
caucccauaaaugcugac

SEQ ID NO: 37054 - RNA, 18 nt, Artificial Sequence
  Description of Artificial Sequence: Synthetic oligonucleotide
uuaaacaucccauaaaug

SEQ ID NO: 37055 - RNA, 18 nt, Artificial Sequence
  Description of Artificial Sequence: Synthetic oligonucleotide
ugucauuaaacaucccau

SEQ ID NO: 37056 - RNA, 18 nt, Artificial Sequence
  Description of Artificial Sequence: Synthetic oligonucleotide
aacuaugucauuaaacau

SEQ ID NO: 37057 - RNA, 18 nt, Artificial Sequence
  Description of Artificial Sequence: Synthetic oligonucleotide
acuugaacuaugucauua

SEQ ID NO: 37058 - RNA, 18 nt, Artificial Sequence
  Description of Artificial Sequence: Synthetic oligonucleotide
agaaaacuugaacuaugu

SEQ ID NO: 37059 - RNA, 18 nt, Artificial Sequence
  Description of Artificial Sequence: Synthetic oligonucleotide
ucacaagaaaacuugaac

SEQ ID NO: 37060 - RNA, 18 nt, Artificial Sequence
  Description of Artificial Sequence: Synthetic oligonucleotide
ccaaaucacaagaaaacu

SEQ ID NO: 37061 - RNA, 18 nt, Artificial Sequence
  Description of Artificial Sequence: Synthetic oligonucleotide
uugccccaaaucacaaga

SEQ ID NO: 37062 - RNA, 18 nt, Artificial Sequence
  Description of Artificial Sequence: Synthetic oligonucleotide
agcuuuugccccaaauca

SEQ ID NO: 37063 - RNA, 18 nt, Artificial Sequence
  Description of Artificial Sequence: Synthetic oligonucleotide
cuuacagcuuuugcccca

SEQ ID NO: 37064 - RNA, 18 nt, Artificial Sequence
  Description of Artificial Sequence: Synthetic oligonucleotide
uaugccuuacagcuuuug

SEQ ID NO: 37065 - RNA, 18 nt, Artificial Sequence
  Description of Artificial Sequence: Synthetic oligonucleotide
acuauuaugccuuacagc

SEQ ID NO: 37066 - RNA, 18 nt, Artificial Sequence
  Description of Artificial Sequence: Synthetic oligonucleotide
aagaaacuauuaugccuu

SEQ ID NO: 37067 - RNA, 18 nt, Artificial Sequence
  Description of Artificial Sequence: Synthetic oligonucleotide
ucaggaagaaacuauuau

SEQ ID NO: 37068 - RNA, 18 nt, Artificial Sequence
  Description of Artificial Sequence: Synthetic oligonucleotide
gguuuucaggaagaaacu

SEQ ID NO: 37069 - RNA, 18 nt, Artificial Sequence
  Description of Artificial Sequence: Synthetic oligonucleotide
gcaaugguuuucaggaag

SEQ ID NO: 37070 - RNA, 18 nt, Artificial Sequence
  Description of Artificial Sequence: Synthetic oligonucleotide
caagagcaaugguuuuca

SEQ ID NO: 37071 - RNA, 18 nt, Artificial Sequence
  Description of Artificial Sequence: Synthetic oligonucleotide
acaugcaagagcaauggu

SEQ ID NO: 37072 - RNA, 18 nt, Artificial Sequence
  Description of Artificial Sequence: Synthetic oligonucleotide
auguaacaugcaagagca

SEQ ID NO: 37073 - RNA, 18 nt, Artificial Sequence
  Description of Artificial Sequence: Synthetic oligonucleotide
uaaccauguaacaugcaa

SEQ ID NO: 37074 - RNA, 18 nt, Artificial Sequence
  Description of Artificial Sequence: Synthetic oligonucleotide
ugugguaaccauguaaca

SEQ ID NO: 37075 - RNA, 18 nt, Artificial Sequence
  Description of Artificial Sequence: Synthetic oligonucleotide
uggcuugugguaaccaug

SEQ ID NO: 37076 - RNA, 18 nt, Artificial Sequence
  Description of Artificial Sequence: Synthetic oligonucleotide
uauuguggcuugugguaa

SEQ ID NO: 37077 - RNA, 18 nt, Artificial Sequence
  Description of Artificial Sequence: Synthetic oligonucleotide
cuuuuuauuguggcuugu

SEQ ID NO: 37078 - RNA, 18 nt, Artificial Sequence
  Description of Artificial Sequence: Synthetic oligonucleotide
uuaugcuuuuuauugugg

SEQ ID NO: 37079 - RNA, 18 nt, Artificial Sequence
  Description of Artificial Sequence: Synthetic oligonucleotide
agaaguuaugcuuuuuau

SEQ ID NO: 37080 - RNA, 18 nt, Artificial Sequence
  Description of Artificial Sequence: Synthetic oligonucleotide
ccuuuagaaguuaugcuu

SEQ ID NO: 37081 - RNA, 18 nt, Artificial Sequence
  Description of Artificial Sequence: Synthetic oligonucleotide
ugcuuccuuuagaaguua

SEQ ID NO: 37082 - RNA, 18 nt, Artificial Sequence
  Description of Artificial Sequence: Synthetic oligonucleotide
uauucugcuuccuuuaga

SEQ ID NO: 37083 - RNA, 18 nt, Artificial Sequence
  Description of Artificial Sequence: Synthetic oligonucleotide
ggagcuauucugcuuccu

SEQ ID NO: 37084 - RNA, 18 nt, Artificial Sequence
  Description of Artificial Sequence: Synthetic oligonucleotide
ccagaggagcuauucugc

SEQ ID NO: 37085 - RNA, 18 nt, Artificial Sequence
  Description of Artificial Sequence: Synthetic oligonucleotide
gcuggccagaggagcuau

SEQ ID NO: 37086 - RNA, 18 nt, Artificial Sequence
  Description of Artificial Sequence: Synthetic oligonucleotide
ucgaugcuggccagagga

SEQ ID NO: 37087 - RNA, 18 nt, Artificial Sequence
  Description of Artificial Sequence: Synthetic oligonucleotide
uauauucgaugcuggcca

SEQ ID NO: 37088 - RNA, 18 nt, Artificial Sequence
  Description of Artificial Sequence: Synthetic oligonucleotide
uuacuuauauucgaugcu

SEQ ID NO: 37089 - RNA, 18 nt, Artificial Sequence
  Description of Artificial Sequence: Synthetic oligonucleotide
gcaucuuacuuauauucg

SEQ ID NO: 37090 - RNA, 18 nt, Artificial Sequence
  Description of Artificial Sequence: Synthetic oligonucleotide
uaaaugcaucuuacuuau

SEQ ID NO: 37091 - RNA, 18 nt, Artificial Sequence
  Description of Artificial Sequence: Synthetic oligonucleotide
uguaguaaaugcaucuua

SEQ ID NO: 37092 - RNA, 18 nt, Artificial Sequence
  Description of Artificial Sequence: Synthetic oligonucleotide
ccaacuguaguaaaugca

SEQ ID NO: 37093 - RNA, 18 nt, Artificial Sequence
  Description of Artificial Sequence: Synthetic oligonucleotide
agaagccaacuguaguaa

SEQ ID NO: 37094 - RNA, 18 nt, Artificial Sequence
  Description of Artificial Sequence: Synthetic oligonucleotide
gcauuagaagccaacugu

SEQ ID NO: 37095 - RNA, 18 nt, Artificial Sequence
  Description of Artificial Sequence: Synthetic oligonucleotide
cugaagcauuagaagcca

SEQ ID NO: 37096 - RNA, 18 nt, Artificial Sequence
  Description of Artificial Sequence: Synthetic oligonucleotide
ucuaucugaagcauuaga

SEQ ID NO: 37097 - RNA, 18 nt, Artificial Sequence
  Description of Artificial Sequence: Synthetic oligonucleotide
uguauucuaucugaagca

SEQ ID NO: 37098 - RNA, 18 nt, Artificial Sequence
  Description of Artificial Sequence: Synthetic oligonucleotide
ccaacuguauucuaucug

SEQ ID NO: 37099 - RNA, 18 nt, Artificial Sequence
  Description of Artificial Sequence: Synthetic oligonucleotide
gagacccaacuguauucu

SEQ ID NO: 37100 - RNA, 18 nt, Artificial Sequence
  Description of Artificial Sequence: Synthetic oligonucleotide
uaugugagacccaacugu

SEQ ID NO: 37101 - RNA, 18 nt, Artificial Sequence
  Description of Artificial Sequence: Synthetic oligonucleotide
aggguuaugugagaccca

SEQ ID NO: 37102 - RNA, 18 nt, Artificial Sequence
  Description of Artificial Sequence: Synthetic oligonucleotide
uguaaaggguuaugugag

SEQ ID NO: 37103 - RNA, 18 nt, Artificial Sequence
  Description of Artificial Sequence: Synthetic oligonucleotide
cacaauguaaaggguuau

SEQ ID NO: 37104 - RNA, 18 nt, Artificial Sequence
  Description of Artificial Sequence: Synthetic oligonucleotide
uauuucacaauguaaagg

SEQ ID NO: 37105 - RNA, 18 nt, Artificial Sequence
  Description of Artificial Sequence: Synthetic oligonucleotide
aauuuuauuucacaaugu

SEQ ID NO: 37106 - RNA, 18 nt, Artificial Sequence
  Description of Artificial Sequence: Synthetic oligonucleotide
aagaaaauuuuauuucac

SEQ ID NO: 37107 - RNA, 18 nt, Artificial Sequence
  Description of Artificial Sequence: Synthetic oligonucleotide
uggguaagaaaauuuuau

SEQ ID NO: 37108 - RNA, 18 nt, Artificial Sequence
  Description of Artificial Sequence: Synthetic oligonucleotide
cuucuuuuucgucuucuu

SEQ ID NO: 37109 - RNA, 18 nt, Artificial Sequence
  Description of Artificial Sequence: Synthetic oligonucleotide
gcauccuucuuuuucguc

SEQ ID NO: 37110 - RNA, 18 nt, Artificial Sequence
  Description of Artificial Sequence: Synthetic oligonucleotide
cgaucgcauccuucuuuu

SEQ ID NO: 37111 - RNA, 18 nt, Artificial Sequence
  Description of Artificial Sequence: Synthetic oligonucleotide
caccacgaucgcauccuu

SEQ ID NO: 37112 - RNA, 18 nt, Artificial Sequence
  Description of Artificial Sequence: Synthetic oligonucleotide
ggguccaccacgaucgca

SEQ ID NO: 37113 - RNA, 18 nt, Artificial Sequence
  Description of Artificial Sequence: Synthetic oligonucleotide
uggacggguccaccacga

SEQ ID NO: 37114 - RNA, 18 nt, Artificial Sequence
  Description of Artificial Sequence: Synthetic oligonucleotide
guugcuggacggguccac

SEQ ID NO: 37115 - RNA, 18 nt, Artificial Sequence
  Description of Artificial Sequence: Synthetic oligonucleotide
uacagguugcuggacggg

SEQ ID NO: 37116 - RNA, 18 nt, Artificial Sequence
  Description of Artificial Sequence: Synthetic oligonucleotide
gguaguacagguugcugg

SEQ ID NO: 37117 - RNA, 18 nt, Artificial Sequence
  Description of Artificial Sequence: Synthetic oligonucleotide
ccagcgguaguacagguu

SEQ ID NO: 37118 - RNA, 18 nt, Artificial Sequence
  Description of Artificial Sequence: Synthetic oligonucleotide
gucagccagcgguaguac

SEQ ID NO: 37119 - RNA, 18 nt, Artificial Sequence
  Description of Artificial Sequence: Synthetic oligonucleotide
uggcggucagccagcggu

SEQ ID NO: 37120 - RNA, 18 nt, Artificial Sequence
  Description of Artificial Sequence: Synthetic oligonucleotide
ggcgauggcggucagcca

SEQ ID NO: 37121 - RNA, 18 nt, Artificial Sequence
  Description of Artificial Sequence: Synthetic oligonucleotide
ggcagggcgauggcgguc

SEQ ID NO: 37122 - RNA, 18 nt, Artificial Sequence
  Description of Artificial Sequence: Synthetic oligonucleotide
agacaggcagggcgaugg

SEQ ID NO: 37123 - RNA, 18 nt, Artificial Sequence
  Description of Artificial Sequence: Synthetic oligonucleotide
auagaagacaggcagggc

SEQ ID NO: 37124 - RNA, 18 nt, Artificial Sequence
  Description of Artificial Sequence: Synthetic oligonucleotide
caguuauagaagacaggc

SEQ ID NO: 37125 - RNA, 18 nt, Artificial Sequence
  Description of Artificial Sequence: Synthetic oligonucleotide
gauaccaguuauagaaga

SEQ ID NO: 37126 - RNA, 18 nt, Artificial Sequence
  Description of Artificial Sequence: Synthetic oligonucleotide
aagcagauaccaguuaua

SEQ ID NO: 37127 - RNA, 18 nt, Artificial Sequence
  Description of Artificial Sequence: Synthetic oligonucleotide
caaauaagcagauaccag

SEQ ID NO: 37128 - RNA, 18 nt, Artificial Sequence
  Description of Artificial Sequence: Synthetic oligonucleotide
caccuuccaccccugucg

SEQ ID NO: 37129 - RNA, 18 nt, Artificial Sequence
  Description of Artificial Sequence: Synthetic oligonucleotide
cgcugcaccuuccacccc

SEQ ID NO: 37130 - RNA, 18 nt, Artificial Sequence
  Description of Artificial Sequence: Synthetic oligonucleotide
cuuuccgcugcaccuucc

SEQ ID NO: 37131 - RNA, 18 nt, Artificial Sequence
  Description of Artificial Sequence: Synthetic oligonucleotide
ucccccuuuccgcugcac

SEQ ID NO: 37132 - RNA, 18 nt, Artificial Sequence
  Description of Artificial Sequence: Synthetic oligonucleotide
ugguuucccccuuuccgc

SEQ ID NO: 37133 - RNA, 18 nt, Artificial Sequence
  Description of Artificial Sequence: Synthetic oligonucleotide
ugcccugguuucccccuu

SEQ ID NO: 37134 - RNA, 18 nt, Artificial Sequence
  Description of Artificial Sequence: Synthetic oligonucleotide
ccuggugcccugguuucc

SEQ ID NO: 37135 - RNA, 18 nt, Artificial Sequence
  Description of Artificial Sequence: Synthetic oligonucleotide
cugggccuggugcccugg

SEQ ID NO: 37136 - RNA, 18 nt, Artificial Sequence
  Description of Artificial Sequence: Synthetic oligonucleotide
ggcuccugggccuggugc

SEQ ID NO: 37137 - RNA, 18 nt, Artificial Sequence
  Description of Artificial Sequence: Synthetic oligonucleotide
gcucuggcuccugggccu

SEQ ID NO: 37138 - RNA, 18 nt, Artificial Sequence
  Description of Artificial Sequence: Synthetic oligonucleotide
guggagcucuggcuccug

SEQ ID NO: 37139 - RNA, 18 nt, Artificial Sequence
  Description of Artificial Sequence: Synthetic oligonucleotide
gagagguggagcucuggc

SEQ ID NO: 37140 - RNA, 18 nt, Artificial Sequence
  Description of Artificial Sequence: Synthetic oligonucleotide
cgagggagagguggagcu

SEQ ID NO: 37141 - RNA, 18 nt, Artificial Sequence
  Description of Artificial Sequence: Synthetic oligonucleotide
ccucccgagggagaggug

SEQ ID NO: 37142 - RNA, 18 nt, Artificial Sequence
  Description of Artificial Sequence: Synthetic oligonucleotide
ucaggccucccgagggag

SEQ ID NO: 37143 - RNA, 18 nt, Artificial Sequence
  Description of Artificial Sequence: Synthetic oligonucleotide
aggccucaggccucccga

SEQ ID NO: 37144 - RNA, 18 nt, Artificial Sequence
  Description of Artificial Sequence: Synthetic oligonucleotide
gguccaggccucaggccu

SEQ ID NO: 37145 - RNA, 18 nt, Artificial Sequence
  Description of Artificial Sequence: Synthetic oligonucleotide
ggguccaggccucaggcc

SEQ ID NO: 37146 - RNA, 18 nt, Artificial Sequence
  Description of Artificial Sequence: Synthetic oligonucleotide
aagugguggccgugaggg

SEQ ID NO: 37147 - RNA, 18 nt, Artificial Sequence
  Description of Artificial Sequence: Synthetic oligonucleotide
uaacuaagugguggccgu

SEQ ID NO: 37148 - RNA, 18 nt, Artificial Sequence
  Description of Artificial Sequence: Synthetic oligonucleotide
cacaauaacuaaguggug

SEQ ID NO: 37149 - RNA, 18 nt, Artificial Sequence
  Description of Artificial Sequence: Synthetic oligonucleotide
cgaggcacaauaacuaag

SEQ ID NO: 37150 - RNA, 18 nt, Artificial Sequence
  Description of Artificial Sequence: Synthetic oligonucleotide
gaaaccgaggcacaauaa

SEQ ID NO: 37151 - RNA, 18 nt, Artificial Sequence
  Description of Artificial Sequence: Synthetic oligonucleotide
aaggagaaaccgaggcac

SEQ ID NO: 37152 - RNA, 18 nt, Artificial Sequence
  Description of Artificial Sequence: Synthetic oligonucleotide
uuuaaaaggagaaaccga

SEQ ID NO: 37153 - RNA, 18 nt, Artificial Sequence
  Description of Artificial Sequence: Synthetic oligonucleotide
cuauuuuuaaaaggagaa

SEQ ID NO: 37154 - RNA, 18 nt, Artificial Sequence
  Description of Artificial Sequence: Synthetic oligonucleotide
accuucuauuuuuaaaag

SEQ ID NO: 37155 - RNA, 18 nt, Artificial Sequence
  Description of Artificial Sequence: Synthetic oligonucleotide
gggaaccuucuauuuuua

SEQ ID NO: 37156 - RNA, 18 nt, Artificial Sequence
  Description of Artificial Sequence: Synthetic oligonucleotide
ucugaugguccucuuggg

SEQ ID NO: 37157 - RNA, 18 nt, Artificial Sequence
  Description of Artificial Sequence: Synthetic oligonucleotide
agcacucugaugguccuc

SEQ ID NO: 37158 - RNA, 18 nt, Artificial Sequence
  Description of Artificial Sequence: Synthetic oligonucleotide
uucagagcacucugaugg

SEQ ID NO: 37159 - RNA, 18 nt, Artificial Sequence
  Description of Artificial Sequence: Synthetic oligonucleotide
caugcuucagagcacucu

SEQ ID NO: 37160 - RNA, 18 nt, Artificial Sequence
  Description of Artificial Sequence: Synthetic oligonucleotide
ccacccaugcuucagagc

SEQ ID NO: 37161 - RNA, 18 nt, Artificial Sequence
  Description of Artificial Sequence: Synthetic oligonucleotide
auuccccacccaugcuuc

SEQ ID NO: 37162 - RNA, 18 nt, Artificial Sequence
  Description of Artificial Sequence: Synthetic oligonucleotide
gcucaauuccccacccau

SEQ ID NO: 37163 - RNA, 18 nt, Artificial Sequence
  Description of Artificial Sequence: Synthetic oligonucleotide
cugaagcucaauucccca

SEQ ID NO: 37164 - RNA, 18 nt, Artificial Sequence
  Description of Artificial Sequence: Synthetic oligonucleotide
uccaccugaagcucaauu

SEQ ID NO: 37165 - RNA, 18 nt, Artificial Sequence
  Description of Artificial Sequence: Synthetic oligonucleotide
ggcuguccaccugaagcu

SEQ ID NO: 37166 - RNA, 18 nt, Artificial Sequence
  Description of Artificial Sequence: Synthetic oligonucleotide
acccuggcuguccaccug

SEQ ID NO: 37167 - RNA, 18 nt, Artificial Sequence
  Description of Artificial Sequence: Synthetic oligonucleotide
ccgaaacccuggcugucc

SEQ ID NO: 37168 - RNA, 18 nt, Artificial Sequence
  Description of Artificial Sequence: Synthetic oligonucleotide
cagugccgaaacccuggc

SEQ ID NO: 37169 - RNA, 18 nt, Artificial Sequence
  Description of Artificial Sequence: Synthetic oligonucleotide
ccccacagugccgaaacc

SEQ ID NO: 37170 - RNA, 18 nt, Artificial Sequence
  Description of Artificial Sequence: Synthetic oligonucleotide
gggccccacagugccgaa

SEQ ID NO: 37171 - RNA, 18 nt, Artificial Sequence
  Description of Artificial Sequence: Synthetic oligonucleotide
guacaacucacuugaggg

SEQ ID NO: 37172 - RNA, 18 nt, Artificial Sequence
  Description of Artificial Sequence: Synthetic oligonucleotide
uccucguacaacucacuu

SEQ ID NO: 37173 - RNA, 18 nt, Artificial Sequence
  Description of Artificial Sequence: Synthetic oligonucleotide
cauccuccucguacaacu

SEQ ID NO: 37174 - RNA, 18 nt, Artificial Sequence
  Description of Artificial Sequence: Synthetic oligonucleotide
cccugcauccuccucgua

SEQ ID NO: 37175 - RNA, 18 nt, Artificial Sequence
  Description of Artificial Sequence: Synthetic oligonucleotide
accgccccugcauccucc

SEQ ID NO: 37176 - RNA, 18 nt, Artificial Sequence
  Description of Artificial Sequence: Synthetic oligonucleotide
aagcaaccgccccugcau

SEQ ID NO: 37177 - RNA, 18 nt, Artificial Sequence
  Description of Artificial Sequence: Synthetic oligonucleotide
aagagaagcaaccgcccc

SEQ ID NO: 37178 - RNA, 18 nt, Artificial Sequence
  Description of Artificial Sequence: Synthetic oligonucleotide
cuccaaagagaagcaacc

SEQ ID NO: 37179 - RNA, 18 nt, Artificial Sequence
  Description of Artificial Sequence: Synthetic oligonucleotide
uaucccuccaaagagaag

SEQ ID NO: 37180 - RNA, 18 nt, Artificial Sequence
  Description of Artificial Sequence: Synthetic oligonucleotide
ccacuuaucccuccaaag

SEQ ID NO: 37181 - RNA, 18 nt, Artificial Sequence
  Description of Artificial Sequence: Synthetic oligonucleotide
accacccacuuaucccuc

SEQ ID NO: 37182 - RNA, 18 nt, Artificial Sequence
  Description of Artificial Sequence: Synthetic oligonucleotide
ucagaaccacccacuuau

SEQ ID NO: 37183 - RNA, 18 nt, Artificial Sequence
  Description of Artificial Sequence: Synthetic oligonucleotide
cauguucagaaccaccca

SEQ ID NO: 37184 - RNA, 18 nt, Artificial Sequence
  Description of Artificial Sequence: Synthetic oligonucleotide
ugcugcauguucagaacc

SEQ ID NO: 37185 - RNA, 18 nt, Artificial Sequence
  Description of Artificial Sequence: Synthetic oligonucleotide
uacccugcugcauguuca

SEQ ID NO: 37186 - RNA, 18 nt, Artificial Sequence
  Description of Artificial Sequence: Synthetic oligonucleotide
cucccuacccugcugcau

SEQ ID NO: 37187 - RNA, 18 nt, Artificial Sequence
  Description of Artificial Sequence: Synthetic oligonucleotide
ccugccucccuacccugc

SEQ ID NO: 37188 - RNA, 18 nt, Artificial Sequence
  Description of Artificial Sequence: Synthetic oligonucleotide
uugccccugccucccuac

SEQ ID NO: 37189 - RNA, 18 nt, Artificial Sequence
  Description of Artificial Sequence: Synthetic oligonucleotide
gcagcuugccccugccuc

SEQ ID NO: 37190 - RNA, 18 nt, Artificial Sequence
  Description of Artificial Sequence: Synthetic oligonucleotide
uaguagcagcuugccccu

SEQ ID NO: 37191 - RNA, 18 nt, Artificial Sequence
  Description of Artificial Sequence: Synthetic oligonucleotide
aaaaauaguagcagcuug

SEQ ID NO: 37192 - RNA, 18 nt, Artificial Sequence
  Description of Artificial Sequence: Synthetic oligonucleotide
aagaaaaaaauaguagca

SEQ ID NO: 37193 - RNA, 18 nt, Artificial Sequence
  Description of Artificial Sequence: Synthetic oligonucleotide
aaaaaaagaaaaaaauag

SEQ ID NO: 37194 - RNA, 18 nt, Artificial Sequence
  Description of Artificial Sequence: Synthetic oligonucleotide
caaaaaaaaaaagaaaaa

SEQ ID NO: 37195 - RNA, 18 nt, Artificial Sequence
  Description of Artificial Sequence: Synthetic oligonucleotide
ugucucaaaaaaaaaaag

SEQ ID NO: 37196 - RNA, 18 nt, Artificial Sequence
  Description of Artificial Sequence: Synthetic oligonucleotide
gacucugucucaaaaaaa

SEQ ID NO: 37197 - RNA, 18 nt, Artificial Sequence
  Description of Artificial Sequence: Synthetic oligonucleotide
agugagacucugucucaa

SEQ ID NO: 37198 - RNA, 18 nt, Artificial Sequence
  Description of Artificial Sequence: Synthetic oligonucleotide
gacagagugagacucugu

SEQ ID NO: 37199 - RNA, 18 nt, Artificial Sequence
  Description of Artificial Sequence: Synthetic oligonucleotide
ugggugacagagugagac

SEQ ID NO: 37200 - RNA, 18 nt, Artificial Sequence
  Description of Artificial Sequence: Synthetic oligonucleotide
cagccugggugacagagu

SEQ ID NO: 37201 - RNA, 18 nt, Artificial Sequence
  Description of Artificial Sequence: Synthetic oligonucleotide
aacuccagccugggugac

SEQ ID NO: 37202 - RNA, 18 nt, Artificial Sequence
  Description of Artificial Sequence: Synthetic oligonucleotide
cacugaacuccagccugg

SEQ ID NO: 37203 - RNA, 18 nt, Artificial Sequence
  Description of Artificial Sequence: Synthetic oligonucleotide
cgcgccacugaacuccag

SEQ ID NO: 37204 - RNA, 18 nt, Artificial Sequence
  Description of Artificial Sequence: Synthetic oligonucleotide
gagaucgcgccacugaac

SEQ ID NO: 37205 - RNA, 18 nt, Artificial Sequence
  Description of Artificial Sequence: Synthetic oligonucleotide
uagcugagaucgcgccac

SEQ ID NO: 37206 - RNA, 18 nt, Artificial Sequence
  Description of Artificial Sequence: Synthetic oligonucleotide
gcaguuagcugagaucgc

SEQ ID NO: 37207 - RNA, 18 nt, Artificial Sequence
  Description of Artificial Sequence: Synthetic oligonucleotide
agguugcaguuagcugag

SEQ ID NO: 37208 - RNA, 18 nt, Artificial Sequence
  Description of Artificial Sequence: Synthetic oligonucleotide
gguggagguugcaguuag

SEQ ID NO: 37209 - RNA, 18 nt, Artificial Sequence
  Description of Artificial Sequence: Synthetic oligonucleotide
cgggagguggagguugca

SEQ ID NO: 37210 - RNA, 18 nt, Artificial Sequence
  Description of Artificial Sequence: Synthetic oligonucleotide
uaacccgggagguggagg

SEQ ID NO: 37211 - RNA, 18 nt, Artificial Sequence
  Description of Artificial Sequence: Synthetic oligonucleotide
cgcuuuaacccgggaggu

SEQ ID NO: 37212 - RNA, 18 nt, Artificial Sequence
  Description of Artificial Sequence: Synthetic oligonucleotide
agaaucgcuuuaacccgg

SEQ ID NO: 37213 - RNA, 18 nt, Artificial Sequence
  Description of Artificial Sequence: Synthetic oligonucleotide
gcaggagaaucgcuuuaa

SEQ ID NO: 37214 - RNA, 18 nt, Artificial Sequence
  Description of Artificial Sequence: Synthetic oligonucleotide
cugaggcaggagaaucgc

SEQ ID NO: 37215 - RNA, 18 nt, Artificial Sequence
  Description of Artificial Sequence: Synthetic oligonucleotide
gguggcugaggcaggaga

SEQ ID NO: 37216 - RNA, 18 nt, Artificial Sequence
  Description of Artificial Sequence: Synthetic oligonucleotide
acucggguggcugaggca

SEQ ID NO: 37217 - RNA, 18 nt, Artificial Sequence
  Description of Artificial Sequence: Synthetic oligonucleotide
cagcuacucggguggcug

SEQ ID NO: 37218 - RNA, 18 nt, Artificial Sequence
  Description of Artificial Sequence: Synthetic oligonucleotide
agucacagcuacucgggu

SEQ ID NO: 37219 - RNA, 18 nt, Artificial Sequence
  Description of Artificial Sequence: Synthetic oligonucleotide
uauguagucacagcuacu

SEQ ID NO: 37220 - RNA, 18 nt, Artificial Sequence
  Description of Artificial Sequence: Synthetic oligonucleotide
ucauauauguagucacag

SEQ ID NO: 37221 - RNA, 18 nt, Artificial Sequence
  Description of Artificial Sequence: Synthetic oligonucleotide
guggcucauauauguagu

SEQ ID NO: 37222 - RNA, 18 nt, Artificial Sequence
  Description of Artificial Sequence: Synthetic oligonucleotide
ccgcccaccugcugcuug

SEQ ID NO: 37223 - RNA, 18 nt, Artificial Sequence
  Description of Artificial Sequence: Synthetic oligonucleotide
cccugccgcccaccugcu

SEQ ID NO: 37224 - RNA, 18 nt, Artificial Sequence
  Description of Artificial Sequence: Synthetic oligonucleotide
ccugccccugccgcccac

SEQ ID NO: 37225 - RNA, 18 nt, Artificial Sequence
  Description of Artificial Sequence: Synthetic oligonucleotide
agcagccugccccugccg

SEQ ID NO: 37226 - RNA, 18 nt, Artificial Sequence
  Description of Artificial Sequence: Synthetic oligonucleotide
ggcacagcagccugcccc

SEQ ID NO: 37227 - RNA, 18 nt, Artificial Sequence
  Description of Artificial Sequence: Synthetic oligonucleotide
ucacgggcacagcagccu

SEQ ID NO: 37228 - RNA, 18 nt, Artificial Sequence
  Description of Artificial Sequence: Synthetic oligonucleotide
uauccucacgggcacagc

SEQ ID NO: 37229 - RNA, 18 nt, Artificial Sequence
  Description of Artificial Sequence: Synthetic oligonucleotide
ccuccuauccucacgggc

SEQ ID NO: 37230 - RNA, 18 nt, Artificial Sequence
  Description of Artificial Sequence: Synthetic oligonucleotide
gcucuccuccuauccuca

SEQ ID NO: 37231 - RNA, 18 nt, Artificial Sequence
  Description of Artificial Sequence: Synthetic oligonucleotide
ccccagcucuccuccuau

SEQ ID NO: 37232 - RNA, 18 nt, Artificial Sequence
  Description of Artificial Sequence: Synthetic oligonucleotide
agcacccccagcucuccu

SEQ ID NO: 37233 - RNA, 18 nt, Artificial Sequence
  Description of Artificial Sequence: Synthetic oligonucleotide
caggcagcacccccagcu

SEQ ID NO: 37234 - RNA, 18 nt, Artificial Sequence
  Description of Artificial Sequence: Synthetic oligonucleotide
ccacacaggcagcacccc

SEQ ID NO: 37235 - RNA, 18 nt, Artificial Sequence
  Description of Artificial Sequence: Synthetic oligonucleotide
guuucccacacaggcagc

SEQ ID NO: 37236 - RNA, 18 nt, Artificial Sequence
  Description of Artificial Sequence: Synthetic oligonucleotide
cugcuguuucccacacag

SEQ ID NO: 37237 - RNA, 18 nt, Artificial Sequence
  Description of Artificial Sequence: Synthetic oligonucleotide
ucuuucugcuguuuccca

SEQ ID NO: 37238 - RNA, 18 nt, Artificial Sequence
  Description of Artificial Sequence: Synthetic oligonucleotide
cuccaucuuucugcuguu

SEQ ID NO: 37239 - RNA, 18 nt, Artificial Sequence
  Description of Artificial Sequence: Synthetic oligonucleotide
accuucuccaucuuucug

SEQ ID NO: 37240 - RNA, 18 nt, Artificial Sequence
  Description of Artificial Sequence: Synthetic oligonucleotide
uuucuaccuucuccaucu

SEQ ID NO: 37241 - RNA, 18 nt, Artificial Sequence
  Description of Artificial Sequence: Synthetic oligonucleotide
aauauuuucuaccuucuc

SEQ ID NO: 37242 - RNA, 18 nt, Artificial Sequence
  Description of Artificial Sequence: Synthetic oligonucleotide
caguaaauauuuucuacc

SEQ ID NO: 37243 - RNA, 18 nt, Artificial Sequence
  Description of Artificial Sequence: Synthetic oligonucleotide
acagacaguaaauauuuu

SEQ ID NO: 37244 - RNA, 18 nt, Artificial Sequence
  Description of Artificial Sequence: Synthetic oligonucleotide
auggaacagacaguaaau

SEQ ID NO: 37245 - RNA, 18 nt, Artificial Sequence
  Description of Artificial Sequence: Synthetic oligonucleotide
uaacaauggaacagacag

SEQ ID NO: 37246 - RNA, 18 nt, Artificial Sequence
  Description of Artificial Sequence: Synthetic oligonucleotide
gagauuaacaauggaaca

SEQ ID NO: 37247 - RNA, 18 nt, Artificial Sequence
  Description of Artificial Sequence: Synthetic oligonucleotide
uccgagagauuaacaaug

SEQ ID NO: 37248 - RNA, 18 nt, Artificial Sequence
  Description of Artificial Sequence: Synthetic oligonucleotide
gaauuuccgagagauuaa

SEQ ID NO: 37249 - RNA, 18 nt, Artificial Sequence
  Description of Artificial Sequence: Synthetic oligonucleotide
uaggagaauuuccgagag

SEQ ID NO: 37250 - RNA, 18 nt, Artificial Sequence
  Description of Artificial Sequence: Synthetic oligonucleotide
aaaaauaggagaauuucc

SEQ ID NO: 37251 - RNA, 18 nt, Artificial Sequence
  Description of Artificial Sequence: Synthetic oligonucleotide
ucaacaaaaauaggagaa

SEQ ID NO: 37252 - RNA, 18 nt, Artificial Sequence
  Description of Artificial Sequence: Synthetic oligonucleotide
aaaguucaacaaaaauag

SEQ ID NO: 37253 - RNA, 18 nt, Artificial Sequence
  Description of Artificial Sequence: Synthetic oligonucleotide
gggucaaaguucaacaaa

SEQ ID NO: 37254 - RNA, 18 nt, Artificial Sequence
  Description of Artificial Sequence: Synthetic oligonucleotide
agaccugcccuuucuggg

SEQ ID NO: 37255 - RNA, 18 nt, Artificial Sequence
  Description of Artificial Sequence: Synthetic oligonucleotide
aaagaccugcccuuucug

SEQ ID NO: 37256 - RNA, 18 nt, Artificial Sequence
  Description of Artificial Sequence: Synthetic oligonucleotide
gggcuaaagaccugcccu

SEQ ID NO: 37257 - RNA, 18 nt, Artificial Sequence
  Description of Artificial Sequence: Synthetic oligonucleotide
gcagagucagguaaaggg

SEQ ID NO: 37258 - RNA, 18 nt, Artificial Sequence
  Description of Artificial Sequence: Synthetic oligonucleotide
cuggcagagucagguaaa

SEQ ID NO: 37259 - RNA, 18 nt, Artificial Sequence
  Description of Artificial Sequence: Synthetic oligonucleotide
ccacacuggcagagucag

SEQ ID NO: 37260 - RNA, 18 nt, Artificial Sequence
  Description of Artificial Sequence: Synthetic oligonucleotide
ccaggccacacuggcaga

SEQ ID NO: 37261 - RNA, 18 nt, Artificial Sequence
  Description of Artificial Sequence: Synthetic oligonucleotide
guuuuccaggccacacug

SEQ ID NO: 37262 - RNA, 18 nt, Artificial Sequence
  Description of Artificial Sequence: Synthetic oligonucleotide
guaccguuuuccaggcca

SEQ ID NO: 37263 - RNA, 18 nt, Artificial Sequence
  Description of Artificial Sequence: Synthetic oligonucleotide
aggagguaccguuuucca

SEQ ID NO: 37264 - RNA, 18 nt, Artificial Sequence
  Description of Artificial Sequence: Synthetic oligonucleotide
aucccaggagguaccguu

SEQ ID NO: 37265 - RNA, 18 nt, Artificial Sequence
  Description of Artificial Sequence: Synthetic oligonucleotide
acaagaucccaggaggua

SEQ ID NO: 37266 - RNA, 18 nt, Artificial Sequence
  Description of Artificial Sequence: Synthetic oligonucleotide
gagcuacaagaucccagg

SEQ ID NO: 37267 - RNA, 18 nt, Artificial Sequence
  Description of Artificial Sequence: Synthetic oligonucleotide
gcagagagcuacaagauc

SEQ ID NO: 37268 - RNA, 18 nt, Artificial Sequence
  Description of Artificial Sequence: Synthetic oligonucleotide
ucucagcagagagcuaca

SEQ ID NO: 37269 - RNA, 18 nt, Artificial Sequence
  Description of Artificial Sequence: Synthetic oligonucleotide
uugccucucagcagagag

SEQ ID NO: 37270 - RNA, 18 nt, Artificial Sequence
  Description of Artificial Sequence: Synthetic oligonucleotide
ccccauugccucucagca

SEQ ID NO: 37271 - RNA, 18 nt, Artificial Sequence
  Description of Artificial Sequence: Synthetic oligonucleotide
agcggccccauugccucu

SEQ ID NO: 37272 - RNA, 18 nt, Artificial Sequence
  Description of Artificial Sequence: Synthetic oligonucleotide
caaagagcggccccauug

SEQ ID NO: 37273 - RNA, 18 nt, Artificial Sequence
  Description of Artificial Sequence: Synthetic oligonucleotide
gaccccaaagagcggccc

SEQ ID NO: 37274 - RNA, 18 nt, Artificial Sequence
  Description of Artificial Sequence: Synthetic oligonucleotide
ggauugaccccaaagagc

SEQ ID NO: 37275 - RNA, 18 nt, Artificial Sequence
  Description of Artificial Sequence: Synthetic oligonucleotide
agcugggauugaccccaa

SEQ ID NO: 37276 - RNA, 18 nt, Artificial Sequence
  Description of Artificial Sequence: Synthetic oligonucleotide
agaagagcugggauugac

SEQ ID NO: 37277 - RNA, 18 nt, Artificial Sequence
  Description of Artificial Sequence: Synthetic oligonucleotide
uccugagaagagcuggga

SEQ ID NO: 37278 - RNA, 18 nt, Artificial Sequence
  Description of Artificial Sequence: Synthetic oligonucleotide
agaacuccugagaagagc

SEQ ID NO: 37279 - RNA, 18 nt, Artificial Sequence
  Description of Artificial Sequence: Synthetic oligonucleotide
gucacagaacuccugaga

SEQ ID NO: 37280 - RNA, 18 nt, Artificial Sequence
  Description of Artificial Sequence: Synthetic oligonucleotide
ccacagucacagaacucc

SEQ ID NO: 37281 - RNA, 18 nt, Artificial Sequence
  Description of Artificial Sequence: Synthetic oligonucleotide
cugucccacagucacaga

SEQ ID NO: 37282 - RNA, 18 nt, Artificial Sequence
  Description of Artificial Sequence: Synthetic oligonucleotide
cuuuucugucccacaguc

SEQ ID NO: 37283 - RNA, 18 nt, Artificial Sequence
  Description of Artificial Sequence: Synthetic oligonucleotide
agaagcuuuucuguccca

SEQ ID NO: 37284 - RNA, 18 nt, Artificial Sequence
  Description of Artificial Sequence: Synthetic oligonucleotide
cucugagaagcuuuucug

SEQ ID NO: 37285 - RNA, 18 nt, Artificial Sequence
  Description of Artificial Sequence: Synthetic oligonucleotide
gaugucucugagaagcuu

SEQ ID NO: 37286 - RNA, 18 nt, Artificial Sequence
  Description of Artificial Sequence: Synthetic oligonucleotide
gaugagaugucucugaga

SEQ ID NO: 37287 - RNA, 18 nt, Artificial Sequence
  Description of Artificial Sequence: Synthetic oligonucleotide
cuucugaugagaugucuc

SEQ ID NO: 37288 - RNA, 18 nt, Artificial Sequence
  Description of Artificial Sequence: Synthetic oligonucleotide
ccccgcuucugaugagau

SEQ ID NO: 37289 - RNA, 18 nt, Artificial Sequence
  Description of Artificial Sequence: Synthetic oligonucleotide
aucacccccgcuucugau

SEQ ID NO: 37290 - RNA, 18 nt, Artificial Sequence
  Description of Artificial Sequence: Synthetic oligonucleotide
guguaaucacccccgcuu

SEQ ID NO: 37291 - RNA, 18 nt, Artificial Sequence
  Description of Artificial Sequence: Synthetic oligonucleotide
ccucaguguaaucacccc

SEQ ID NO: 37292 - RNA, 18 nt, Artificial Sequence
  Description of Artificial Sequence: Synthetic oligonucleotide
cacuaccucaguguaauc

SEQ ID NO: 37293 - RNA, 18 nt, Artificial Sequence
  Description of Artificial Sequence: Synthetic oligonucleotide
ggugucacuaccucagug

SEQ ID NO: 37294 - RNA, 18 nt, Artificial Sequence
  Description of Artificial Sequence: Synthetic oligonucleotide
ccugcggugucacuaccu

SEQ ID NO: 37295 - RNA, 18 nt, Artificial Sequence
  Description of Artificial Sequence: Synthetic oligonucleotide
cccugccugcggugucac

SEQ ID NO: 37296 - RNA, 18 nt, Artificial Sequence
  Description of Artificial Sequence: Synthetic oligonucleotide
aauggcccugccugcggu

SEQ ID NO: 37297 - RNA, 18 nt, Artificial Sequence
  Description of Artificial Sequence: Synthetic oligonucleotide
augggaauggcccugccu

SEQ ID NO: 37298 - RNA, 18 nt, Artificial Sequence
  Description of Artificial Sequence: Synthetic oligonucleotide
guaauaugggaauggccc

SEQ ID NO: 37299 - RNA, 18 nt, Artificial Sequence
  Description of Artificial Sequence: Synthetic oligonucleotide
aucauguaauaugggaau

SEQ ID NO: 37300 - RNA, 18 nt, Artificial Sequence
  Description of Artificial Sequence: Synthetic oligonucleotide
gcuggaucauguaauaug

SEQ ID NO: 37301 - RNA, 18 nt, Artificial Sequence
  Description of Artificial Sequence: Synthetic oligonucleotide
aagacgcuggaucaugua

SEQ ID NO: 37302 - RNA, 18 nt, Artificial Sequence
  Description of Artificial Sequence: Synthetic oligonucleotide
uguggaagacgcuggauc

SEQ ID NO: 37303 - RNA, 18 nt, Artificial Sequence
  Description of Artificial Sequence: Synthetic oligonucleotide
cucuguguggaagacgcu

SEQ ID NO: 37304 - RNA, 18 nt, Artificial Sequence
  Description of Artificial Sequence: Synthetic oligonucleotide
acgggcucuguguggaag

SEQ ID NO: 37305 - RNA, 18 nt, Artificial Sequence
  Description of Artificial Sequence: Synthetic oligonucleotide
ugggcacgggcucugugu

SEQ ID NO: 37306 - RNA, 18 nt, Artificial Sequence
  Description of Artificial Sequence: Synthetic oligonucleotide
accugugggcacgggcuc

SEQ ID NO: 37307 - RNA, 18 nt, Artificial Sequence
  Description of Artificial Sequence: Synthetic oligonucleotide
cacccaccugugggcacg

SEQ ID NO: 37308 - RNA, 18 nt, Artificial Sequence
  Description of Artificial Sequence: Synthetic oligonucleotide
uggaccacccaccugugg

SEQ ID NO: 37309 - RNA, 18 nt, Artificial Sequence
  Description of Artificial Sequence: Synthetic oligonucleotide
gagcguggaccacccacc

SEQ ID NO: 37310 - RNA, 18 nt, Artificial Sequence
  Description of Artificial Sequence: Synthetic oligonucleotide
uucuggagcguggaccac

SEQ ID NO: 37311 - RNA, 18 nt, Artificial Sequence
  Description of Artificial Sequence: Synthetic oligonucleotide
uguguuucuggagcgugg

SEQ ID NO: 37312 - RNA, 18 nt, Artificial Sequence
  Description of Artificial Sequence: Synthetic oligonucleotide
gugcguguguuucuggag

SEQ ID NO: 37313 - RNA, 18 nt, Artificial Sequence
  Description of Artificial Sequence: Synthetic oligonucleotide
uggcugugcguguguuuc

SEQ ID NO: 37314 - RNA, 18 nt, Artificial Sequence
  Description of Artificial Sequence: Synthetic oligonucleotide
auggauggcugugcgugu

SEQ ID NO: 37315 - RNA, 18 nt, Artificial Sequence
  Description of Artificial Sequence: Synthetic oligonucleotide
gggagauggauggcugug

SEQ ID NO: 37316 - RNA, 18 nt, Artificial Sequence
  Description of Artificial Sequence: Synthetic oligonucleotide
cagcucaucgaaacaggc

SEQ ID NO: 37317 - RNA, 18 nt, Artificial Sequence
  Description of Artificial Sequence: Synthetic oligonucleotide
gacugcagcucaucgaaa

SEQ ID NO: 37318 - RNA, 18 nt, Artificial Sequence
  Description of Artificial Sequence: Synthetic oligonucleotide
acucggacugcagcucau

SEQ ID NO: 37319 - RNA, 18 nt, Artificial Sequence
  Description of Artificial Sequence: Synthetic oligonucleotide
cagguacucggacugcag

SEQ ID NO: 37320 - RNA, 18 nt, Artificial Sequence
  Description of Artificial Sequence: Synthetic oligonucleotide
agcaucagguacucggac

SEQ ID NO: 37321 - RNA, 18 nt, Artificial Sequence
  Description of Artificial Sequence: Synthetic oligonucleotide
gccacagcaucagguacu

SEQ ID NO: 37322 - RNA, 18 nt, Artificial Sequence
  Description of Artificial Sequence: Synthetic oligonucleotide
gaccagccacagcaucag

SEQ ID NO: 37323 - RNA, 18 nt, Artificial Sequence
  Description of Artificial Sequence: Synthetic oligonucleotide
uccaggaccagccacagc

SEQ ID NO: 37324 - RNA, 18 nt, Artificial Sequence
  Description of Artificial Sequence: Synthetic oligonucleotide
aguaguccaggaccagcc

SEQ ID NO: 37325 - RNA, 18 nt, Artificial Sequence
  Description of Artificial Sequence: Synthetic oligonucleotide
ugccgaguaguccaggac

SEQ ID NO: 37326 - RNA, 18 nt, Artificial Sequence
  Description of Artificial Sequence: Synthetic oligonucleotide
acaucugccgaguagucc

SEQ ID NO: 37327 - RNA, 18 nt, Artificial Sequence
  Description of Artificial Sequence: Synthetic oligonucleotide
acaggacaucugccgagu

SEQ ID NO: 37328 - RNA, 18 nt, Artificial Sequence
  Description of Artificial Sequence: Synthetic oligonucleotide
gacauacaggacaucugc

SEQ ID NO: 37329 - RNA, 18 nt, Artificial Sequence
  Description of Artificial Sequence: Synthetic oligonucleotide
uccaagacauacaggaca

SEQ ID NO: 37330 - RNA, 18 nt, Artificial Sequence
  Description of Artificial Sequence: Synthetic oligonucleotide
gcacauccaagacauaca

SEQ ID NO: 37331 - RNA, 18 nt, Artificial Sequence
  Description of Artificial Sequence: Synthetic oligonucleotide
uacaagcacauccaagac

SEQ ID NO: 37332 - RNA, 18 nt, Artificial Sequence
  Description of Artificial Sequence: Synthetic oligonucleotide
gcucguacaagcacaucc

SEQ ID NO: 37333 - RNA, 18 nt, Artificial Sequence
  Description of Artificial Sequence: Synthetic oligonucleotide
uccgagcucguacaagca

SEQ ID NO: 37334 - RNA, 18 nt, Artificial Sequence
  Description of Artificial Sequence: Synthetic oligonucleotide
cuucuuuuucgucuucuu

SEQ ID NO: 37335 - RNA, 18 nt, Artificial Sequence
  Description of Artificial Sequence: Synthetic oligonucleotide
gcauccuucuuuuucguc

SEQ ID NO: 37336 - RNA, 18 nt, Artificial Sequence
  Description of Artificial Sequence: Synthetic oligonucleotide
cgaucgcauccuucuuuu

SEQ ID NO: 37337 - RNA, 18 nt, Artificial Sequence
  Description of Artificial Sequence: Synthetic oligonucleotide
caccacgaucgcauccuu

SEQ ID NO: 37338 - RNA, 18 nt, Artificial Sequence
  Description of Artificial Sequence: Synthetic oligonucleotide
ggguccaccacgaucgca

SEQ ID NO: 37339 - RNA, 18 nt, Artificial Sequence
  Description of Artificial Sequence: Synthetic oligonucleotide
uggacggguccaccacga

SEQ ID NO: 37340 - RNA, 18 nt, Artificial Sequence
  Description of Artificial Sequence: Synthetic oligonucleotide
guugcuggacggguccac

SEQ ID NO: 37341 - RNA, 18 nt, Artificial Sequence
  Description of Artificial Sequence: Synthetic oligonucleotide
uacagguugcuggacggg

SEQ ID NO: 37342 - RNA, 18 nt, Artificial Sequence
  Description of Artificial Sequence: Synthetic oligonucleotide
gguaguacagguugcugg

SEQ ID NO: 37343 - RNA, 18 nt, Artificial Sequence
  Description of Artificial Sequence: Synthetic oligonucleotide
ccagcgguaguacagguu

SEQ ID NO: 37344 - RNA, 18 nt, Artificial Sequence
  Description of Artificial Sequence: Synthetic oligonucleotide
gucagccagcgguaguac

SEQ ID NO: 37345 - RNA, 18 nt, Artificial Sequence
  Description of Artificial Sequence: Synthetic oligonucleotide
uggcggucagccagcggu

SEQ ID NO: 37346 - RNA, 18 nt, Artificial Sequence
  Description of Artificial Sequence: Synthetic oligonucleotide
ggcgauggcggucagcca

SEQ ID NO: 37347 - RNA, 18 nt, Artificial Sequence
  Description of Artificial Sequence: Synthetic oligonucleotide
ggcagggcgauggcgguc

SEQ ID NO: 37348 - RNA, 18 nt, Artificial Sequence
  Description of Artificial Sequence: Synthetic oligonucleotide
agacaggcagggcgaugg

SEQ ID NO: 37349 - RNA, 18 nt, Artificial Sequence
  Description of Artificial Sequence: Synthetic oligonucleotide
auagaagacaggcagggc

SEQ ID NO: 37350 - RNA, 18 nt, Artificial Sequence
  Description of Artificial Sequence: Synthetic oligonucleotide
caguuauagaagacaggc

SEQ ID NO: 37351 - RNA, 18 nt, Artificial Sequence
  Description of Artificial Sequence: Synthetic oligonucleotide
gauaccaguuauagaaga

SEQ ID NO: 37352 - RNA, 18 nt, Artificial Sequence
  Description of Artificial Sequence: Synthetic oligonucleotide
aagcagauaccaguuaua

SEQ ID NO: 37353 - RNA, 18 nt, Artificial Sequence
  Description of Artificial Sequence: Synthetic oligonucleotide
caaauaagcagauaccag

SEQ ID NO: 37354 - RNA, 18 nt, Artificial Sequence
  Description of Artificial Sequence: Synthetic oligonucleotide
caccuuccaccccugucg

SEQ ID NO: 37355 - RNA, 18 nt, Artificial Sequence
  Description of Artificial Sequence: Synthetic oligonucleotide
cgcugcaccuuccacccc

SEQ ID NO: 37356 - RNA, 18 nt, Artificial Sequence
  Description of Artificial Sequence: Synthetic oligonucleotide
cuuuccgcugcaccuucc

SEQ ID NO: 37357 - RNA, 18 nt, Artificial Sequence
  Description of Artificial Sequence: Synthetic oligonucleotide
ucccccuuuccgcugcac

SEQ ID NO: 37358 - RNA, 18 nt, Artificial Sequence
  Description of Artificial Sequence: Synthetic oligonucleotide
ugguuucccccuuuccgc

SEQ ID NO: 37359 - RNA, 18 nt, Artificial Sequence
  Description of Artificial Sequence: Synthetic oligonucleotide
ugcccugguuucccccuu

SEQ ID NO: 37360 - RNA, 18 nt, Artificial Sequence
  Description of Artificial Sequence: Synthetic oligonucleotide
ccuggugcccugguuucc

SEQ ID NO: 37361 - RNA, 18 nt, Artificial Sequence
  Description of Artificial Sequence: Synthetic oligonucleotide
cugggccuggugcccugg

SEQ ID NO: 37362 - RNA, 18 nt, Artificial Sequence
  Description of Artificial Sequence: Synthetic oligonucleotide
ggcuccugggccuggugc

SEQ ID NO: 37363 - RNA, 18 nt, Artificial Sequence
  Description of Artificial Sequence: Synthetic oligonucleotide
gcucuggcuccugggccu

SEQ ID NO: 37364 - RNA, 18 nt, Artificial Sequence
  Description of Artificial Sequence: Synthetic oligonucleotide
guggagcucuggcuccug

SEQ ID NO: 37365 - RNA, 18 nt, Artificial Sequence
  Description of Artificial Sequence: Synthetic oligonucleotide
gagagguggagcucuggc

SEQ ID NO: 37366 - RNA, 18 nt, Artificial Sequence
  Description of Artificial Sequence: Synthetic oligonucleotide
cgagggagagguggagcu

SEQ ID NO: 37367 - RNA, 18 nt, Artificial Sequence
  Description of Artificial Sequence: Synthetic oligonucleotide
ccucccgagggagaggug

SEQ ID NO: 37368 - RNA, 18 nt, Artificial Sequence
  Description of Artificial Sequence: Synthetic oligonucleotide
ucaggccucccgagggag

SEQ ID NO: 37369 - RNA, 18 nt, Artificial Sequence
  Description of Artificial Sequence: Synthetic oligonucleotide
aggccucaggccucccga

SEQ ID NO: 37370 - RNA, 18 nt, Artificial Sequence
  Description of Artificial Sequence: Synthetic oligonucleotide
gguccaggccucaggccu

SEQ ID NO: 37371 - RNA, 18 nt, Artificial Sequence
  Description of Artificial Sequence: Synthetic oligonucleotide
ggguccaggccucaggcc

SEQ ID NO: 37372 - RNA, 18 nt, Artificial Sequence
  Description of Artificial Sequence: Synthetic oligonucleotide
aagugguggccgugaggg

SEQ ID NO: 37373 - RNA, 18 nt, Artificial Sequence
  Description of Artificial Sequence: Synthetic oligonucleotide
uaacuaagugguggccgu

SEQ ID NO: 37374 - RNA, 18 nt, Artificial Sequence
  Description of Artificial Sequence: Synthetic oligonucleotide
cacaauaacuaaguggug

SEQ ID NO: 37375 - RNA, 18 nt, Artificial Sequence
  Description of Artificial Sequence: Synthetic oligonucleotide
cgaggcacaauaacuaag

SEQ ID NO: 37376 - RNA, 18 nt, Artificial Sequence
  Description of Artificial Sequence: Synthetic oligonucleotide
gaaaccgaggcacaauaa

SEQ ID NO: 37377 - RNA, 18 nt, Artificial Sequence
  Description of Artificial Sequence: Synthetic oligonucleotide
aaggagaaaccgaggcac

SEQ ID NO: 37378 - RNA, 18 nt, Artificial Sequence
  Description of Artificial Sequence: Synthetic oligonucleotide
uuuaaaaggagaaaccga

SEQ ID NO: 37379 - RNA, 18 nt, Artificial Sequence
  Description of Artificial Sequence: Synthetic oligonucleotide
cuauuuuuaaaaggagaa

SEQ ID NO: 37380 - RNA, 18 nt, Artificial Sequence
  Description of Artificial Sequence: Synthetic oligonucleotide
accuucuauuuuuaaaag

SEQ ID NO: 37381 - RNA, 18 nt, Artificial Sequence
  Description of Artificial Sequence: Synthetic oligonucleotide
gggaaccuucuauuuuua

SEQ ID NO: 37382 - RNA, 18 nt, Artificial Sequence
  Description of Artificial Sequence: Synthetic oligonucleotide
ucugaugguccucuuggg

SEQ ID NO: 37383 - RNA, 18 nt, Artificial Sequence
  Description of Artificial Sequence: Synthetic oligonucleotide
agcacucugaugguccuc

SEQ ID NO: 37384 - RNA, 18 nt, Artificial Sequence
  Description of Artificial Sequence: Synthetic oligonucleotide
uucagagcacucugaugg

SEQ ID NO: 37385 - RNA, 18 nt, Artificial Sequence
  Description of Artificial Sequence: Synthetic oligonucleotide
caugcuucagagcacucu

SEQ ID NO: 37386 - RNA, 18 nt, Artificial Sequence
  Description of Artificial Sequence: Synthetic oligonucleotide
ccacccaugcuucagagc

SEQ ID NO: 37387 - RNA, 18 nt, Artificial Sequence
  Description of Artificial Sequence: Synthetic oligonucleotide
auuccccacccaugcuuc

SEQ ID NO: 37388 - RNA, 18 nt, Artificial Sequence
  Description of Artificial Sequence: Synthetic oligonucleotide
gcucaauuccccacccau

SEQ ID NO: 37389 - RNA, 18 nt, Artificial Sequence
  Description of Artificial Sequence: Synthetic oligonucleotide
cugaagcucaauucccca

SEQ ID NO: 37390 - RNA, 18 nt, Artificial Sequence
  Description of Artificial Sequence: Synthetic oligonucleotide
uccaccugaagcucaauu

SEQ ID NO: 37391 - RNA, 18 nt, Artificial Sequence
  Description of Artificial Sequence: Synthetic oligonucleotide
ggcuguccaccugaagcu

SEQ ID NO: 37392 - RNA, 18 nt, Artificial Sequence
  Description of Artificial Sequence: Synthetic oligonucleotide
acccuggcuguccaccug

SEQ ID NO: 37393 - RNA, 18 nt, Artificial Sequence
  Description of Artificial Sequence: Synthetic oligonucleotide
ccgaaacccuggcugucc

SEQ ID NO: 37394 - RNA, 18 nt, Artificial Sequence
  Description of Artificial Sequence: Synthetic oligonucleotide
cagugccgaaacccuggc

SEQ ID NO: 37395 - RNA, 18 nt, Artificial Sequence
  Description of Artificial Sequence: Synthetic oligonucleotide
ccccacagugccgaaacc

SEQ ID NO: 37396 - RNA, 18 nt, Artificial Sequence
  Description of Artificial Sequence: Synthetic oligonucleotide
gggccccacagugccgaa

SEQ ID NO: 37397 - RNA, 18 nt, Artificial Sequence
  Description of Artificial Sequence: Synthetic oligonucleotide
guacaacucacuugaggg

SEQ ID NO: 37398 - RNA, 18 nt, Artificial Sequence
  Description of Artificial Sequence: Synthetic oligonucleotide
uccucguacaacucacuu

SEQ ID NO: 37399 - RNA, 18 nt, Artificial Sequence
  Description of Artificial Sequence: Synthetic oligonucleotide
cauccuccucguacaacu

SEQ ID NO: 37400 - RNA, 18 nt, Artificial Sequence
  Description of Artificial Sequence: Synthetic oligonucleotide
cccugcauccuccucgua

SEQ ID NO: 37401 - RNA, 18 nt, Artificial Sequence
  Description of Artificial Sequence: Synthetic oligonucleotide
accgccccugcauccucc

SEQ ID NO: 37402 - RNA, 18 nt, Artificial Sequence
  Description of Artificial Sequence: Synthetic oligonucleotide
aagcaaccgccccugcau

SEQ ID NO: 37403 - RNA, 18 nt, Artificial Sequence
  Description of Artificial Sequence: Synthetic oligonucleotide
aagagaagcaaccgcccc

SEQ ID NO: 37404 - RNA, 18 nt, Artificial Sequence
  Description of Artificial Sequence: Synthetic oligonucleotide
cuccaaagagaagcaacc

SEQ ID NO: 37405 - RNA, 18 nt, Artificial Sequence
  Description of Artificial Sequence: Synthetic oligonucleotide
uaucccuccaaagagaag

SEQ ID NO: 37406 - RNA, 18 nt, Artificial Sequence
  Description of Artificial Sequence: Synthetic oligonucleotide
ccacuuaucccuccaaag

SEQ ID NO: 37407 - RNA, 18 nt, Artificial Sequence
  Description of Artificial Sequence: Synthetic oligonucleotide
accacccacuuaucccuc

SEQ ID NO: 37408 - RNA, 18 nt, Artificial Sequence
  Description of Artificial Sequence: Synthetic oligonucleotide
ucagaaccacccacuuau

SEQ ID NO: 37409 - RNA, 18 nt, Artificial Sequence
  Description of Artificial Sequence: Synthetic oligonucleotide
cauguucagaaccaccca

SEQ ID NO: 37410 - RNA, 18 nt, Artificial Sequence
  Description of Artificial Sequence: Synthetic oligonucleotide
ugcugcauguucagaacc

SEQ ID NO: 37411 - RNA, 18 nt, Artificial Sequence
  Description of Artificial Sequence: Synthetic oligonucleotide
uacccugcugcauguuca

SEQ ID NO: 37412 - RNA, 18 nt, Artificial Sequence
  Description of Artificial Sequence: Synthetic oligonucleotide
cucccuacccugcugcau

SEQ ID NO: 37413 - RNA, 18 nt, Artificial Sequence
  Description of Artificial Sequence: Synthetic oligonucleotide
ccugccucccuacccugc

SEQ ID NO: 37414 - RNA, 18 nt, Artificial Sequence
  Description of Artificial Sequence: Synthetic oligonucleotide
uugccccugccucccuac

SEQ ID NO: 37415 - RNA, 18 nt, Artificial Sequence
  Description of Artificial Sequence: Synthetic oligonucleotide
gcagcuugccccugccuc

SEQ ID NO: 37416 - RNA, 18 nt, Artificial Sequence
  Description of Artificial Sequence: Synthetic oligonucleotide
uaguagcagcuugccccu

SEQ ID NO: 37417 - RNA, 18 nt, Artificial Sequence
  Description of Artificial Sequence: Synthetic oligonucleotide
aaaaauaguagcagcuug

SEQ ID NO: 37418 - RNA, 18 nt, Artificial Sequence
  Description of Artificial Sequence: Synthetic oligonucleotide
aagaaaaaaauaguagca

SEQ ID NO: 37419 - RNA, 18 nt, Artificial Sequence
  Description of Artificial Sequence: Synthetic oligonucleotide
aaaaaaagaaaaaaauag

SEQ ID NO: 37420 - RNA, 18 nt, Artificial Sequence
  Description of Artificial Sequence: Synthetic oligonucleotide
caaaaaaaaaaagaaaaa

SEQ ID NO: 37421 - RNA, 18 nt, Artificial Sequence
  Description of Artificial Sequence: Synthetic oligonucleotide
ugucucaaaaaaaaaaag

SEQ ID NO: 37422 - RNA, 18 nt, Artificial Sequence
  Description of Artificial Sequence: Synthetic oligonucleotide
gacucugucucaaaaaaa

SEQ ID NO: 37423 - RNA, 18 nt, Artificial Sequence
  Description of Artificial Sequence: Synthetic oligonucleotide
agugagacucugucucaa

SEQ ID NO: 37424 - RNA, 18 nt, Artificial Sequence
  Description of Artificial Sequence: Synthetic oligonucleotide
gacagagugagacucugu

SEQ ID NO: 37425 - RNA, 18 nt, Artificial Sequence
  Description of Artificial Sequence: Synthetic oligonucleotide
ugggugacagagugagac

SEQ ID NO: 37426 - RNA, 18 nt, Artificial Sequence
  Description of Artificial Sequence: Synthetic oligonucleotide
cagccugggugacagagu

SEQ ID NO: 37427 - RNA, 18 nt, Artificial Sequence
  Description of Artificial Sequence: Synthetic oligonucleotide
aacuccagccugggugac

SEQ ID NO: 37428 - RNA, 18 nt, Artificial Sequence
  Description of Artificial Sequence: Synthetic oligonucleotide
cacugaacuccagccugg

SEQ ID NO: 37429 - RNA, 18 nt, Artificial Sequence
  Description of Artificial Sequence: Synthetic oligonucleotide
cgcgccacugaacuccag

SEQ ID NO: 37430 - RNA, 18 nt, Artificial Sequence
  Description of Artificial Sequence: Synthetic oligonucleotide
gagaucgcgccacugaac

SEQ ID NO: 37431 - RNA, 18 nt, Artificial Sequence
  Description of Artificial Sequence: Synthetic oligonucleotide
uagcugagaucgcgccac

SEQ ID NO: 37432 - RNA, 18 nt, Artificial Sequence
  Description of Artificial Sequence: Synthetic oligonucleotide
gcaguuagcugagaucgc

SEQ ID NO: 37433 - RNA, 18 nt, Artificial Sequence
  Description of Artificial Sequence: Synthetic oligonucleotide
agguugcaguuagcugag

SEQ ID NO: 37434 - RNA, 18 nt, Artificial Sequence
  Description of Artificial Sequence: Synthetic oligonucleotide
gguggagguugcaguuag

SEQ ID NO: 37435 - RNA, 18 nt, Artificial Sequence
  Description of Artificial Sequence: Synthetic oligonucleotide
cgggagguggagguugca

SEQ ID NO: 37436 - RNA, 18 nt, Artificial Sequence
  Description of Artificial Sequence: Synthetic oligonucleotide
uaacccgggagguggagg

SEQ ID NO: 37437 - RNA, 18 nt, Artificial Sequence
  Description of Artificial Sequence: Synthetic oligonucleotide
cgcuuuaacccgggaggu

SEQ ID NO: 37438 - RNA, 18 nt, Artificial Sequence
  Description of Artificial Sequence: Synthetic oligonucleotide
agaaucgcuuuaacccgg

SEQ ID NO: 37439 - RNA, 18 nt, Artificial Sequence
  Description of Artificial Sequence: Synthetic oligonucleotide
gcaggagaaucgcuuuaa

SEQ ID NO: 37440 - RNA, 18 nt, Artificial Sequence
  Description of Artificial Sequence: Synthetic oligonucleotide
cugaggcaggagaaucgc

SEQ ID NO: 37441 - RNA, 18 nt, Artificial Sequence
  Description of Artificial Sequence: Synthetic oligonucleotide
gguggcugaggcaggaga

SEQ ID NO: 37442 - RNA, 18 nt, Artificial Sequence
  Description of Artificial Sequence: Synthetic oligonucleotide
acucggguggcugaggca

SEQ ID NO: 37443 - RNA, 18 nt, Artificial Sequence
  Description of Artificial Sequence: Synthetic oligonucleotide
cagcuacucggguggcug

SEQ ID NO: 37444 - RNA, 18 nt, Artificial Sequence
  Description of Artificial Sequence: Synthetic oligonucleotide
agucacagcuacucgggu

SEQ ID NO: 37445 - RNA, 18 nt, Artificial Sequence
  Description of Artificial Sequence: Synthetic oligonucleotide
uauguagucacagcuacu

SEQ ID NO: 37446 - RNA, 18 nt, Artificial Sequence
  Description of Artificial Sequence: Synthetic oligonucleotide
ucauauauguagucacag

SEQ ID NO: 37447 - RNA, 18 nt, Artificial Sequence
  Description of Artificial Sequence: Synthetic oligonucleotide
guggcucauauauguagu

SEQ ID NO: 37448 - RNA, 18 nt, Artificial Sequence
  Description of Artificial Sequence: Synthetic oligonucleotide
ccgcccaccugcugcuug

SEQ ID NO: 37449 - RNA, 18 nt, Artificial Sequence
  Description of Artificial Sequence: Synthetic oligonucleotide
cccugccgcccaccugcu

SEQ ID NO: 37450 - RNA, 18 nt, Artificial Sequence
  Description of Artificial Sequence: Synthetic oligonucleotide
ccugccccugccgcccac

SEQ ID NO: 37451 - RNA, 18 nt, Artificial Sequence
  Description of Artificial Sequence: Synthetic oligonucleotide
agcagccugccccugccg

SEQ ID NO: 37452 - RNA, 18 nt, Artificial Sequence
  Description of Artificial Sequence: Synthetic oligonucleotide
ggcacagcagccugcccc

SEQ ID NO: 37453 - RNA, 18 nt, Artificial Sequence
  Description of Artificial Sequence: Synthetic oligonucleotide
ucacgggcacagcagccu

SEQ ID NO: 37454 - RNA, 18 nt, Artificial Sequence
  Description of Artificial Sequence: Synthetic oligonucleotide
uauccucacgggcacagc

SEQ ID NO: 37455 - RNA, 18 nt, Artificial Sequence
  Description of Artificial Sequence: Synthetic oligonucleotide
ccuccuauccucacgggc

SEQ ID NO: 37456 - RNA, 18 nt, Artificial Sequence
  Description of Artificial Sequence: Synthetic oligonucleotide
gcucuccuccuauccuca

SEQ ID NO: 37457 - RNA, 18 nt, Artificial Sequence
  Description of Artificial Sequence: Synthetic oligonucleotide
ccccagcucuccuccuau

SEQ ID NO: 37458 - RNA, 18 nt, Artificial Sequence
  Description of Artificial Sequence: Synthetic oligonucleotide
agcacccccagcucuccu

SEQ ID NO: 37459 - RNA, 18 nt, Artificial Sequence
  Description of Artificial Sequence: Synthetic oligonucleotide
caggcagcacccccagcu

SEQ ID NO: 37460 - RNA, 18 nt, Artificial Sequence
  Description of Artificial Sequence: Synthetic oligonucleotide
ccacacaggcagcacccc

SEQ ID NO: 37461 - RNA, 18 nt, Artificial Sequence
  Description of Artificial Sequence: Synthetic oligonucleotide
guuucccacacaggcagc

SEQ ID NO: 37462 - RNA, 18 nt, Artificial Sequence
  Description of Artificial Sequence: Synthetic oligonucleotide
cugcuguuucccacacag

SEQ ID NO: 37463 - RNA, 18 nt, Artificial Sequence
  Description of Artificial Sequence: Synthetic oligonucleotide
ucuuucugcuguuuccca

SEQ ID NO: 37464 - RNA, 18 nt, Artificial Sequence
  Description of Artificial Sequence: Synthetic oligonucleotide
cuccaucuuucugcuguu

SEQ ID NO: 37465 - RNA, 18 nt, Artificial Sequence
  Description of Artificial Sequence: Synthetic oligonucleotide
accuucuccaucuuucug

SEQ ID NO: 37466 - RNA, 18 nt, Artificial Sequence
  Description of Artificial Sequence: Synthetic oligonucleotide
uuucuaccuucuccaucu

SEQ ID NO: 37467 - RNA, 18 nt, Artificial Sequence
  Description of Artificial Sequence: Synthetic oligonucleotide
aauauuuucuaccuucuc

SEQ ID NO: 37468 - RNA, 18 nt, Artificial Sequence
  Description of Artificial Sequence: Synthetic oligonucleotide
caguaaauauuuucuacc

SEQ ID NO: 37469 - RNA, 18 nt, Artificial Sequence
  Description of Artificial Sequence: Synthetic oligonucleotide
acagacaguaaauauuuu

SEQ ID NO: 37470 - RNA, 18 nt, Artificial Sequence
  Description of Artificial Sequence: Synthetic oligonucleotide
auggaacagacaguaaau

SEQ ID NO: 37471 - RNA, 18 nt, Artificial Sequence
  Description of Artificial Sequence: Synthetic oligonucleotide
uaacaauggaacagacag

SEQ ID NO: 37472 - RNA, 18 nt, Artificial Sequence
  Description of Artificial Sequence: Synthetic oligonucleotide
gagauuaacaauggaaca

SEQ ID NO: 37473 - RNA, 18 nt, Artificial Sequence
  Description of Artificial Sequence: Synthetic oligonucleotide
uccgagagauuaacaaug

SEQ ID NO: 37474 - RNA, 18 nt, Artificial Sequence
  Description of Artificial Sequence: Synthetic oligonucleotide
gaauuuccgagagauuaa

SEQ ID NO: 37475 - RNA, 18 nt, Artificial Sequence
  Description of Artificial Sequence: Synthetic oligonucleotide
uaggagaauuuccgagag

SEQ ID NO: 37476 - RNA, 18 nt, Artificial Sequence
  Description of Artificial Sequence: Synthetic oligonucleotide
aaaaauaggagaauuucc

SEQ ID NO: 37477 - RNA, 18 nt, Artificial Sequence
  Description of Artificial Sequence: Synthetic oligonucleotide
ucaacaaaaauaggagaa

SEQ ID NO: 37478 - RNA, 18 nt, Artificial Sequence
  Description of Artificial Sequence: Synthetic oligonucleotide
aaaguucaacaaaaauag

SEQ ID NO: 37479 - RNA, 18 nt, Artificial Sequence
  Description of Artificial Sequence: Synthetic oligonucleotide
gggucaaaguucaacaaa

SEQ ID NO: 37480 - RNA, 18 nt, Artificial Sequence
  Description of Artificial Sequence: Synthetic oligonucleotide
agaccugcccuuucuggg

SEQ ID NO: 37481 - RNA, 18 nt, Artificial Sequence
  Description of Artificial Sequence: Synthetic oligonucleotide
aaagaccugcccuuucug

SEQ ID NO: 37482 - RNA, 18 nt, Artificial Sequence
  Description of Artificial Sequence: Synthetic oligonucleotide
gggcuaaagaccugcccu

SEQ ID NO: 37483 - RNA, 18 nt, Artificial Sequence
  Description of Artificial Sequence: Synthetic oligonucleotide
gcagagucagguaaaggg

SEQ ID NO: 37484 - RNA, 18 nt, Artificial Sequence
  Description of Artificial Sequence: Synthetic oligonucleotide
cuggcagagucagguaaa

SEQ ID NO: 37485 - RNA, 18 nt, Artificial Sequence
  Description of Artificial Sequence: Synthetic oligonucleotide
ccacacuggcagagucag

SEQ ID NO: 37486 - RNA, 18 nt, Artificial Sequence
  Description of Artificial Sequence: Synthetic oligonucleotide
ccaggccacacuggcaga

SEQ ID NO: 37487 - RNA, 18 nt, Artificial Sequence
  Description of Artificial Sequence: Synthetic oligonucleotide
guuuuccaggccacacug

SEQ ID NO: 37488 - RNA, 18 nt, Artificial Sequence
  Description of Artificial Sequence: Synthetic oligonucleotide
guaccguuuuccaggcca

SEQ ID NO: 37489 - RNA, 18 nt, Artificial Sequence
  Description of Artificial Sequence: Synthetic oligonucleotide
aggagguaccguuuucca

SEQ ID NO: 37490 - RNA, 18 nt, Artificial Sequence
  Description of Artificial Sequence: Synthetic oligonucleotide
aucccaggagguaccguu

SEQ ID NO: 37491 - RNA, 18 nt, Artificial Sequence
  Description of Artificial Sequence: Synthetic oligonucleotide
acaagaucccaggaggua

SEQ ID NO: 37492 - RNA, 18 nt, Artificial Sequence
  Description of Artificial Sequence: Synthetic oligonucleotide
gagcuacaagaucccagg

SEQ ID NO: 37493 - RNA, 18 nt, Artificial Sequence
  Description of Artificial Sequence: Synthetic oligonucleotide
gcagagagcuacaagauc

SEQ ID NO: 37494 - RNA, 18 nt, Artificial Sequence
  Description of Artificial Sequence: Synthetic oligonucleotide
ucucagcagagagcuaca

SEQ ID NO: 37495 - RNA, 18 nt, Artificial Sequence
  Description of Artificial Sequence: Synthetic oligonucleotide
uugccucucagcagagag

SEQ ID NO: 37496 - RNA, 18 nt, Artificial Sequence
  Description of Artificial Sequence: Synthetic oligonucleotide
ccccauugccucucagca

SEQ ID NO: 37497 - RNA, 18 nt, Artificial Sequence
  Description of Artificial Sequence: Synthetic oligonucleotide
agcggccccauugccucu

SEQ ID NO: 37498 - RNA, 18 nt, Artificial Sequence
  Description of Artificial Sequence: Synthetic oligonucleotide
caaagagcggccccauug

SEQ ID NO: 37499 - RNA, 18 nt, Artificial Sequence
  Description of Artificial Sequence: Synthetic oligonucleotide
gaccccaaagagcggccc

SEQ ID NO: 37500 - RNA, 18 nt, Artificial Sequence
  Description of Artificial Sequence: Synthetic oligonucleotide
ggauugaccccaaagagc

SEQ ID NO: 37501 - RNA, 18 nt, Artificial Sequence
  Description of Artificial Sequence: Synthetic oligonucleotide
agcugggauugaccccaa

SEQ ID NO: 37502 - RNA, 18 nt, Artificial Sequence
  Description of Artificial Sequence: Synthetic oligonucleotide
agaagagcugggauugac

SEQ ID NO: 37503 - RNA, 18 nt, Artificial Sequence
  Description of Artificial Sequence: Synthetic oligonucleotide
uccugagaagagcuggga

SEQ ID NO: 37504 - RNA, 18 nt, Artificial Sequence
  Description of Artificial Sequence: Synthetic oligonucleotide
agaacuccugagaagagc

SEQ ID NO: 37505 - RNA, 18 nt, Artificial Sequence
  Description of Artificial Sequence: Synthetic oligonucleotide
gucacagaacuccugaga

SEQ ID NO: 37506 - RNA, 18 nt, Artificial Sequence
  Description of Artificial Sequence: Synthetic oligonucleotide
ccacagucacagaacucc

SEQ ID NO: 37507 - RNA, 18 nt, Artificial Sequence
  Description of Artificial Sequence: Synthetic oligonucleotide
cugucccacagucacaga

SEQ ID NO: 37508 - RNA, 18 nt, Artificial Sequence
  Description of Artificial Sequence: Synthetic oligonucleotide
cuuuucugucccacaguc

SEQ ID NO: 37509 - RNA, 18 nt, Artificial Sequence
  Description of Artificial Sequence: Synthetic oligonucleotide
agaagcuuuucuguccca

SEQ ID NO: 37510 - RNA, 18 nt, Artificial Sequence
  Description of Artificial Sequence: Synthetic oligonucleotide
cucugagaagcuuuucug

SEQ ID NO: 37511 - RNA, 18 nt, Artificial Sequence
  Description of Artificial Sequence: Synthetic oligonucleotide
gaugucucugagaagcuu

SEQ ID NO: 37512 - RNA, 18 nt, Artificial Sequence
  Description of Artificial Sequence: Synthetic oligonucleotide
gaugagaugucucugaga

SEQ ID NO: 37513 - RNA, 18 nt, Artificial Sequence
  Description of Artificial Sequence: Synthetic oligonucleotide
cuucugaugagaugucuc

SEQ ID NO: 37514 - RNA, 18 nt, Artificial Sequence
  Description of Artificial Sequence: Synthetic oligonucleotide
ccccgcuucugaugagau

SEQ ID NO: 37515 - RNA, 18 nt, Artificial Sequence
  Description of Artificial Sequence: Synthetic oligonucleotide
aucacccccgcuucugau

SEQ ID NO: 37516 - RNA, 18 nt, Artificial Sequence
  Description of Artificial Sequence: Synthetic oligonucleotide
guguaaucacccccgcuu

SEQ ID NO: 37517 - RNA, 18 nt, Artificial Sequence
  Description of Artificial Sequence: Synthetic oligonucleotide
ccucaguguaaucacccc

SEQ ID NO: 37518 - RNA, 18 nt, Artificial Sequence
  Description of Artificial Sequence: Synthetic oligonucleotide
cacuaccucaguguaauc

SEQ ID NO: 37519 - RNA, 18 nt, Artificial Sequence
  Description of Artificial Sequence: Synthetic oligonucleotide
ggugucacuaccucagug

SEQ ID NO: 37520 - RNA, 18 nt, Artificial Sequence
  Description of Artificial Sequence: Synthetic oligonucleotide
ccugcggugucacuaccu

SEQ ID NO: 37521 - RNA, 18 nt, Artificial Sequence
  Description of Artificial Sequence: Synthetic oligonucleotide
cccugccugcggugucac

SEQ ID NO: 37522 - RNA, 18 nt, Artificial Sequence
  Description of Artificial Sequence: Synthetic oligonucleotide
aauggcccugccugcggu

SEQ ID NO: 37523 - RNA, 18 nt, Artificial Sequence
  Description of Artificial Sequence: Synthetic oligonucleotide
augggaauggcccugccu

SEQ ID NO: 37524 - RNA, 18 nt, Artificial Sequence
  Description of Artificial Sequence: Synthetic oligonucleotide
guaauaugggaauggccc

SEQ ID NO: 37525 - RNA, 18 nt, Artificial Sequence
  Description of Artificial Sequence: Synthetic oligonucleotide
aucauguaauaugggaau

SEQ ID NO: 37526 - RNA, 18 nt, Artificial Sequence
  Description of Artificial Sequence: Synthetic oligonucleotide
gcuggaucauguaauaug

SEQ ID NO: 37527 - RNA, 18 nt, Artificial Sequence
  Description of Artificial Sequence: Synthetic oligonucleotide
aagacgcuggaucaugua

SEQ ID NO: 37528 - RNA, 18 nt, Artificial Sequence
  Description of Artificial Sequence: Synthetic oligonucleotide
uguggaagacgcuggauc

SEQ ID NO: 37529 - RNA, 18 nt, Artificial Sequence
  Description of Artificial Sequence: Synthetic oligonucleotide
cucuguguggaagacgcu

SEQ ID NO: 37530 - RNA, 18 nt, Artificial Sequence
  Description of Artificial Sequence: Synthetic oligonucleotide
acgggcucuguguggaag

SEQ ID NO: 37531 - RNA, 18 nt, Artificial Sequence
  Description of Artificial Sequence: Synthetic oligonucleotide
ugggcacgggcucugugu

SEQ ID NO: 37532 - RNA, 18 nt, Artificial Sequence
  Description of Artificial Sequence: Synthetic oligonucleotide
accugugggcacgggcuc

SEQ ID NO: 37533 - RNA, 18 nt, Artificial Sequence
  Description of Artificial Sequence: Synthetic oligonucleotide
cacccaccugugggcacg

SEQ ID NO: 37534 - RNA, 18 nt, Artificial Sequence
  Description of Artificial Sequence: Synthetic oligonucleotide
uggaccacccaccugugg

SEQ ID NO: 37535 - RNA, 18 nt, Artificial Sequence
  Description of Artificial Sequence: Synthetic oligonucleotide
gagcguggaccacccacc

SEQ ID NO: 37536 - RNA, 18 nt, Artificial Sequence
  Description of Artificial Sequence: Synthetic oligonucleotide
uucuggagcguggaccac

SEQ ID NO: 37537 - RNA, 18 nt, Artificial Sequence
  Description of Artificial Sequence: Synthetic oligonucleotide
uguguuucuggagcgugg

SEQ ID NO: 37538 - RNA, 18 nt, Artificial Sequence
  Description of Artificial Sequence: Synthetic oligonucleotide
gugcguguguuucuggag

SEQ ID NO: 37539 - RNA, 18 nt, Artificial Sequence
  Description of Artificial Sequence: Synthetic oligonucleotide
uggcugugcguguguuuc

SEQ ID NO: 37540 - RNA, 18 nt, Artificial Sequence
  Description of Artificial Sequence: Synthetic oligonucleotide
auggauggcugugcgugu

SEQ ID NO: 37541 - RNA, 18 nt, Artificial Sequence
  Description of Artificial Sequence: Synthetic oligonucleotide
gggagauggauggcugug

SEQ ID NO: 37542 - RNA, 18 nt, Artificial Sequence
  Description of Artificial Sequence: Synthetic oligonucleotide
cagcucaucgaaacaggc

SEQ ID NO: 37543 - RNA, 18 nt, Artificial Sequence
  Description of Artificial Sequence: Synthetic oligonucleotide
gacugcagcucaucgaaa

SEQ ID NO: 37544 - RNA, 18 nt, Artificial Sequence
  Description of Artificial Sequence: Synthetic oligonucleotide
acucggacugcagcucau

SEQ ID NO: 37545 - RNA, 18 nt, Artificial Sequence
  Description of Artificial Sequence: Synthetic oligonucleotide
cagguacucggacugcag

SEQ ID NO: 37546 - RNA, 18 nt, Artificial Sequence
  Description of Artificial Sequence: Synthetic oligonucleotide
agcaucagguacucggac

SEQ ID NO: 37547 - RNA, 18 nt, Artificial Sequence
  Description of Artificial Sequence: Synthetic oligonucleotide
gccacagcaucagguacu

SEQ ID NO: 37548 - RNA, 18 nt, Artificial Sequence
  Description of Artificial Sequence: Synthetic oligonucleotide
gaccagccacagcaucag

SEQ ID NO: 37549 - RNA, 18 nt, Artificial Sequence
  Description of Artificial Sequence: Synthetic oligonucleotide
uccaggaccagccacagc

SEQ ID NO: 37550 - RNA, 18 nt, Artificial Sequence
  Description of Artificial Sequence: Synthetic oligonucleotide
aguaguccaggaccagcc

SEQ ID NO: 37551 - RNA, 18 nt, Artificial Sequence
  Description of Artificial Sequence: Synthetic oligonucleotide
ugccgaguaguccaggac

SEQ ID NO: 37552 - RNA, 18 nt, Artificial Sequence
  Description of Artificial Sequence: Synthetic oligonucleotide
acaucugccgaguagucc

SEQ ID NO: 37553 - RNA, 18 nt, Artificial Sequence
  Description of Artificial Sequence: Synthetic oligonucleotide
acaggacaucugccgagu

SEQ ID NO: 37554 - RNA, 18 nt, Artificial Sequence
  Description of Artificial Sequence: Synthetic oligonucleotide
gacauacaggacaucugc

SEQ ID NO: 37555 - RNA, 18 nt, Artificial Sequence
  Description of Artificial Sequence: Synthetic oligonucleotide
uccaagacauacaggaca

SEQ ID NO: 37556 - RNA, 18 nt, Artificial Sequence
  Description of Artificial Sequence: Synthetic oligonucleotide
gcacauccaagacauaca

SEQ ID NO: 37557 - RNA, 18 nt, Artificial Sequence
  Description of Artificial Sequence: Synthetic oligonucleotide
uacaagcacauccaagac

SEQ ID NO: 37558 - RNA, 18 nt, Artificial Sequence
  Description of Artificial Sequence: Synthetic oligonucleotide
gcucguacaagcacaucc

SEQ ID NO: 37559 - RNA, 18 nt, Artificial Sequence
  Description of Artificial Sequence: Synthetic oligonucleotide
uccgagcucguacaagca

SEQ ID NO: 37560 - RNA, 18 nt, Artificial Sequence
  Description of Artificial Sequence: Synthetic oligonucleotide
agaauagcacgcucgcca

SEQ ID NO: 37561 - RNA, 18 nt, Artificial Sequence
  Description of Artificial Sequence: Synthetic oligonucleotide
ccaguagaauagcacgcu

SEQ ID NO: 37562 - RNA, 18 nt, Artificial Sequence
  Description of Artificial Sequence: Synthetic oligonucleotide
uccucccaguagaauagc

SEQ ID NO: 37563 - RNA, 18 nt, Artificial Sequence
  Description of Artificial Sequence: Synthetic oligonucleotide
augaguccucccaguaga

SEQ ID NO: 37564 - RNA, 18 nt, Artificial Sequence
  Description of Artificial Sequence: Synthetic oligonucleotide
caacgaugaguccuccca

SEQ ID NO: 37565 - RNA, 18 nt, Artificial Sequence
  Description of Artificial Sequence: Synthetic oligonucleotide
ccauacaacgaugagucc

SEQ ID NO: 37566 - RNA, 18 nt, Artificial Sequence
  Description of Artificial Sequence: Synthetic oligonucleotide
ccaacccauacaacgaug

SEQ ID NO: 37567 - RNA, 18 nt, Artificial Sequence
  Description of Artificial Sequence: Synthetic oligonucleotide
agaagccaacccauacaa

SEQ ID NO: 37568 - RNA, 18 nt, Artificial Sequence
  Description of Artificial Sequence: Synthetic oligonucleotide
gauaaagaagccaaccca

SEQ ID NO: 37569 - RNA, 18 nt, Artificial Sequence
  Description of Artificial Sequence: Synthetic oligonucleotide
aacaagauaaagaagcca

SEQ ID NO: 37570 - RNA, 18 nt, Artificial Sequence
  Description of Artificial Sequence: Synthetic oligonucleotide
aagguaacaagauaaaga

SEQ ID NO: 37571 - RNA, 18 nt, Artificial Sequence
  Description of Artificial Sequence: Synthetic oligonucleotide
uccccaagguaacaagau

SEQ ID NO: 37572 - RNA, 18 nt, Artificial Sequence
  Description of Artificial Sequence: Synthetic oligonucleotide
ugauuuccccaagguaac

SEQ ID NO: 37573 - RNA, 18 nt, Artificial Sequence
  Description of Artificial Sequence: Synthetic oligonucleotide
gaaauugauuuccccaag

SEQ ID NO: 37574 - RNA, 18 nt, Artificial Sequence
  Description of Artificial Sequence: Synthetic oligonucleotide
uuugggaaauugauuucc

SEQ ID NO: 37575 - RNA, 18 nt, Artificial Sequence
  Description of Artificial Sequence: Synthetic oligonucleotide
uguauuuugggaaauuga

SEQ ID NO: 37576 - RNA, 18 nt, Artificial Sequence
  Description of Artificial Sequence: Synthetic oligonucleotide
cccacuguauuuugggaa

SEQ ID NO: 37577 - RNA, 18 nt, Artificial Sequence
  Description of Artificial Sequence: Synthetic oligonucleotide
uauagaauuauguauggc

SEQ ID NO: 37578 - RNA, 18 nt, Artificial Sequence
  Description of Artificial Sequence: Synthetic oligonucleotide
aacauuauagaauuaugu

SEQ ID NO: 37579 - RNA, 18 nt, Artificial Sequence
  Description of Artificial Sequence: Synthetic oligonucleotide
agguuaacauuauagaau

SEQ ID NO: 37580 - RNA, 18 nt, Artificial Sequence
  Description of Artificial Sequence: Synthetic oligonucleotide
aacagagguuaacauuau

SEQ ID NO: 37581 - RNA, 18 nt, Artificial Sequence
  Description of Artificial Sequence: Synthetic oligonucleotide
uaaauaacagagguuaac

SEQ ID NO: 37582 - RNA, 18 nt, Artificial Sequence
  Description of Artificial Sequence: Synthetic oligonucleotide
uuagauaaauaacagagg

SEQ ID NO: 37583 - RNA, 18 nt, Artificial Sequence
  Description of Artificial Sequence: Synthetic oligonucleotide
ugauuuuagauaaauaac

SEQ ID NO: 37584 - RNA, 18 nt, Artificial Sequence
  Description of Artificial Sequence: Synthetic oligonucleotide
cuuguugauuuuagauaa

SEQ ID NO: 37585 - RNA, 18 nt, Artificial Sequence
  Description of Artificial Sequence: Synthetic oligonucleotide
cauuacuuguugauuuua

SEQ ID NO: 37586 - RNA, 18 nt, Artificial Sequence
  Description of Artificial Sequence: Synthetic oligonucleotide
cagugcauuacuuguuga

SEQ ID NO: 37587 - RNA, 18 nt, Artificial Sequence
  Description of Artificial Sequence: Synthetic oligonucleotide
cauugcagugcauuacuu

SEQ ID NO: 37588 - RNA, 18 nt, Artificial Sequence
  Description of Artificial Sequence: Synthetic oligonucleotide
agguuaacauuauagaau

SEQ ID NO: 37589 - RNA, 18 nt, Artificial Sequence
  Description of Artificial Sequence: Synthetic oligonucleotide
aacagagguuaacauuau

SEQ ID NO: 37590 - RNA, 18 nt, Artificial Sequence
  Description of Artificial Sequence: Synthetic oligonucleotide
uaaauaacagagguuaac

SEQ ID NO: 37591 - RNA, 18 nt, Artificial Sequence
  Description of Artificial Sequence: Synthetic oligonucleotide
uuagauaaauaacagagg

SEQ ID NO: 37592 - RNA, 18 nt, Artificial Sequence
  Description of Artificial Sequence: Synthetic oligonucleotide
ugauuuuagauaaauaac

SEQ ID NO: 37593 - RNA, 18 nt, Artificial Sequence
  Description of Artificial Sequence: Synthetic oligonucleotide
cuuguugauuuuagauaa

SEQ ID NO: 37594 - RNA, 18 nt, Artificial Sequence
  Description of Artificial Sequence: Synthetic oligonucleotide
cauuacuuguugauuuua

SEQ ID NO: 37595 - RNA, 18 nt, Artificial Sequence
  Description of Artificial Sequence: Synthetic oligonucleotide
cagugcauuacuuguuga

SEQ ID NO: 37596 - RNA, 18 nt, Artificial Sequence
  Description of Artificial Sequence: Synthetic oligonucleotide
cauugcagugcauuacuu

SEQ ID NO: 37597 - RNA, 18 nt, Artificial Sequence
  Description of Artificial Sequence: Synthetic oligonucleotide
auugaauuauugugcaaa

SEQ ID NO: 37598 - RNA, 18 nt, Artificial Sequence
  Description of Artificial Sequence: Synthetic oligonucleotide
uagggauugaauuauugu

SEQ ID NO: 37599 - RNA, 18 nt, Artificial Sequence
  Description of Artificial Sequence: Synthetic oligonucleotide
gguauuagggauugaauu

SEQ ID NO: 37600 - RNA, 18 nt, Artificial Sequence
  Description of Artificial Sequence: Synthetic oligonucleotide
aaugugguauuagggauu

SEQ ID NO: 37601 - RNA, 18 nt, Artificial Sequence
  Description of Artificial Sequence: Synthetic oligonucleotide
ccccaaaugugguauuag

SEQ ID NO: 37602 - RNA, 18 nt, Artificial Sequence
  Description of Artificial Sequence: Synthetic oligonucleotide
aauuuccccaaauguggu

SEQ ID NO: 37603 - RNA, 18 nt, Artificial Sequence
  Description of Artificial Sequence: Synthetic oligonucleotide
auaauaauuuccccaaau

SEQ ID NO: 37604 - RNA, 18 nt, Artificial Sequence
  Description of Artificial Sequence: Synthetic oligonucleotide
gaccaauaauaauuuccc

SEQ ID NO: 37605 - RNA, 18 nt, Artificial Sequence
  Description of Artificial Sequence: Synthetic oligonucleotide
ccaaagaccaauaauaau

SEQ ID NO: 37606 - RNA, 18 nt, Artificial Sequence
  Description of Artificial Sequence: Synthetic oligonucleotide
gacuuccaaagaccaaua

SEQ ID NO: 37607 - RNA, 18 nt, Artificial Sequence
  Description of Artificial Sequence: Synthetic oligonucleotide
uuggagacuuccaaagac

SEQ ID NO: 37608 - RNA, 18 nt, Artificial Sequence
  Description of Artificial Sequence: Synthetic oligonucleotide
uuccauuggagacuucca

SEQ ID NO: 37609 - RNA, 18 nt, Artificial Sequence
  Description of Artificial Sequence: Synthetic oligonucleotide
ucaucuuccauuggagac

SEQ ID NO: 37610 - RNA, 18 nt, Artificial Sequence
  Description of Artificial Sequence: Synthetic oligonucleotide
cauugucaucuuccauug

SEQ ID NO: 37611 - RNA, 18 nt, Artificial Sequence
  Description of Artificial Sequence: Synthetic oligonucleotide
ucuuucauugucaucuuc

SEQ ID NO: 37612 - RNA, 18 nt, Artificial Sequence
  Description of Artificial Sequence: Synthetic oligonucleotide
guuggucuuucauuguca

SEQ ID NO: 37613 - RNA, 18 nt, Artificial Sequence
  Description of Artificial Sequence: Synthetic oligonucleotide
aaccaguuggucuuucau

SEQ ID NO: 37614 - RNA, 18 nt, Artificial Sequence
  Description of Artificial Sequence: Synthetic oligonucleotide
cgagcaaccaguuggucu

SEQ ID NO: 37615 - RNA, 18 nt, Artificial Sequence
  Description of Artificial Sequence: Synthetic oligonucleotide
ucaaucgagcaaccaguu

SEQ ID NO: 37616 - RNA, 18 nt, Artificial Sequence
  Description of Artificial Sequence: Synthetic oligonucleotide
cuuguucaaucgagcaac

SEQ ID NO: 37617 - RNA, 18 nt, Artificial Sequence
  Description of Artificial Sequence: Synthetic oligonucleotide
ccaggcuuguucaaucga

SEQ ID NO: 37618 - RNA, 18 nt, Artificial Sequence
  Description of Artificial Sequence: Synthetic oligonucleotide
aggcaccaggcuuguuca

SEQ ID NO: 37619 - RNA, 18 nt, Artificial Sequence
  Description of Artificial Sequence: Synthetic oligonucleotide
uguagaggcaccaggcuu

SEQ ID NO: 37620 - RNA, 18 nt, Artificial Sequence
  Description of Artificial Sequence: Synthetic oligonucleotide
ggguguagaggcaccagg

SEQ ID NO: 37621 - RNA, 18 nt, Artificial Sequence
  Description of Artificial Sequence: Synthetic oligonucleotide
gccagaugaaucaccggg

SEQ ID NO: 37622 - RNA, 18 nt, Artificial Sequence
  Description of Artificial Sequence: Synthetic oligonucleotide
acugggccagaugaauca

SEQ ID NO: 37623 - RNA, 18 nt, Artificial Sequence
  Description of Artificial Sequence: Synthetic oligonucleotide
aaggaacugggccagaug

SEQ ID NO: 37624 - RNA, 18 nt, Artificial Sequence
  Description of Artificial Sequence: Synthetic oligonucleotide
gauguaaggaacugggcc

SEQ ID NO: 37625 - RNA, 18 nt, Artificial Sequence
  Description of Artificial Sequence: Synthetic oligonucleotide
cagcugauguaaggaacu

SEQ ID NO: 37626 - RNA, 18 nt, Artificial Sequence
  Description of Artificial Sequence: Synthetic oligonucleotide
uagcacagcugauguaag

SEQ ID NO: 37627 - RNA, 18 nt, Artificial Sequence
  Description of Artificial Sequence: Synthetic oligonucleotide
ccuauuagcacagcugau

SEQ ID NO: 37628 - RNA, 18 nt, Artificial Sequence
  Description of Artificial Sequence: Synthetic oligonucleotide
cuaauccuauuagcacag

SEQ ID NO: 37629 - RNA, 18 nt, Artificial Sequence
  Description of Artificial Sequence: Synthetic oligonucleotide
auagccuaauccuauuag

SEQ ID NO: 37630 - RNA, 18 nt, Artificial Sequence
  Description of Artificial Sequence: Synthetic oligonucleotide
acuggauagccuaauccu

SEQ ID NO: 37631 - RNA, 18 nt, Artificial Sequence
  Description of Artificial Sequence: Synthetic oligonucleotide
ugcagacuggauagccua

SEQ ID NO: 37632 - RNA, 18 nt, Artificial Sequence
  Description of Artificial Sequence: Synthetic oligonucleotide
aagauugcagacuggaua

SEQ ID NO: 37633 - RNA, 18 nt, Artificial Sequence
  Description of Artificial Sequence: Synthetic oligonucleotide
gacauaagauugcagacu

SEQ ID NO: 37634 - RNA, 18 nt, Artificial Sequence
  Description of Artificial Sequence: Synthetic oligonucleotide
uauaggacauaagauugc

SEQ ID NO: 37635 - RNA, 18 nt, Artificial Sequence
  Description of Artificial Sequence: Synthetic oligonucleotide
uagaguauaggacauaag

SEQ ID NO: 37636 - RNA, 18 nt, Artificial Sequence
  Description of Artificial Sequence: Synthetic oligonucleotide
gaauauagaguauaggac

SEQ ID NO: 37637 - RNA, 18 nt, Artificial Sequence
  Description of Artificial Sequence: Synthetic oligonucleotide
uuuuugaauauagaguau

SEQ ID NO: 37638 - RNA, 18 nt, Artificial Sequence
  Description of Artificial Sequence: Synthetic oligonucleotide
uagaauuuuugaauauag

SEQ ID NO: 37639 - RNA, 18 nt, Artificial Sequence
  Description of Artificial Sequence: Synthetic oligonucleotide
gguccuagaauuuuugaa

SEQ ID NO: 37640 - RNA, 18 nt, Artificial Sequence
  Description of Artificial Sequence: Synthetic oligonucleotide
guuuugguccuagaauuu

SEQ ID NO: 37641 - RNA, 18 nt, Artificial Sequence
  Description of Artificial Sequence: Synthetic oligonucleotide
cugagguuuugguccuag

SEQ ID NO: 37642 - RNA, 18 nt, Artificial Sequence
  Description of Artificial Sequence: Synthetic oligonucleotide
gggauugaauuauugugc

SEQ ID NO: 37643 - RNA, 18 nt, Artificial Sequence
  Description of Artificial Sequence: Synthetic oligonucleotide
uauuagggauugaauuau

SEQ ID NO: 37644 - RNA, 18 nt, Artificial Sequence
  Description of Artificial Sequence: Synthetic oligonucleotide
ugugguauuagggauuga

SEQ ID NO: 37645 - RNA, 18 nt, Artificial Sequence
  Description of Artificial Sequence: Synthetic oligonucleotide
ccaaaugugguauuaggg

SEQ ID NO: 37646 - RNA, 18 nt, Artificial Sequence
  Description of Artificial Sequence: Synthetic oligonucleotide
uuuccccaaaugugguau

SEQ ID NO: 37647 - RNA, 18 nt, Artificial Sequence
  Description of Artificial Sequence: Synthetic oligonucleotide
aauaauuuccccaaaugu

SEQ ID NO: 37648 - RNA, 18 nt, Artificial Sequence
  Description of Artificial Sequence: Synthetic oligonucleotide
ccaauaauaauuucccca

SEQ ID NO: 37649 - RNA, 18 nt, Artificial Sequence
  Description of Artificial Sequence: Synthetic oligonucleotide
aaagaccaauaauaauuu

SEQ ID NO: 37650 - RNA, 18 nt, Artificial Sequence
  Description of Artificial Sequence: Synthetic oligonucleotide
cuuccaaagaccaauaau

SEQ ID NO: 37651 - RNA, 18 nt, Artificial Sequence
  Description of Artificial Sequence: Synthetic oligonucleotide
ggagacuuccaaagacca

SEQ ID NO: 37652 - RNA, 18 nt, Artificial Sequence
  Description of Artificial Sequence: Synthetic oligonucleotide
ccauuggagacuuccaaa

SEQ ID NO: 37653 - RNA, 18 nt, Artificial Sequence
  Description of Artificial Sequence: Synthetic oligonucleotide
aucuuccauuggagacuu

SEQ ID NO: 37654 - RNA, 18 nt, Artificial Sequence
  Description of Artificial Sequence: Synthetic oligonucleotide
uugucaucuuccauugga

SEQ ID NO: 37655 - RNA, 18 nt, Artificial Sequence
  Description of Artificial Sequence: Synthetic oligonucleotide
uuucauugucaucuucca

SEQ ID NO: 37656 - RNA, 18 nt, Artificial Sequence
  Description of Artificial Sequence: Synthetic oligonucleotide
uggucuuucauugucauc

SEQ ID NO: 37657 - RNA, 18 nt, Artificial Sequence
  Description of Artificial Sequence: Synthetic oligonucleotide
ccaguuggucuuucauug

SEQ ID NO: 37658 - RNA, 18 nt, Artificial Sequence
  Description of Artificial Sequence: Synthetic oligonucleotide
agcaaccaguuggucuuu

SEQ ID NO: 37659 - RNA, 18 nt, Artificial Sequence
  Description of Artificial Sequence: Synthetic oligonucleotide
aaucgagcaaccaguugg

SEQ ID NO: 37660 - RNA, 18 nt, Artificial Sequence
  Description of Artificial Sequence: Synthetic oligonucleotide
uguucaaucgagcaacca

SEQ ID NO: 37661 - RNA, 18 nt, Artificial Sequence
  Description of Artificial Sequence: Synthetic oligonucleotide
aggcuuguucaaucgagc

SEQ ID NO: 37662 - RNA, 18 nt, Artificial Sequence
  Description of Artificial Sequence: Synthetic oligonucleotide
gcaccaggcuuguucaau

SEQ ID NO: 37663 - RNA, 18 nt, Artificial Sequence
  Description of Artificial Sequence: Synthetic oligonucleotide
uagaggcaccaggcuugu

SEQ ID NO: 37664 - RNA, 18 nt, Artificial Sequence
  Description of Artificial Sequence: Synthetic oligonucleotide
ggguguagaggcaccagg

SEQ ID NO: 37665 - RNA, 18 nt, Artificial Sequence
  Description of Artificial Sequence: Synthetic oligonucleotide
gccagaugaaucaccggg

SEQ ID NO: 37666 - RNA, 18 nt, Artificial Sequence
  Description of Artificial Sequence: Synthetic oligonucleotide
gggccagaugaaucaccg

SEQ ID NO: 37667 - RNA, 18 nt, Artificial Sequence
  Description of Artificial Sequence: Synthetic oligonucleotide
gaacugggccagaugaau

SEQ ID NO: 37668 - RNA, 18 nt, Artificial Sequence
  Description of Artificial Sequence: Synthetic oligonucleotide
guaaggaacugggccaga

SEQ ID NO: 37669 - RNA, 18 nt, Artificial Sequence
  Description of Artificial Sequence: Synthetic oligonucleotide
cugauguaaggaacuggg

SEQ ID NO: 37670 - RNA, 18 nt, Artificial Sequence
  Description of Artificial Sequence: Synthetic oligonucleotide
cacagcugauguaaggaa

SEQ ID NO: 37671 - RNA, 18 nt, Artificial Sequence
  Description of Artificial Sequence: Synthetic oligonucleotide
auuagcacagcugaugua

SEQ ID NO: 37672 - RNA, 18 nt, Artificial Sequence
  Description of Artificial Sequence: Synthetic oligonucleotide
auccuauuagcacagcug

SEQ ID NO: 37673 - RNA, 18 nt, Artificial Sequence
  Description of Artificial Sequence: Synthetic oligonucleotide
gccuaauccuauuagcac

SEQ ID NO: 37674 - RNA, 18 nt, Artificial Sequence
  Description of Artificial Sequence: Synthetic oligonucleotide
ggauagccuaauccuauu

SEQ ID NO: 37675 - RNA, 18 nt, Artificial Sequence
  Description of Artificial Sequence: Synthetic oligonucleotide
agacuggauagccuaauc

SEQ ID NO: 37676 - RNA, 18 nt, Artificial Sequence
  Description of Artificial Sequence: Synthetic oligonucleotide
auugcagacuggauagcc

SEQ ID NO: 37677 - RNA, 18 nt, Artificial Sequence
  Description of Artificial Sequence: Synthetic oligonucleotide
auaagauugcagacugga

SEQ ID NO: 37678 - RNA, 18 nt, Artificial Sequence
  Description of Artificial Sequence: Synthetic oligonucleotide
aggacauaagauugcaga

SEQ ID NO: 37679 - RNA, 18 nt, Artificial Sequence
  Description of Artificial Sequence: Synthetic oligonucleotide
aguauaggacauaagauu

SEQ ID NO: 37680 - RNA, 18 nt, Artificial Sequence
  Description of Artificial Sequence: Synthetic oligonucleotide
uauagaguauaggacaua

SEQ ID NO: 37681 - RNA, 18 nt, Artificial Sequence
  Description of Artificial Sequence: Synthetic oligonucleotide
uugaauauagaguauagg

SEQ ID NO: 37682 - RNA, 18 nt, Artificial Sequence
  Description of Artificial Sequence: Synthetic oligonucleotide
aauuuuugaauauagagu

SEQ ID NO: 37683 - RNA, 18 nt, Artificial Sequence
  Description of Artificial Sequence: Synthetic oligonucleotide
ccuagaauuuuugaauau

SEQ ID NO: 37684 - RNA, 18 nt, Artificial Sequence
  Description of Artificial Sequence: Synthetic oligonucleotide
uugguccuagaauuuuug

SEQ ID NO: 37685 - RNA, 18 nt, Artificial Sequence
  Description of Artificial Sequence: Synthetic oligonucleotide
agguuuugguccuagaau

SEQ ID NO: 37686 - RNA, 18 nt, Artificial Sequence
  Description of Artificial Sequence: Synthetic oligonucleotide
caaugucaggguaccugg

SEQ ID NO: 37687 - RNA, 18 nt, Artificial Sequence
  Description of Artificial Sequence: Synthetic oligonucleotide
aauugcaaugucagggua

SEQ ID NO: 37688 - RNA, 18 nt, Artificial Sequence
  Description of Artificial Sequence: Synthetic oligonucleotide
ucuauaauugcaauguca

SEQ ID NO: 37689 - RNA, 18 nt, Artificial Sequence
  Description of Artificial Sequence: Synthetic oligonucleotide
uauuuucuauaauugcaa

SEQ ID NO: 37690 - RNA, 18 nt, Artificial Sequence
  Description of Artificial Sequence: Synthetic oligonucleotide
aaguauauuuucuauaau

SEQ ID NO: 37691 - RNA, 18 nt, Artificial Sequence
  Description of Artificial Sequence: Synthetic oligonucleotide
cuuacaaguauauuuucu

SEQ ID NO: 37692 - RNA, 18 nt, Artificial Sequence
  Description of Artificial Sequence: Synthetic oligonucleotide
gagugcuuacaaguauau

SEQ ID NO: 37693 - RNA, 18 nt, Artificial Sequence
  Description of Artificial Sequence: Synthetic oligonucleotide
auguugagugcuuacaag

SEQ ID NO: 37694 - RNA, 18 nt, Artificial Sequence
  Description of Artificial Sequence: Synthetic oligonucleotide
aaaaaauguugagugcuu

SEQ ID NO: 37695 - RNA, 18 nt, Artificial Sequence
  Description of Artificial Sequence: Synthetic oligonucleotide
gcagcaaaaaauguugag

SEQ ID NO: 37696 - RNA, 18 nt, Artificial Sequence
  Description of Artificial Sequence: Synthetic oligonucleotide
gaauggcagcaaaaaaug

SEQ ID NO: 37697 - RNA, 18 nt, Artificial Sequence
  Description of Artificial Sequence: Synthetic oligonucleotide
auagagaauggcagcaaa

SEQ ID NO: 37698 - RNA, 18 nt, Artificial Sequence
  Description of Artificial Sequence: Synthetic oligonucleotide
uaaaaauagagaauggca

SEQ ID NO: 37699 - RNA, 18 nt, Artificial Sequence
  Description of Artificial Sequence: Synthetic oligonucleotide
cuguguaaaaauagagaa

SEQ ID NO: 37700 - RNA, 18 nt, Artificial Sequence
  Description of Artificial Sequence: Synthetic oligonucleotide
ucagucuguguaaaaaua

SEQ ID NO: 37701 - RNA, 18 nt, Artificial Sequence
  Description of Artificial Sequence: Synthetic oligonucleotide
ucaaaucagucuguguaa

SEQ ID NO: 37702 - RNA, 18 nt, Artificial Sequence
  Description of Artificial Sequence: Synthetic oligonucleotide
aucccucaaaucagucug

SEQ ID NO: 37703 - RNA, 18 nt, Artificial Sequence
  Description of Artificial Sequence: Synthetic oligonucleotide
uaaaaaucccucaaauca

SEQ ID NO: 37704 - RNA, 18 nt, Artificial Sequence
  Description of Artificial Sequence: Synthetic oligonucleotide
uaugauaaaaaucccuca

SEQ ID NO: 37705 - RNA, 18 nt, Artificial Sequence
  Description of Artificial Sequence: Synthetic oligonucleotide
cugaauaugauaaaaauc

SEQ ID NO: 37706 - RNA, 18 nt, Artificial Sequence
  Description of Artificial Sequence: Synthetic oligonucleotide
aaaugcugaauaugauaa

SEQ ID NO: 37707 - RNA, 18 nt, Artificial Sequence
  Description of Artificial Sequence: Synthetic oligonucleotide
auuuuaaaugcugaauau

SEQ ID NO: 37708 - RNA, 18 nt, Artificial Sequence
  Description of Artificial Sequence: Synthetic oligonucleotide
uaaaaauuuuaaaugcug

SEQ ID NO: 37709 - RNA, 18 nt, Artificial Sequence
  Description of Artificial Sequence: Synthetic oligonucleotide
auuuuuaaaaauuuuaaa

SEQ ID NO: 37710 - RNA, 18 nt, Artificial Sequence
  Description of Artificial Sequence: Synthetic oligonucleotide
gugggauuuuuaaaaauu

SEQ ID NO: 37711 - RNA, 18 nt, Artificial Sequence
  Description of Artificial Sequence: Synthetic oligonucleotide
aaguugugggauuuuuaa

SEQ ID NO: 37712 - RNA, 18 nt, Artificial Sequence
  Description of Artificial Sequence: Synthetic oligonucleotide
uauagaaguugugggauu

SEQ ID NO: 37713 - RNA, 18 nt, Artificial Sequence
  Description of Artificial Sequence: Synthetic oligonucleotide
aacuuuauagaaguugug

SEQ ID NO: 37714 - RNA, 18 nt, Artificial Sequence
  Description of Artificial Sequence: Synthetic oligonucleotide
gaaugaacuuuauagaag

SEQ ID NO: 37715 - RNA, 18 nt, Artificial Sequence
  Description of Artificial Sequence: Synthetic oligonucleotide
cccaagaaugaacuuuau

SEQ ID NO: 37716 - RNA, 18 nt, Artificial Sequence
  Description of Artificial Sequence: Synthetic oligonucleotide
accuacccaagaaugaac

SEQ ID NO: 37717 - RNA, 18 nt, Artificial Sequence
  Description of Artificial Sequence: Synthetic oligonucleotide
acauaaccuacccaagaa

SEQ ID NO: 37718 - RNA, 18 nt, Artificial Sequence
  Description of Artificial Sequence: Synthetic oligonucleotide
aacccacauaaccuaccc

SEQ ID NO: 37719 - RNA, 18 nt, Artificial Sequence
  Description of Artificial Sequence: Synthetic oligonucleotide
acuauaacccacauaacc

SEQ ID NO: 37720 - RNA, 18 nt, Artificial Sequence
  Description of Artificial Sequence: Synthetic oligonucleotide
ccaaaacuauaacccaca

SEQ ID NO: 37721 - RNA, 18 nt, Artificial Sequence
  Description of Artificial Sequence: Synthetic oligonucleotide
uguauccaaaacuauaac

SEQ ID NO: 37722 - RNA, 18 nt, Artificial Sequence
  Description of Artificial Sequence: Synthetic oligonucleotide
acuucuguauccaaaacu

SEQ ID NO: 37723 - RNA, 18 nt, Artificial Sequence
  Description of Artificial Sequence: Synthetic oligonucleotide
cuacaacuucuguaucca

SEQ ID NO: 37724 - RNA, 18 nt, Artificial Sequence
  Description of Artificial Sequence: Synthetic oligonucleotide
cacuccuacaacuucugu

SEQ ID NO: 37725 - RNA, 18 nt, Artificial Sequence
  Description of Artificial Sequence: Synthetic oligonucleotide
aaugccacuccuacaacu

SEQ ID NO: 37726 - RNA, 18 nt, Artificial Sequence
  Description of Artificial Sequence: Synthetic oligonucleotide
accacaaugccacuccua

SEQ ID NO: 37727 - RNA, 18 nt, Artificial Sequence
  Description of Artificial Sequence: Synthetic oligonucleotide
acucuaccacaaugccac

SEQ ID NO: 37728 - RNA, 18 nt, Artificial Sequence
  Description of Artificial Sequence: Synthetic oligonucleotide
uuuacacucuaccacaau

SEQ ID NO: 37729 - RNA, 18 nt, Artificial Sequence
  Description of Artificial Sequence: Synthetic oligonucleotide
gccacuuuacacucuacc

SEQ ID NO: 37730 - RNA, 18 nt, Artificial Sequence
  Description of Artificial Sequence: Synthetic oligonucleotide
acugugccacuuuacacu

SEQ ID NO: 37731 - RNA, 18 nt, Artificial Sequence
  Description of Artificial Sequence: Synthetic oligonucleotide
acuccacugugccacuuu

SEQ ID NO: 37732 - RNA, 18 nt, Artificial Sequence
  Description of Artificial Sequence: Synthetic oligonucleotide
ggcugacuccacugugcc

SEQ ID NO: 37733 - RNA, 18 nt, Artificial Sequence
  Description of Artificial Sequence: Synthetic oligonucleotide
uauuuggcugacuccacu

SEQ ID NO: 37734 - RNA, 18 nt, Artificial Sequence
  Description of Artificial Sequence: Synthetic oligonucleotide
agccauauuuggcugacu

SEQ ID NO: 37735 - RNA, 18 nt, Artificial Sequence
  Description of Artificial Sequence: Synthetic oligonucleotide
uuugaagccauauuuggc

SEQ ID NO: 37736 - RNA, 18 nt, Artificial Sequence
  Description of Artificial Sequence: Synthetic oligonucleotide
agagguuugaagccauau

SEQ ID NO: 37737 - RNA, 18 nt, Artificial Sequence
  Description of Artificial Sequence: Synthetic oligonucleotide
guucaagagguuugaagc

SEQ ID NO: 37738 - RNA, 18 nt, Artificial Sequence
  Description of Artificial Sequence: Synthetic oligonucleotide
aacuuguucaagagguuu

SEQ ID NO: 37739 - RNA, 18 nt, Artificial Sequence
  Description of Artificial Sequence: Synthetic oligonucleotide
uaaguaacuuguucaaga

SEQ ID NO: 37740 - RNA, 18 nt, Artificial Sequence
  Description of Artificial Sequence: Synthetic oligonucleotide
aaguuuaaguaacuuguu

SEQ ID NO: 37741 - RNA, 18 nt, Artificial Sequence
  Description of Artificial Sequence: Synthetic oligonucleotide
ucagaaaguuuaaguaac

SEQ ID NO: 37742 - RNA, 18 nt, Artificial Sequence
  Description of Artificial Sequence: Synthetic oligonucleotide
gaaacucagaaaguuuaa

SEQ ID NO: 37743 - RNA, 18 nt, Artificial Sequence
  Description of Artificial Sequence: Synthetic oligonucleotide
aagcugaaacucagaaag

SEQ ID NO: 37744 - RNA, 18 nt, Artificial Sequence
  Description of Artificial Sequence: Synthetic oligonucleotide
gguagaagcugaaacuca

SEQ ID NO: 37745 - RNA, 18 nt, Artificial Sequence
  Description of Artificial Sequence: Synthetic oligonucleotide
acaaagguagaagcugaa

SEQ ID NO: 37746 - RNA, 18 nt, Artificial Sequence
  Description of Artificial Sequence: Synthetic oligonucleotide
guuuaacaaagguagaag

SEQ ID NO: 37747 - RNA, 18 nt, Artificial Sequence
  Description of Artificial Sequence: Synthetic oligonucleotide
ugccuguuuaacaaaggu

SEQ ID NO: 37748 - RNA, 18 nt, Artificial Sequence
  Description of Artificial Sequence: Synthetic oligonucleotide
uguuaugccuguuuaaca

SEQ ID NO: 37749 - RNA, 18 nt, Artificial Sequence
  Description of Artificial Sequence: Synthetic oligonucleotide
acagguguuaugccuguu

SEQ ID NO: 37750 - RNA, 18 nt, Artificial Sequence
  Description of Artificial Sequence: Synthetic oligonucleotide
cgaugacagguguuaugc

SEQ ID NO: 37751 - RNA, 18 nt, Artificial Sequence
  Description of Artificial Sequence: Synthetic oligonucleotide
aguuucgaugacaggugu

SEQ ID NO: 37752 - RNA, 18 nt, Artificial Sequence
  Description of Artificial Sequence: Synthetic oligonucleotide
ucacaaguuucgaugaca

SEQ ID NO: 37753 - RNA, 18 nt, Artificial Sequence
  Description of Artificial Sequence: Synthetic oligonucleotide
aauguucacaaguuucga

SEQ ID NO: 37754 - RNA, 18 nt, Artificial Sequence
  Description of Artificial Sequence: Synthetic oligonucleotide
uuuguaauguucacaagu

SEQ ID NO: 37755 - RNA, 18 nt, Artificial Sequence
  Description of Artificial Sequence: Synthetic oligonucleotide
caucauuuguaauguuca

SEQ ID NO: 37756 - RNA, 18 nt, Artificial Sequence
  Description of Artificial Sequence: Synthetic oligonucleotide
aaauacaucauuuguaau

SEQ ID NO: 37757 - RNA, 18 nt, Artificial Sequence
  Description of Artificial Sequence: Synthetic oligonucleotide
uguuaugccuguuuaaca

SEQ ID NO: 37758 - RNA, 18 nt, Artificial Sequence
  Description of Artificial Sequence: Synthetic oligonucleotide
acagguguuaugccuguu

SEQ ID NO: 37759 - RNA, 18 nt, Artificial Sequence
  Description of Artificial Sequence: Synthetic oligonucleotide
cgaugacagguguuaugc

SEQ ID NO: 37760 - RNA, 18 nt, Artificial Sequence
  Description of Artificial Sequence: Synthetic oligonucleotide
aguuucgaugacaggugu

SEQ ID NO: 37761 - RNA, 18 nt, Artificial Sequence
  Description of Artificial Sequence: Synthetic oligonucleotide
ucacaaguuucgaugaca

SEQ ID NO: 37762 - RNA, 18 nt, Artificial Sequence
  Description of Artificial Sequence: Synthetic oligonucleotide
aauguucacaaguuucga

SEQ ID NO: 37763 - RNA, 18 nt, Artificial Sequence
  Description of Artificial Sequence: Synthetic oligonucleotide
uuuguaauguucacaagu

SEQ ID NO: 37764 - RNA, 18 nt, Artificial Sequence
  Description of Artificial Sequence: Synthetic oligonucleotide
caucauuuguaauguuca

SEQ ID NO: 37765 - RNA, 18 nt, Artificial Sequence
  Description of Artificial Sequence: Synthetic oligonucleotide
aaauacaucauuuguaau

SEQ ID NO: 37766 - RNA, 18 nt, Artificial Sequence
  Description of Artificial Sequence: Synthetic oligonucleotide
gcuuuaaauacaucauuu

SEQ ID NO: 37767 - RNA, 18 nt, Artificial Sequence
  Description of Artificial Sequence: Synthetic oligonucleotide
uaggugcuuuaaauacau

SEQ ID NO: 37768 - RNA, 18 nt, Artificial Sequence
  Description of Artificial Sequence: Synthetic oligonucleotide
ugagguaggugcuuuaaa

SEQ ID NO: 37769 - RNA, 18 nt, Artificial Sequence
  Description of Artificial Sequence: Synthetic oligonucleotide
gucacugagguaggugcu

SEQ ID NO: 37770 - RNA, 18 nt, Artificial Sequence
  Description of Artificial Sequence: Synthetic oligonucleotide
ugccagucacugagguag

SEQ ID NO: 37771 - RNA, 18 nt, Artificial Sequence
  Description of Artificial Sequence: Synthetic oligonucleotide
cuacaugccagucacuga

SEQ ID NO: 37772 - RNA, 18 nt, Artificial Sequence
  Description of Artificial Sequence: Synthetic oligonucleotide
accugcuacaugccaguc

SEQ ID NO: 37773 - RNA, 18 nt, Artificial Sequence
  Description of Artificial Sequence: Synthetic oligonucleotide
uuuguaccugcuacaugc

SEQ ID NO: 37774 - RNA, 18 nt, Artificial Sequence
  Description of Artificial Sequence: Synthetic oligonucleotide
uuuauuuuguaccugcua

SEQ ID NO: 37775 - RNA, 18 nt, Artificial Sequence
  Description of Artificial Sequence: Synthetic oligonucleotide
uaacauuuauuuuguacc

SEQ ID NO: 37776 - RNA, 18 nt, Artificial Sequence
  Description of Artificial Sequence: Synthetic oligonucleotide
aaagcuaacauuuauuuu

SEQ ID NO: 37777 - RNA, 18 nt, Artificial Sequence
  Description of Artificial Sequence: Synthetic oligonucleotide
cuuuuaaagcuaacauuu

SEQ ID NO: 37778 - RNA, 18 nt, Artificial Sequence
  Description of Artificial Sequence: Synthetic oligonucleotide
aauaccuuuuaaagcuaa

SEQ ID NO: 37779 - RNA, 18 nt, Artificial Sequence
  Description of Artificial Sequence: Synthetic oligonucleotide
auuaaaauaccuuuuaaa

SEQ ID NO: 37780 - RNA, 18 nt, Artificial Sequence
  Description of Artificial Sequence: Synthetic oligonucleotide
aauugauuaaaauaccuu

SEQ ID NO: 37781 - RNA, 18 nt, Artificial Sequence
  Description of Artificial Sequence: Synthetic oligonucleotide
aauaaaauugauuaaaau

SEQ ID NO: 37782 - RNA, 18 nt, Artificial Sequence
  Description of Artificial Sequence: Synthetic oligonucleotide
ggaauaauaaaauugauu

SEQ ID NO: 37783 - RNA, 18 nt, Artificial Sequence
  Description of Artificial Sequence: Synthetic oligonucleotide
cccugggaauaauaaaau

SEQ ID NO: 37784 - RNA, 18 nt, Artificial Sequence
  Description of Artificial Sequence: Synthetic oligonucleotide
ugaagcccugggaauaau

SEQ ID NO: 37785 - RNA, 18 nt, Artificial Sequence
  Description of Artificial Sequence: Synthetic oligonucleotide
ucugcugaagcccuggga

SEQ ID NO: 37786 - RNA, 18 nt, Artificial Sequence
  Description of Artificial Sequence: Synthetic oligonucleotide
uacugucugcugaagccc

SEQ ID NO: 37787 - RNA, 18 nt, Artificial Sequence
  Description of Artificial Sequence: Synthetic oligonucleotide
aaacuuacugucugcuga

SEQ ID NO: 37788 - RNA, 18 nt, Artificial Sequence
  Description of Artificial Sequence: Synthetic oligonucleotide
gggaaaaacuuacugucu

SEQ ID NO: 37789 - RNA, 18 nt, Artificial Sequence
  Description of Artificial Sequence: Synthetic oligonucleotide
guaaagggaaaaacuuac

SEQ ID NO: 37790 - RNA, 18 nt, Artificial Sequence
  Description of Artificial Sequence: Synthetic oligonucleotide
ggaguguaaagggaaaaa

SEQ ID NO: 37791 - RNA, 18 nt, Artificial Sequence
  Description of Artificial Sequence: Synthetic oligonucleotide
uaaaaggaguguaaaggg

SEQ ID NO: 37792 - RNA, 18 nt, Artificial Sequence
  Description of Artificial Sequence: Synthetic oligonucleotide
aaaaauaaaaggagugua

SEQ ID NO: 37793 - RNA, 18 nt, Artificial Sequence
  Description of Artificial Sequence: Synthetic oligonucleotide
uuaaaaaaaauaaaagga

SEQ ID NO: 37794 - RNA, 18 nt, Artificial Sequence
  Description of Artificial Sequence: Synthetic oligonucleotide
ucagauuaaaaaaaauaa

SEQ ID NO: 37795 - RNA, 18 nt, Artificial Sequence
  Description of Artificial Sequence: Synthetic oligonucleotide
uuaagucagauuaaaaaa

SEQ ID NO: 37796 - RNA, 18 nt, Artificial Sequence
  Description of Artificial Sequence: Synthetic oligonucleotide
uaauauuaagucagauua

SEQ ID NO: 37797 - RNA, 18 nt, Artificial Sequence
  Description of Artificial Sequence: Synthetic oligonucleotide
gcauuuaauauuaaguca

SEQ ID NO: 37798 - RNA, 18 nt, Artificial Sequence
  Description of Artificial Sequence: Synthetic oligonucleotide
auauagcauuuaauauua

SEQ ID NO: 37799 - RNA, 18 nt, Artificial Sequence
  Description of Artificial Sequence: Synthetic oligonucleotide
uauaaauauagcauuuaa

SEQ ID NO: 37800 - RNA, 18 nt, Artificial Sequence
  Description of Artificial Sequence: Synthetic oligonucleotide
ccuccuauaaauauagca

SEQ ID NO: 37801 - RNA, 18 nt, Artificial Sequence
  Description of Artificial Sequence: Synthetic oligonucleotide
aaaugccuccuauaaaua

SEQ ID NO: 37802 - RNA, 18 nt, Artificial Sequence
  Description of Artificial Sequence: Synthetic oligonucleotide
acauaaaaugccuccuau

SEQ ID NO: 37803 - RNA, 18 nt, Artificial Sequence
  Description of Artificial Sequence: Synthetic oligonucleotide
auuaaacauaaaaugccu

SEQ ID NO: 37804 - RNA, 18 nt, Artificial Sequence
  Description of Artificial Sequence: Synthetic oligonucleotide
uuuaaauuaaacauaaaa

SEQ ID NO: 37805 - RNA, 18 nt, Artificial Sequence
  Description of Artificial Sequence: Synthetic oligonucleotide
uuacuuuuaaauuaaaca

SEQ ID NO: 37806 - RNA, 18 nt, Artificial Sequence
  Description of Artificial Sequence: Synthetic oligonucleotide
aucuuuuacuuuuaaauu

SEQ ID NO: 37807 - RNA, 18 nt, Artificial Sequence
  Description of Artificial Sequence: Synthetic oligonucleotide
ucugcaucuuuuacuuuu

SEQ ID NO: 37808 - RNA, 18 nt, Artificial Sequence
  Description of Artificial Sequence: Synthetic oligonucleotide
ucauuucugcaucuuuua

SEQ ID NO: 37809 - RNA, 18 nt, Artificial Sequence
  Description of Artificial Sequence: Synthetic oligonucleotide
aagaaucauuucugcauc

SEQ ID NO: 37810 - RNA, 18 nt, Artificial Sequence
  Description of Artificial Sequence: Synthetic oligonucleotide
cuuacaagaaucauuucu

SEQ ID NO: 37811 - RNA, 18 nt, Artificial Sequence
  Description of Artificial Sequence: Synthetic oligonucleotide
gcaaacuuacaagaauca

SEQ ID NO: 37812 - RNA, 18 nt, Artificial Sequence
  Description of Artificial Sequence: Synthetic oligonucleotide
cuacagcaaacuuacaag

SEQ ID NO: 37813 - RNA, 18 nt, Artificial Sequence
  Description of Artificial Sequence: Synthetic oligonucleotide
ccaaacuacagcaaacuu

SEQ ID NO: 37814 - RNA, 18 nt, Artificial Sequence
  Description of Artificial Sequence: Synthetic oligonucleotide
uauuaccaaacuacagca

SEQ ID NO: 37815 - RNA, 18 nt, Artificial Sequence
  Description of Artificial Sequence: Synthetic oligonucleotide
aaugguauuaccaaacua

SEQ ID NO: 37816 - RNA, 18 nt, Artificial Sequence
  Description of Artificial Sequence: Synthetic oligonucleotide
aaagaaaugguauuacca

SEQ ID NO: 37817 - RNA, 18 nt, Artificial Sequence
  Description of Artificial Sequence: Synthetic oligonucleotide
aaagcaaagaaaugguau

SEQ ID NO: 37818 - RNA, 18 nt, Artificial Sequence
  Description of Artificial Sequence: Synthetic oligonucleotide
auuuaaaagcaaagaaau

SEQ ID NO: 37819 - RNA, 18 nt, Artificial Sequence
  Description of Artificial Sequence: Synthetic oligonucleotide
uaguuauuuaaaagcaaa

SEQ ID NO: 37820 - RNA, 18 nt, Artificial Sequence
  Description of Artificial Sequence: Synthetic oligonucleotide
ggguuuaguuauuuaaaa

SEQ ID NO: 37821 - RNA, 18 nt, Artificial Sequence
  Description of Artificial Sequence: Synthetic oligonucleotide
aagcagauugauauuggg

SEQ ID NO: 37822 - RNA, 18 nt, Artificial Sequence
  Description of Artificial Sequence: Synthetic oligonucleotide
gacaagcagauugauauu

SEQ ID NO: 37823 - RNA, 18 nt, Artificial Sequence
  Description of Artificial Sequence: Synthetic oligonucleotide
uggaggacaagcagauug

SEQ ID NO: 37824 - RNA, 18 nt, Artificial Sequence
  Description of Artificial Sequence: Synthetic oligonucleotide
accagcccauguauacac

SEQ ID NO: 37825 - RNA, 18 nt, Artificial Sequence
  Description of Artificial Sequence: Synthetic oligonucleotide
uguuaaccagcccaugua

SEQ ID NO: 37826 - RNA, 18 nt, Artificial Sequence
  Description of Artificial Sequence: Synthetic oligonucleotide
gaugcuguuaaccagccc

SEQ ID NO: 37827 - RNA, 18 nt, Artificial Sequence
  Description of Artificial Sequence: Synthetic oligonucleotide
uuccagaugcuguuaacc

SEQ ID NO: 37828 - RNA, 18 nt, Artificial Sequence
  Description of Artificial Sequence: Synthetic oligonucleotide
uccacuuccagaugcugu

SEQ ID NO: 37829 - RNA, 18 nt, Artificial Sequence
  Description of Artificial Sequence: Synthetic oligonucleotide
cgggcuccacuuccagau

SEQ ID NO: 37830 - RNA, 18 nt, Artificial Sequence
  Description of Artificial Sequence: Synthetic oligonucleotide
gaauccgggcuccacuuc

SEQ ID NO: 37831 - RNA, 18 nt, Artificial Sequence
  Description of Artificial Sequence: Synthetic oligonucleotide
cccaagaauccgggcucc

SEQ ID NO: 37832 - RNA, 18 nt, Artificial Sequence
  Description of Artificial Sequence: Synthetic oligonucleotide
auaggcccaagaauccgg

SEQ ID NO: 37833 - RNA, 18 nt, Artificial Sequence
  Description of Artificial Sequence: Synthetic oligonucleotide
ugaacauaggcccaagaa

SEQ ID NO: 37834 - RNA, 18 nt, Artificial Sequence
  Description of Artificial Sequence: Synthetic oligonucleotide
gcugaugaacauaggccc

SEQ ID NO: 37835 - RNA, 18 nt, Artificial Sequence
  Description of Artificial Sequence: Synthetic oligonucleotide
acuuggcugaugaacaua

SEQ ID NO: 37836 - RNA, 18 nt, Artificial Sequence
  Description of Artificial Sequence: Synthetic oligonucleotide
cauacacuuggcugauga

SEQ ID NO: 37837 - RNA, 18 nt, Artificial Sequence
  Description of Artificial Sequence: Synthetic oligonucleotide
gugagcauacacuuggcu

SEQ ID NO: 37838 - RNA, 18 nt, Artificial Sequence
  Description of Artificial Sequence: Synthetic oligonucleotide
ccccagugagcauacacu

SEQ ID NO: 37839 - RNA, 18 nt, Artificial Sequence
  Description of Artificial Sequence: Synthetic oligonucleotide
gugguccccagugagcau

SEQ ID NO: 37840 - RNA, 18 nt, Artificial Sequence
  Description of Artificial Sequence: Synthetic oligonucleotide
ccaucgugguccccagug

SEQ ID NO: 37841 - RNA, 18 nt, Artificial Sequence
  Description of Artificial Sequence: Synthetic oligonucleotide
aaugcccaucgugguccc

SEQ ID NO: 37842 - RNA, 18 nt, Artificial Sequence
  Description of Artificial Sequence: Synthetic oligonucleotide
ggcugaaugcccaucgug

SEQ ID NO: 37843 - RNA, 18 nt, Artificial Sequence
  Description of Artificial Sequence: Synthetic oligonucleotide
caccaggcugaaugccca

SEQ ID NO: 37844 - RNA, 18 nt, Artificial Sequence
  Description of Artificial Sequence: Synthetic oligonucleotide
ccacacaccaggcugaau

SEQ ID NO: 37845 - RNA, 18 nt, Artificial Sequence
  Description of Artificial Sequence: Synthetic oligonucleotide
uuauuccacacaccaggc

SEQ ID NO: 37846 - RNA, 18 nt, Artificial Sequence
  Description of Artificial Sequence: Synthetic oligonucleotide
cacuauuauuccacacac

SEQ ID NO: 37847 - RNA, 18 nt, Artificial Sequence
  Description of Artificial Sequence: Synthetic oligonucleotide
gugagcacuauuauucca

SEQ ID NO: 37848 - RNA, 18 nt, Artificial Sequence
  Description of Artificial Sequence: Synthetic oligonucleotide
ugauggugagcacuauua

SEQ ID NO: 37849 - RNA, 18 nt, Artificial Sequence
  Description of Artificial Sequence: Synthetic oligonucleotide
gagggugauggugagcac

SEQ ID NO: 37850 - RNA, 18 nt, Artificial Sequence
  Description of Artificial Sequence: Synthetic oligonucleotide
cccaggagggugauggug

SEQ ID NO: 37851 - RNA, 18 nt, Artificial Sequence
  Description of Artificial Sequence: Synthetic oligonucleotide
ccacucccaggaggguga

SEQ ID NO: 37852 - RNA, 18 nt, Artificial Sequence
  Description of Artificial Sequence: Synthetic oligonucleotide
guaaaccacucccaggag

SEQ ID NO: 37853 - RNA, 18 nt, Artificial Sequence
  Description of Artificial Sequence: Synthetic oligonucleotide
cuuuuguaaaccacuccc

SEQ ID NO: 37854 - RNA, 18 nt, Artificial Sequence
  Description of Artificial Sequence: Synthetic oligonucleotide
ugagucuuuuguaaacca

SEQ ID NO: 37855 - RNA, 18 nt, Artificial Sequence
  Description of Artificial Sequence: Synthetic oligonucleotide
agcaaugagucuuuugua

SEQ ID NO: 37856 - RNA, 18 nt, Artificial Sequence
  Description of Artificial Sequence: Synthetic oligonucleotide
gaaagagcaaugagucuu

SEQ ID NO: 37857 - RNA, 18 nt, Artificial Sequence
  Description of Artificial Sequence: Synthetic oligonucleotide
uuacagaaagagcaauga

SEQ ID NO: 37858 - RNA, 18 nt, Artificial Sequence
  Description of Artificial Sequence: Synthetic oligonucleotide
auaucuuacagaaagagc

SEQ ID NO: 37859 - RNA, 18 nt, Artificial Sequence
  Description of Artificial Sequence: Synthetic oligonucleotide
cucccauaucuuacagaa

SEQ ID NO: 37860 - RNA, 18 nt, Artificial Sequence
  Description of Artificial Sequence: Synthetic oligonucleotide
gaauccucccauaucuua

SEQ ID NO: 37861 - RNA, 18 nt, Artificial Sequence
  Description of Artificial Sequence: Synthetic oligonucleotide
uuccugaauccucccaua

SEQ ID NO: 37862 - RNA, 18 nt, Artificial Sequence
  Description of Artificial Sequence: Synthetic oligonucleotide
guuuauuccugaauccuc

SEQ ID NO: 37863 - RNA, 18 nt, Artificial Sequence
  Description of Artificial Sequence: Synthetic oligonucleotide
agcuaguuuauuccugaa

SEQ ID NO: 37864 - RNA, 18 nt, Artificial Sequence
  Description of Artificial Sequence: Synthetic oligonucleotide
gucuuagcuaguuuauuc

SEQ ID NO: 37865 - RNA, 18 nt, Artificial Sequence
  Description of Artificial Sequence: Synthetic oligonucleotide
ucacagucuuagcuaguu

SEQ ID NO: 37866 - RNA, 18 nt, Artificial Sequence
  Description of Artificial Sequence: Synthetic oligonucleotide
uuccaucacagucuuagc

SEQ ID NO: 37867 - RNA, 18 nt, Artificial Sequence
  Description of Artificial Sequence: Synthetic oligonucleotide
guaguuuccaucacaguc

SEQ ID NO: 37868 - RNA, 18 nt, Artificial Sequence
  Description of Artificial Sequence: Synthetic oligonucleotide
agcaaguaguuuccauca

SEQ ID NO: 37869 - RNA, 18 nt, Artificial Sequence
  Description of Artificial Sequence: Synthetic oligonucleotide
cacacagcaaguaguuuc

SEQ ID NO: 37870 - RNA, 18 nt, Artificial Sequence
  Description of Artificial Sequence: Synthetic oligonucleotide
agugccacacagcaagua

SEQ ID NO: 37871 - RNA, 18 nt, Artificial Sequence
  Description of Artificial Sequence: Synthetic oligonucleotide
caggaagugccacacagc

SEQ ID NO: 37872 - RNA, 18 nt, Artificial Sequence
  Description of Artificial Sequence: Synthetic oligonucleotide
uagaccaggaagugccac

SEQ ID NO: 37873 - RNA, 18 nt, Artificial Sequence
  Description of Artificial Sequence: Synthetic oligonucleotide
agcuuuagaccaggaagu

SEQ ID NO: 37874 - RNA, 18 nt, Artificial Sequence
  Description of Artificial Sequence: Synthetic oligonucleotide
agcagagcuuuagaccag

SEQ ID NO: 37875 - RNA, 18 nt, Artificial Sequence
  Description of Artificial Sequence: Synthetic oligonucleotide
ugucuagcagagcuuuag

SEQ ID NO: 37876 - RNA, 18 nt, Artificial Sequence
  Description of Artificial Sequence: Synthetic oligonucleotide
gcaauugucuagcagagc

SEQ ID NO: 37877 - RNA, 18 nt, Artificial Sequence
  Description of Artificial Sequence: Synthetic oligonucleotide
ucaccgcaauugucuagc

SEQ ID NO: 37878 - RNA, 18 nt, Artificial Sequence
  Description of Artificial Sequence: Synthetic oligonucleotide
cuggcucaccgcaauugu

SEQ ID NO: 37879 - RNA, 18 nt, Artificial Sequence
  Description of Artificial Sequence: Synthetic oligonucleotide
ggagacuggcucaccgca

SEQ ID NO: 37880 - RNA, 18 nt, Artificial Sequence
  Description of Artificial Sequence: Synthetic oligonucleotide
uucuuggagacuggcuca

SEQ ID NO: 37881 - RNA, 18 nt, Artificial Sequence
  Description of Artificial Sequence: Synthetic oligonucleotide
ucugauucuuggagacug

SEQ ID NO: 37882 - RNA, 18 nt, Artificial Sequence
  Description of Artificial Sequence: Synthetic oligonucleotide
uguagucugauucuugga

SEQ ID NO: 37883 - RNA, 18 nt, Artificial Sequence
  Description of Artificial Sequence: Synthetic oligonucleotide
auaucuguagucugauuc

SEQ ID NO: 37884 - RNA, 18 nt, Artificial Sequence
  Description of Artificial Sequence: Synthetic oligonucleotide
cugcaauaucuguagucu

SEQ ID NO: 37885 - RNA, 18 nt, Artificial Sequence
  Description of Artificial Sequence: Synthetic oligonucleotide
aaaaucugcaauaucugu

SEQ ID NO: 37886 - RNA, 18 nt, Artificial Sequence
  Description of Artificial Sequence: Synthetic oligonucleotide
ucuucaaaaucugcaaua

SEQ ID NO: 37887 - RNA, 18 nt, Artificial Sequence
  Description of Artificial Sequence: Synthetic oligonucleotide
cuuguucuucaaaaucug

SEQ ID NO: 37888 - RNA, 18 nt, Artificial Sequence
  Description of Artificial Sequence: Synthetic oligonucleotide
auguucuuguucuucaaa

SEQ ID NO: 37889 - RNA, 18 nt, Artificial Sequence
  Description of Artificial Sequence: Synthetic oligonucleotide
aacauauguucuuguucu

SEQ ID NO: 37890 - RNA, 18 nt, Artificial Sequence
  Description of Artificial Sequence: Synthetic oligonucleotide
uauucaacauauguucuu

SEQ ID NO: 37891 - RNA, 18 nt, Artificial Sequence
  Description of Artificial Sequence: Synthetic oligonucleotide
ucuguuauucaacauaug

SEQ ID NO: 37892 - RNA, 18 nt, Artificial Sequence
  Description of Artificial Sequence: Synthetic oligonucleotide
uucucucuguuauucaac

SEQ ID NO: 37893 - RNA, 18 nt, Artificial Sequence
  Description of Artificial Sequence: Synthetic oligonucleotide
uagaauucucucuguuau

SEQ ID NO: 37894 - RNA, 18 nt, Artificial Sequence
  Description of Artificial Sequence: Synthetic oligonucleotide
acauguagaauucucucu

SEQ ID NO: 37895 - RNA, 18 nt, Artificial Sequence
  Description of Artificial Sequence: Synthetic oligonucleotide
caaugacauguagaauuc

SEQ ID NO: 37896 - RNA, 18 nt, Artificial Sequence
  Description of Artificial Sequence: Synthetic oligonucleotide
auucacaaugacauguag

SEQ ID NO: 37897 - RNA, 18 nt, Artificial Sequence
  Description of Artificial Sequence: Synthetic oligonucleotide
cuacuauucacaaugaca

SEQ ID NO: 37898 - RNA, 18 nt, Artificial Sequence
  Description of Artificial Sequence: Synthetic oligonucleotide
auaaccuacuauucacaa

SEQ ID NO: 37899 - RNA, 18 nt, Artificial Sequence
  Description of Artificial Sequence: Synthetic oligonucleotide
uuuauauaaccuacuauu

SEQ ID NO: 37900 - RNA, 18 nt, Artificial Sequence
  Description of Artificial Sequence: Synthetic oligonucleotide
auguuuuuauauaaccua

SEQ ID NO: 37901 - RNA, 18 nt, Artificial Sequence
  Description of Artificial Sequence: Synthetic oligonucleotide
cuaguauguuuuuauaua

SEQ ID NO: 37902 - RNA, 18 nt, Artificial Sequence
  Description of Artificial Sequence: Synthetic oligonucleotide
aucaucuaguauguuuuu

SEQ ID NO: 37903 - RNA, 18 nt, Artificial Sequence
  Description of Artificial Sequence: Synthetic oligonucleotide
aaauuaucaucuaguaug

SEQ ID NO: 37904 - RNA, 18 nt, Artificial Sequence
  Description of Artificial Sequence: Synthetic oligonucleotide
uaaggaaauuaucaucua

SEQ ID NO: 37905 - RNA, 18 nt, Artificial Sequence
  Description of Artificial Sequence: Synthetic oligonucleotide
ugagguaaggaaauuauc

SEQ ID NO: 37906 - RNA, 18 nt, Artificial Sequence
  Description of Artificial Sequence: Synthetic oligonucleotide
auuucugagguaaggaaa

SEQ ID NO: 37907 - RNA, 18 nt, Artificial Sequence
  Description of Artificial Sequence: Synthetic oligonucleotide
auuucauuucugagguaa

SEQ ID NO: 37908 - RNA, 18 nt, Artificial Sequence
  Description of Artificial Sequence: Synthetic oligonucleotide
auaauauuucauuucuga

SEQ ID NO: 37909 - RNA, 18 nt, Artificial Sequence
  Description of Artificial Sequence: Synthetic oligonucleotide
uaagaauaauauuucauu

SEQ ID NO: 37910 - RNA, 18 nt, Artificial Sequence
  Description of Artificial Sequence: Synthetic oligonucleotide
uauuauaagaauaauauu

SEQ ID NO: 37911 - RNA, 18 nt, Artificial Sequence
  Description of Artificial Sequence: Synthetic oligonucleotide
aaagguauuauaagaaua

SEQ ID NO: 37912 - RNA, 18 nt, Artificial Sequence
  Description of Artificial Sequence: Synthetic oligonucleotide
cacaaaaagguauuauaa

SEQ ID NO: 37913 - RNA, 18 nt, Artificial Sequence
  Description of Artificial Sequence: Synthetic oligonucleotide
gcaaccacaaaaagguau

SEQ ID NO: 37914 - RNA, 18 nt, Artificial Sequence
  Description of Artificial Sequence: Synthetic oligonucleotide
uucaugcaaccacaaaaa

SEQ ID NO: 37915 - RNA, 18 nt, Artificial Sequence
  Description of Artificial Sequence: Synthetic oligonucleotide
auuaguucaugcaaccac

SEQ ID NO: 37916 - RNA, 18 nt, Artificial Sequence
  Description of Artificial Sequence: Synthetic oligonucleotide
cacucauuaguucaugca

SEQ ID NO: 37917 - RNA, 18 nt, Artificial Sequence
  Description of Artificial Sequence: Synthetic oligonucleotide
ccauucacucauuaguuc

SEQ ID NO: 37918 - RNA, 18 nt, Artificial Sequence
  Description of Artificial Sequence: Synthetic oligonucleotide
auuguccauucacucauu

SEQ ID NO: 37919 - RNA, 18 nt, Artificial Sequence
  Description of Artificial Sequence: Synthetic oligonucleotide
ucaucauuguccauucac

SEQ ID NO: 37920 - RNA, 18 nt, Artificial Sequence
  Description of Artificial Sequence: Synthetic oligonucleotide
uuuauucaucauugucca

SEQ ID NO: 37921 - RNA, 18 nt, Artificial Sequence
  Description of Artificial Sequence: Synthetic oligonucleotide
ucacauuuauucaucauu

SEQ ID NO: 37922 - RNA, 18 nt, Artificial Sequence
  Description of Artificial Sequence: Synthetic oligonucleotide
cagcuucacauuuauuca

SEQ ID NO: 37923 - RNA, 18 nt, Artificial Sequence
  Description of Artificial Sequence: Synthetic oligonucleotide
gaauacagcuucacauuu

SEQ ID NO: 37924 - RNA, 18 nt, Artificial Sequence
  Description of Artificial Sequence: Synthetic oligonucleotide
auuaagaauacagcuuca

SEQ ID NO: 37925 - RNA, 18 nt, Artificial Sequence
  Description of Artificial Sequence: Synthetic oligonucleotide
uggguauuaagaauacag

SEQ ID NO: 37926 - RNA, 18 nt, Artificial Sequence
  Description of Artificial Sequence: Synthetic oligonucleotide
ugcaguggguauuaagaa

SEQ ID NO: 37927 - RNA, 18 nt, Artificial Sequence
  Description of Artificial Sequence: Synthetic oligonucleotide
acuucugcaguggguauu

SEQ ID NO: 37928 - RNA, 18 nt, Artificial Sequence
  Description of Artificial Sequence: Synthetic oligonucleotide
augacacuucugcagugg

SEQ ID NO: 37929 - RNA, 18 nt, Artificial Sequence
  Description of Artificial Sequence: Synthetic oligonucleotide
uuuuaaugacacuucugc

SEQ ID NO: 37930 - RNA, 18 nt, Artificial Sequence
  Description of Artificial Sequence: Synthetic oligonucleotide
uauuauuuuaaugacacu

SEQ ID NO: 37931 - RNA, 18 nt, Artificial Sequence
  Description of Artificial Sequence: Synthetic oligonucleotide
cuguauauuauuuuaaug

SEQ ID NO: 37932 - RNA, 18 nt, Artificial Sequence
  Description of Artificial Sequence: Synthetic oligonucleotide
uuccacuguauauuauuu

SEQ ID NO: 37933 - RNA, 18 nt, Artificial Sequence
  Description of Artificial Sequence: Synthetic oligonucleotide
ucugguuccacuguauau

SEQ ID NO: 37934 - RNA, 18 nt, Artificial Sequence
  Description of Artificial Sequence: Synthetic oligonucleotide
cucuuucugguuccacug

SEQ ID NO: 37935 - RNA, 18 nt, Artificial Sequence
  Description of Artificial Sequence: Synthetic oligonucleotide
gaacccucuuucugguuc

SEQ ID NO: 37936 - RNA, 18 nt, Artificial Sequence
  Description of Artificial Sequence: Synthetic oligonucleotide
uuacagaacccucuuucu

SEQ ID NO: 37937 - RNA, 18 nt, Artificial Sequence
  Description of Artificial Sequence: Synthetic oligonucleotide
aauucuuacagaacccuc

SEQ ID NO: 37938 - RNA, 18 nt, Artificial Sequence
  Description of Artificial Sequence: Synthetic oligonucleotide
uggcuaauucuuacagaa

SEQ ID NO: 37939 - RNA, 18 nt, Artificial Sequence
  Description of Artificial Sequence: Synthetic oligonucleotide
ugcuauggcuaauucuua

SEQ ID NO: 37940 - RNA, 18 nt, Artificial Sequence
  Description of Artificial Sequence: Synthetic oligonucleotide
uguucugcuauggcuaau

SEQ ID NO: 37941 - RNA, 18 nt, Artificial Sequence
  Description of Artificial Sequence: Synthetic oligonucleotide
aauuuuguucugcuaugg

SEQ ID NO: 37942 - RNA, 18 nt, Artificial Sequence
  Description of Artificial Sequence: Synthetic oligonucleotide
ucuauaauuuuguucugc

SEQ ID NO: 37943 - RNA, 18 nt, Artificial Sequence
  Description of Artificial Sequence: Synthetic oligonucleotide
aaaauucuauaauuuugu

SEQ ID NO: 37944 - RNA, 18 nt, Artificial Sequence
  Description of Artificial Sequence: Synthetic oligonucleotide
uauuuaaaauucuauaau

SEQ ID NO: 37945 - RNA, 18 nt, Artificial Sequence
  Description of Artificial Sequence: Synthetic oligonucleotide
agagguauuuaaaauucu

SEQ ID NO: 37946 - RNA, 18 nt, Artificial Sequence
  Description of Artificial Sequence: Synthetic oligonucleotide
uggguagagguauuuaaa

SEQ ID NO: 37947 - RNA, 18 nt, Artificial Sequence
  Description of Artificial Sequence: Synthetic oligonucleotide
cuacuuggguagagguau

SEQ ID NO: 37948 - RNA, 18 nt, Artificial Sequence
  Description of Artificial Sequence: Synthetic oligonucleotide
uaccucuacuuggguaga

SEQ ID NO: 37949 - RNA, 18 nt, Artificial Sequence
  Description of Artificial Sequence: Synthetic oligonucleotide
aaaaauaccucuacuugg

SEQ ID NO: 37950 - RNA, 18 nt, Artificial Sequence
  Description of Artificial Sequence: Synthetic oligonucleotide
ugaauaaaaauaccucua

SEQ ID NO: 37951 - RNA, 18 nt, Artificial Sequence
  Description of Artificial Sequence: Synthetic oligonucleotide
gugucugaauaaaaauac

SEQ ID NO: 37952 - RNA, 18 nt, Artificial Sequence
  Description of Artificial Sequence: Synthetic oligonucleotide
aguaggugucugaauaaa

SEQ ID NO: 37953 - RNA, 18 nt, Artificial Sequence
  Description of Artificial Sequence: Synthetic oligonucleotide
uaaaaaguaggugucuga

SEQ ID NO: 37954 - RNA, 18 nt, Artificial Sequence
  Description of Artificial Sequence: Synthetic oligonucleotide
auaaauaaaaaguaggug

SEQ ID NO: 37955 - RNA, 18 nt, Artificial Sequence
  Description of Artificial Sequence: Synthetic oligonucleotide
uuuuuauaaauaaaaagu

SEQ ID NO: 37956 - RNA, 18 nt, Artificial Sequence
  Description of Artificial Sequence: Synthetic oligonucleotide
gcauuuuuuuauaaauaa

SEQ ID NO: 37957 - RNA, 18 nt, Artificial Sequence
  Description of Artificial Sequence: Synthetic oligonucleotide
aaaaugcauuuuuuuaua

SEQ ID NO: 37958 - RNA, 18 nt, Artificial Sequence
  Description of Artificial Sequence: Synthetic oligonucleotide
aauagaaaaugcauuuuu

SEQ ID NO: 37959 - RNA, 18 nt, Artificial Sequence
  Description of Artificial Sequence: Synthetic oligonucleotide
uugauaauagaaaaugca

SEQ ID NO: 37960 - RNA, 18 nt, Artificial Sequence
  Description of Artificial Sequence: Synthetic oligonucleotide
ugaacuugauaauagaaa

SEQ ID NO: 37961 - RNA, 18 nt, Artificial Sequence
  Description of Artificial Sequence: Synthetic oligonucleotide
auaagugaacuugauaau

SEQ ID NO: 37962 - RNA, 18 nt, Artificial Sequence
  Description of Artificial Sequence: Synthetic oligonucleotide
auuucauaagugaacuug

SEQ ID NO: 37963 - RNA, 18 nt, Artificial Sequence
  Description of Artificial Sequence: Synthetic oligonucleotide
uuuuuauuucauaaguga

SEQ ID NO: 37964 - RNA, 18 nt, Artificial Sequence
  Description of Artificial Sequence: Synthetic oligonucleotide
uauaauuuuuauuucaua

SEQ ID NO: 37965 - RNA, 18 nt, Artificial Sequence
  Description of Artificial Sequence: Synthetic oligonucleotide
uguguuauaauuuuuauu

SEQ ID NO: 37966 - RNA, 18 nt, Artificial Sequence
  Description of Artificial Sequence: Synthetic oligonucleotide
aaauauguguuauaauuu

SEQ ID NO: 37967 - RNA, 18 nt, Artificial Sequence
  Description of Artificial Sequence: Synthetic oligonucleotide
auggaaaauauguguuau

SEQ ID NO: 37968 - RNA, 18 nt, Artificial Sequence
  Description of Artificial Sequence: Synthetic oligonucleotide
gcuaaauggaaaauaugu

SEQ ID NO: 37969 - RNA, 18 nt, Artificial Sequence
  Description of Artificial Sequence: Synthetic oligonucleotide
ggcacgcuaaauggaaaa

SEQ ID NO: 37970 - RNA, 18 nt, Artificial Sequence
  Description of Artificial Sequence: Synthetic oligonucleotide
uguuaggcacgcuaaaug

SEQ ID NO: 37971 - RNA, 18 nt, Artificial Sequence
  Description of Artificial Sequence: Synthetic oligonucleotide
uaggauguuaggcacgcu

SEQ ID NO: 37972 - RNA, 18 nt, Artificial Sequence
  Description of Artificial Sequence: Synthetic oligonucleotide
caagguaggauguuaggc

SEQ ID NO: 37973 - RNA, 18 nt, Artificial Sequence
  Description of Artificial Sequence: Synthetic oligonucleotide
gaaggcaagguaggaugu

SEQ ID NO: 37974 - RNA, 18 nt, Artificial Sequence
  Description of Artificial Sequence: Synthetic oligonucleotide
ucauagaaggcaagguag

SEQ ID NO: 37975 - RNA, 18 nt, Artificial Sequence
  Description of Artificial Sequence: Synthetic oligonucleotide
aagacucauagaaggcaa

SEQ ID NO: 37976 - RNA, 18 nt, Artificial Sequence
  Description of Artificial Sequence: Synthetic oligonucleotide
gaagaaagacucauagaa

SEQ ID NO: 37977 - RNA, 18 nt, Artificial Sequence
  Description of Artificial Sequence: Synthetic oligonucleotide
uauuagaagaaagacuca

SEQ ID NO: 37978 - RNA, 18 nt, Artificial Sequence
  Description of Artificial Sequence: Synthetic oligonucleotide
uguaguauuagaagaaag

SEQ ID NO: 37979 - RNA, 18 nt, Artificial Sequence
  Description of Artificial Sequence: Synthetic oligonucleotide
agagguguaguauuagaa

SEQ ID NO: 37980 - RNA, 18 nt, Artificial Sequence
  Description of Artificial Sequence: Synthetic oligonucleotide
aaggcagagguguaguau

SEQ ID NO: 37981 - RNA, 18 nt, Artificial Sequence
  Description of Artificial Sequence: Synthetic oligonucleotide
aaaauaaggcagaggugu

SEQ ID NO: 37982 - RNA, 18 nt, Artificial Sequence
  Description of Artificial Sequence: Synthetic oligonucleotide
gaacuaaaauaaggcaga

SEQ ID NO: 37983 - RNA, 18 nt, Artificial Sequence
  Description of Artificial Sequence: Synthetic oligonucleotide
acccugaacuaaaauaag

SEQ ID NO: 37984 - RNA, 18 nt, Artificial Sequence
  Description of Artificial Sequence: Synthetic oligonucleotide
gugaaacccugaacuaaa

SEQ ID NO: 37985 - RNA, 18 nt, Artificial Sequence
  Description of Artificial Sequence: Synthetic oligonucleotide
acuuagugaaacccugaa

SEQ ID NO: 37986 - RNA, 18 nt, Artificial Sequence
  Description of Artificial Sequence: Synthetic oligonucleotide
ggguuacuuagugaaacc

SEQ ID NO: 37987 - RNA, 18 nt, Artificial Sequence
  Description of Artificial Sequence: Synthetic oligonucleotide
auacucauuuauuaaugu

SEQ ID NO: 37988 - RNA, 18 nt, Artificial Sequence
  Description of Artificial Sequence: Synthetic oligonucleotide
uauccauacucauuuauu

SEQ ID NO: 37989 - RNA, 18 nt, Artificial Sequence
  Description of Artificial Sequence: Synthetic oligonucleotide
agcauuauccauacucau

SEQ ID NO: 37990 - RNA, 18 nt, Artificial Sequence
  Description of Artificial Sequence: Synthetic oligonucleotide
auauuagcauuauccaua

SEQ ID NO: 37991 - RNA, 18 nt, Artificial Sequence
  Description of Artificial Sequence: Synthetic oligonucleotide
cucaaauauuagcauuau

SEQ ID NO: 37992 - RNA, 18 nt, Artificial Sequence
  Description of Artificial Sequence: Synthetic oligonucleotide
uauugcucaaauauuagc

SEQ ID NO: 37993 - RNA, 18 nt, Artificial Sequence
  Description of Artificial Sequence: Synthetic oligonucleotide
cucuguauugcucaaaua

SEQ ID NO: 37994 - RNA, 18 nt, Artificial Sequence
  Description of Artificial Sequence: Synthetic oligonucleotide
uaauccucuguauugcuc

SEQ ID NO: 37995 - RNA, 18 nt, Artificial Sequence
  Description of Artificial Sequence: Synthetic oligonucleotide
ucucuuaauccucuguau

SEQ ID NO: 37996 - RNA, 18 nt, Artificial Sequence
  Description of Artificial Sequence: Synthetic oligonucleotide
cuugaucucuuaauccuc

SEQ ID NO: 37997 - RNA, 18 nt, Artificial Sequence
  Description of Artificial Sequence: Synthetic oligonucleotide
aguaucuugaucucuuaa

SEQ ID NO: 37998 - RNA, 18 nt, Artificial Sequence
  Description of Artificial Sequence: Synthetic oligonucleotide
agugaaguaucuugaucu

SEQ ID NO: 37999 - RNA, 18 nt, Artificial Sequence
  Description of Artificial Sequence: Synthetic oligonucleotide
uaggcagugaaguaucuu

SEQ ID NO: 38000 - RNA, 18 nt, Artificial Sequence
  Description of Artificial Sequence: Synthetic oligonucleotide
gcuaauaggcagugaagu

SEQ ID NO: 38001 - RNA, 18 nt, Artificial Sequence
  Description of Artificial Sequence: Synthetic oligonucleotide
auuaggcuaauaggcagu

SEQ ID NO: 38002 - RNA, 18 nt, Artificial Sequence
  Description of Artificial Sequence: Synthetic oligonucleotide
ucccuauuaggcuaauag

SEQ ID NO: 38003 - RNA, 18 nt, Artificial Sequence
  Description of Artificial Sequence: Synthetic oligonucleotide
agguaucccuauuaggcu

SEQ ID NO: 38004 - RNA, 18 nt, Artificial Sequence
  Description of Artificial Sequence: Synthetic oligonucleotide
aaaguagguaucccuauu

SEQ ID NO: 38005 - RNA, 18 nt, Artificial Sequence
  Description of Artificial Sequence: Synthetic oligonucleotide
gaaagaaaguagguaucc

SEQ ID NO: 38006 - RNA, 18 nt, Artificial Sequence
  Description of Artificial Sequence: Synthetic oligonucleotide
cauuugaaagaaaguagg

SEQ ID NO: 38007 - RNA, 18 nt, Artificial Sequence
  Description of Artificial Sequence: Synthetic oligonucleotide
uuuggcauuugaaagaaa

SEQ ID NO: 38008 - RNA, 18 nt, Artificial Sequence
  Description of Artificial Sequence: Synthetic oligonucleotide
gaauuuuuggcauuugaa

SEQ ID NO: 38009 - RNA, 18 nt, Artificial Sequence
  Description of Artificial Sequence: Synthetic oligonucleotide
aaugugaauuuuuggcau

SEQ ID NO: 38010 - RNA, 18 nt, Artificial Sequence
  Description of Artificial Sequence: Synthetic oligonucleotide
uuucuaaugugaauuuuu

SEQ ID NO: 38011 - RNA, 18 nt, Artificial Sequence
  Description of Artificial Sequence: Synthetic oligonucleotide
uuauguuucuaaugugaa

SEQ ID NO: 38012 - RNA, 18 nt, Artificial Sequence
  Description of Artificial Sequence: Synthetic oligonucleotide
cuggauuauguuucuaau

SEQ ID NO: 38013 - RNA, 18 nt, Artificial Sequence
  Description of Artificial Sequence: Synthetic oligonucleotide
cauaucuggauuauguuu

SEQ ID NO: 38014 - RNA, 18 nt, Artificial Sequence
  Description of Artificial Sequence: Synthetic oligonucleotide
uaacacauaucuggauua

SEQ ID NO: 38015 - RNA, 18 nt, Artificial Sequence
  Description of Artificial Sequence: Synthetic oligonucleotide
uaaaauaacacauaucug

SEQ ID NO: 38016 - RNA, 18 nt, Artificial Sequence
  Description of Artificial Sequence: Synthetic oligonucleotide
auauauaaaauaacacau

SEQ ID NO: 38017 - RNA, 18 nt, Artificial Sequence
  Description of Artificial Sequence: Synthetic oligonucleotide
uauauauauauaaaauaa

SEQ ID NO: 38018 - RNA, 18 nt, Artificial Sequence
  Description of Artificial Sequence: Synthetic oligonucleotide
uuguauauauauauauaa

SEQ ID NO: 38019 - RNA, 18 nt, Artificial Sequence
  Description of Artificial Sequence: Synthetic oligonucleotide
cuguuuuguauauauaua

SEQ ID NO: 38020 - RNA, 18 nt, Artificial Sequence
  Description of Artificial Sequence: Synthetic oligonucleotide
auuuacuguuuuguauau

SEQ ID NO: 38021 - RNA, 18 nt, Artificial Sequence
  Description of Artificial Sequence: Synthetic oligonucleotide
aaaccauuuacuguuuug

SEQ ID NO: 38022 - RNA, 18 nt, Artificial Sequence
  Description of Artificial Sequence: Synthetic oligonucleotide
uuaagaaaccauuuacug

SEQ ID NO: 38023 - RNA, 18 nt, Artificial Sequence
  Description of Artificial Sequence: Synthetic oligonucleotide
uaauuuuaagaaaccauu

SEQ ID NO: 38024 - RNA, 18 nt, Artificial Sequence
  Description of Artificial Sequence: Synthetic oligonucleotide
agcaauaauuuuaagaaa

SEQ ID NO: 38025 - RNA, 18 nt, Artificial Sequence
  Description of Artificial Sequence: Synthetic oligonucleotide
aaaauagcaauaauuuua

SEQ ID NO: 38026 - RNA, 18 nt, Artificial Sequence
  Description of Artificial Sequence: Synthetic oligonucleotide
guugaaaaauagcaauaa

SEQ ID NO: 38027 - RNA, 18 nt, Artificial Sequence
  Description of Artificial Sequence: Synthetic oligonucleotide
ggguugaaaaauagcaau

SEQ ID NO: 38028 - RNA, 18 nt, Artificial Sequence
  Description of Artificial Sequence: Synthetic oligonucleotide
uuuucuccaguuuaaggg

SEQ ID NO: 38029 - RNA, 18 nt, Artificial Sequence
  Description of Artificial Sequence: Synthetic oligonucleotide
aauguuuuucuccaguuu

SEQ ID NO: 38030 - RNA, 18 nt, Artificial Sequence
  Description of Artificial Sequence: Synthetic oligonucleotide
aauuaaauguuuuucucc

SEQ ID NO: 38031 - RNA, 18 nt, Artificial Sequence
  Description of Artificial Sequence: Synthetic oligonucleotide
uuacuaauuaaauguuuu

SEQ ID NO: 38032 - RNA, 18 nt, Artificial Sequence
  Description of Artificial Sequence: Synthetic oligonucleotide
auguuuuacuaauuaaau

SEQ ID NO: 38033 - RNA, 18 nt, Artificial Sequence
  Description of Artificial Sequence: Synthetic oligonucleotide
aauuaauguuuuacuaau

SEQ ID NO: 38034 - RNA, 18 nt, Artificial Sequence
  Description of Artificial Sequence: Synthetic oligonucleotide
aaauuaauuaauguuuua

SEQ ID NO: 38035 - RNA, 18 nt, Artificial Sequence
  Description of Artificial Sequence: Synthetic oligonucleotide
aaaguaaauuaauuaaug

SEQ ID NO: 38036 - RNA, 18 nt, Artificial Sequence
  Description of Artificial Sequence: Synthetic oligonucleotide
aaauuaaaguaaauuaau

SEQ ID NO: 38037 - RNA, 18 nt, Artificial Sequence
  Description of Artificial Sequence: Synthetic oligonucleotide
gggaaaaauuaaaguaaa

SEQ ID NO: 38038 - RNA, 18 nt, Artificial Sequence
  Description of Artificial Sequence: Synthetic oligonucleotide
gagaugggaaaaauuaaa

SEQ ID NO: 38039 - RNA, 18 nt, Artificial Sequence
  Description of Artificial Sequence: Synthetic oligonucleotide
acugagagaugggaaaaa

SEQ ID NO: 38040 - RNA, 18 nt, Artificial Sequence
  Description of Artificial Sequence: Synthetic oligonucleotide
ccacuacugagagauggg

SEQ ID NO: 38041 - RNA, 18 nt, Artificial Sequence
  Description of Artificial Sequence: Synthetic oligonucleotide
ccccgccacuacugagag

SEQ ID NO: 38042 - RNA, 18 nt, Artificial Sequence
  Description of Artificial Sequence: Synthetic oligonucleotide
uuccuccccgccacuacu

SEQ ID NO: 38043 - RNA, 18 nt, Artificial Sequence
  Description of Artificial Sequence: Synthetic oligonucleotide
uuguguuccuccccgcca

SEQ ID NO: 38044 - RNA, 18 nt, Artificial Sequence
  Description of Artificial Sequence: Synthetic oligonucleotide
aacuguuguguuccuccc

SEQ ID NO: 38045 - RNA, 18 nt, Artificial Sequence
  Description of Artificial Sequence: Synthetic oligonucleotide
uugaaaacuguuguguuc

SEQ ID NO: 38046 - RNA, 18 nt, Artificial Sequence
  Description of Artificial Sequence: Synthetic oligonucleotide
auagauugaaaacuguug

SEQ ID NO: 38047 - RNA, 18 nt, Artificial Sequence
  Description of Artificial Sequence: Synthetic oligonucleotide
cagacauagauugaaaac

SEQ ID NO: 38048 - RNA, 18 nt, Artificial Sequence
  Description of Artificial Sequence: Synthetic oligonucleotide
cuaugcagacauagauug

SEQ ID NO: 38049 - RNA, 18 nt, Artificial Sequence
  Description of Artificial Sequence: Synthetic oligonucleotide
cacaacuaugcagacaua

SEQ ID NO: 38050 - RNA, 18 nt, Artificial Sequence
  Description of Artificial Sequence: Synthetic oligonucleotide
cucuacacaacuaugcag

SEQ ID NO: 38051 - RNA, 18 nt, Artificial Sequence
  Description of Artificial Sequence: Synthetic oligonucleotide
ugcagcucuacacaacua

SEQ ID NO: 38052 - RNA, 18 nt, Artificial Sequence
  Description of Artificial Sequence: Synthetic oligonucleotide
aauucugcagcucuacac

SEQ ID NO: 38053 - RNA, 18 nt, Artificial Sequence
  Description of Artificial Sequence: Synthetic oligonucleotide
acuaaaauucugcagcuc

SEQ ID NO: 38054 - RNA, 18 nt, Artificial Sequence
  Description of Artificial Sequence: Synthetic oligonucleotide
auccaacuaaaauucugc

SEQ ID NO: 38055 - RNA, 18 nt, Artificial Sequence
  Description of Artificial Sequence: Synthetic oligonucleotide
uaaaaauccaacuaaaau

SEQ ID NO: 38056 - RNA, 18 nt, Artificial Sequence
  Description of Artificial Sequence: Synthetic oligonucleotide
caaauuaaaaauccaacu

SEQ ID NO: 38057 - RNA, 18 nt, Artificial Sequence
  Description of Artificial Sequence: Synthetic oligonucleotide
ucauccaaauuaaaaauc

SEQ ID NO: 38058 - RNA, 18 nt, Artificial Sequence
  Description of Artificial Sequence: Synthetic oligonucleotide
agggaucauccaaauuaa

SEQ ID NO: 38059 - RNA, 18 nt, Artificial Sequence
  Description of Artificial Sequence: Synthetic oligonucleotide
cugucagggaucauccaa

SEQ ID NO: 38060 - RNA, 18 nt, Artificial Sequence
  Description of Artificial Sequence: Synthetic oligonucleotide
gggcugucagggaucauc

SEQ ID NO: 38061 - RNA, 18 nt, Artificial Sequence
  Description of Artificial Sequence: Synthetic oligonucleotide
uagccugacuaguuuggg

SEQ ID NO: 38062 - RNA, 18 nt, Artificial Sequence
  Description of Artificial Sequence: Synthetic oligonucleotide
cuuauuagccugacuagu

SEQ ID NO: 38063 - RNA, 18 nt, Artificial Sequence
  Description of Artificial Sequence: Synthetic oligonucleotide
aaauacuuauuagccuga

SEQ ID NO: 38064 - RNA, 18 nt, Artificial Sequence
  Description of Artificial Sequence: Synthetic oligonucleotide
gccucaaauacuuauuag

SEQ ID NO: 38065 - RNA, 18 nt, Artificial Sequence
  Description of Artificial Sequence: Synthetic oligonucleotide
auuuugccucaaauacuu

SEQ ID NO: 38066 - RNA, 18 nt, Artificial Sequence
  Description of Artificial Sequence: Synthetic oligonucleotide
aagccauuuugccucaaa

SEQ ID NO: 38067 - RNA, 18 nt, Artificial Sequence
  Description of Artificial Sequence: Synthetic oligonucleotide
gauuaaagccauuuugcc

SEQ ID NO: 38068 - RNA, 18 nt, Artificial Sequence
  Description of Artificial Sequence: Synthetic oligonucleotide
uguuagauuaaagccauu

SEQ ID NO: 38069 - RNA, 18 nt, Artificial Sequence
  Description of Artificial Sequence: Synthetic oligonucleotide
uaaauuguuagauuaaag

SEQ ID NO: 38070 - RNA, 18 nt, Artificial Sequence
  Description of Artificial Sequence: Synthetic oligonucleotide
cucaguaaauuguuagau

SEQ ID NO: 38071 - RNA, 18 nt, Artificial Sequence
  Description of Artificial Sequence: Synthetic oligonucleotide
guaaacucaguaaauugu

SEQ ID NO: 38072 - RNA, 18 nt, Artificial Sequence
  Description of Artificial Sequence: Synthetic oligonucleotide
uucagguaaacucaguaa

SEQ ID NO: 38073 - RNA, 18 nt, Artificial Sequence
  Description of Artificial Sequence: Synthetic oligonucleotide
ccaacuucagguaaacuc

SEQ ID NO: 38074 - RNA, 18 nt, Artificial Sequence
  Description of Artificial Sequence: Synthetic oligonucleotide
uuuagccaacuucaggua

SEQ ID NO: 38075 - RNA, 18 nt, Artificial Sequence
  Description of Artificial Sequence: Synthetic oligonucleotide
uguuauuuagccaacuuc

SEQ ID NO: 38076 - RNA, 18 nt, Artificial Sequence
  Description of Artificial Sequence: Synthetic oligonucleotide
uacaguguuauuuagcca

SEQ ID NO: 38077 - RNA, 18 nt, Artificial Sequence
  Description of Artificial Sequence: Synthetic oligonucleotide
aaacauacaguguuauuu

SEQ ID NO: 38078 - RNA, 18 nt, Artificial Sequence
  Description of Artificial Sequence: Synthetic oligonucleotide
aaguuaaacauacagugu

SEQ ID NO: 38079 - RNA, 18 nt, Artificial Sequence
  Description of Artificial Sequence: Synthetic oligonucleotide
gguagaaguuaaacauac

SEQ ID NO: 38080 - RNA, 18 nt, Artificial Sequence
  Description of Artificial Sequence: Synthetic oligonucleotide
guagagguagaaguuaaa

SEQ ID NO: 38081 - RNA, 18 nt, Artificial Sequence
  Description of Artificial Sequence: Synthetic oligonucleotide
cuuauguagagguagaag

SEQ ID NO: 38082 - RNA, 18 nt, Artificial Sequence
  Description of Artificial Sequence: Synthetic oligonucleotide
uucaacuuauguagaggu

SEQ ID NO: 38083 - RNA, 18 nt, Artificial Sequence
  Description of Artificial Sequence: Synthetic oligonucleotide
cagcauucaacuuaugua

SEQ ID NO: 38084 - RNA, 18 nt, Artificial Sequence
  Description of Artificial Sequence: Synthetic oligonucleotide
uuuaucagcauucaacuu

SEQ ID NO: 38085 - RNA, 18 nt, Artificial Sequence
  Description of Artificial Sequence: Synthetic oligonucleotide
uuccuuuuaucagcauuc

SEQ ID NO: 38086 - RNA, 18 nt, Artificial Sequence
  Description of Artificial Sequence: Synthetic oligonucleotide
acuaguuccuuuuaucag

SEQ ID NO: 38087 - RNA, 18 nt, Artificial Sequence
  Description of Artificial Sequence: Synthetic oligonucleotide
uaucuacuaguuccuuuu

SEQ ID NO: 38088 - RNA, 18 nt, Artificial Sequence
  Description of Artificial Sequence: Synthetic oligonucleotide
auaguuaucuacuaguuc

SEQ ID NO: 38089 - RNA, 18 nt, Artificial Sequence
  Description of Artificial Sequence: Synthetic oligonucleotide
uauacauaguuaucuacu

SEQ ID NO: 38090 - RNA, 18 nt, Artificial Sequence
  Description of Artificial Sequence: Synthetic oligonucleotide
aucaauauacauaguuau

SEQ ID NO: 38091 - RNA, 18 nt, Artificial Sequence
  Description of Artificial Sequence: Synthetic oligonucleotide
ugcuuaucaauauacaua

SEQ ID NO: 38092 - RNA, 18 nt, Artificial Sequence
  Description of Artificial Sequence: Synthetic oligonucleotide
aacagugcuuaucaauau

SEQ ID NO: 38093 - RNA, 18 nt, Artificial Sequence
  Description of Artificial Sequence: Synthetic oligonucleotide
uucuuaacagugcuuauc

SEQ ID NO: 38094 - RNA, 18 nt, Artificial Sequence
  Description of Artificial Sequence: Synthetic oligonucleotide
gcauuuucuuaacagugc

SEQ ID NO: 38095 - RNA, 18 nt, Artificial Sequence
  Description of Artificial Sequence: Synthetic oligonucleotide
uuuuugcauuuucuuaac

SEQ ID NO: 38096 - RNA, 18 nt, Artificial Sequence
  Description of Artificial Sequence: Synthetic oligonucleotide
aaauauuuuugcauuuuc

SEQ ID NO: 38097 - RNA, 18 nt, Artificial Sequence
  Description of Artificial Sequence: Synthetic oligonucleotide
uuuagaaauauuuuugca

SEQ ID NO: 38098 - RNA, 18 nt, Artificial Sequence
  Description of Artificial Sequence: Synthetic oligonucleotide
aaguguuuagaaauauuu

SEQ ID NO: 38099 - RNA, 18 nt, Artificial Sequence
  Description of Artificial Sequence: Synthetic oligonucleotide
uggaaaaguguuuagaaa

SEQ ID NO: 38100 - RNA, 18 nt, Artificial Sequence
  Description of Artificial Sequence: Synthetic oligonucleotide
acauuuggaaaaguguuu

SEQ ID NO: 38101 - RNA, 18 nt, Artificial Sequence
  Description of Artificial Sequence: Synthetic oligonucleotide
agaaaacauuuggaaaag

SEQ ID NO: 38102 - RNA, 18 nt, Artificial Sequence
  Description of Artificial Sequence: Synthetic oligonucleotide
aaaguagaaaacauuugg

SEQ ID NO: 38103 - RNA, 18 nt, Artificial Sequence
  Description of Artificial Sequence: Synthetic oligonucleotide
aacuuaaaguagaaaaca

SEQ ID NO: 38104 - RNA, 18 nt, Artificial Sequence
  Description of Artificial Sequence: Synthetic oligonucleotide
uuucuaacuuaaaguaga

SEQ ID NO: 38105 - RNA, 18 nt, Artificial Sequence
  Description of Artificial Sequence: Synthetic oligonucleotide
aacuauuucuaacuuaaa

SEQ ID NO: 38106 - RNA, 18 nt, Artificial Sequence
  Description of Artificial Sequence: Synthetic oligonucleotide
uuugaaacuauuucuaac

SEQ ID NO: 38107 - RNA, 18 nt, Artificial Sequence
  Description of Artificial Sequence: Synthetic oligonucleotide
ucagauuugaaacuauuu

SEQ ID NO: 38108 - RNA, 18 nt, Artificial Sequence
  Description of Artificial Sequence: Synthetic oligonucleotide
uauucucagauuugaaac

SEQ ID NO: 38109 - RNA, 18 nt, Artificial Sequence
  Description of Artificial Sequence: Synthetic oligonucleotide
guguuuauucucagauuu

SEQ ID NO: 38110 - RNA, 18 nt, Artificial Sequence
  Description of Artificial Sequence: Synthetic oligonucleotide
auauaguguuuauucuca

SEQ ID NO: 38111 - RNA, 18 nt, Artificial Sequence
  Description of Artificial Sequence: Synthetic oligonucleotide
agauuauauaguguuuau

SEQ ID NO: 38112 - RNA, 18 nt, Artificial Sequence
  Description of Artificial Sequence: Synthetic oligonucleotide
agugcagauuauauagug

SEQ ID NO: 38113 - RNA, 18 nt, Artificial Sequence
  Description of Artificial Sequence: Synthetic oligonucleotide
uauaaagugcagauuaua

SEQ ID NO: 38114 - RNA, 18 nt, Artificial Sequence
  Description of Artificial Sequence: Synthetic oligonucleotide
caaccuauaaagugcaga

SEQ ID NO: 38115 - RNA, 18 nt, Artificial Sequence
  Description of Artificial Sequence: Synthetic oligonucleotide
gcacccaaccuauaaagu

SEQ ID NO: 38116 - RNA, 18 nt, Artificial Sequence
  Description of Artificial Sequence: Synthetic oligonucleotide
acacugcacccaaccuau

SEQ ID NO: 38117 - RNA, 18 nt, Artificial Sequence
  Description of Artificial Sequence: Synthetic oligonucleotide
augagacacugcacccaa

SEQ ID NO: 38118 - RNA, 18 nt, Artificial Sequence
  Description of Artificial Sequence: Synthetic oligonucleotide
caggcaugagacacugca

SEQ ID NO: 38119 - RNA, 18 nt, Artificial Sequence
  Description of Artificial Sequence: Synthetic oligonucleotide
gauuacaggcaugagaca

SEQ ID NO: 38120 - RNA, 18 nt, Artificial Sequence
  Description of Artificial Sequence: Synthetic oligonucleotide
gcugggauuacaggcaug

SEQ ID NO: 38121 - RNA, 18 nt, Artificial Sequence
  Description of Artificial Sequence: Synthetic oligonucleotide
aaagugcugggauuacag

SEQ ID NO: 38122 - RNA, 18 nt, Artificial Sequence
  Description of Artificial Sequence: Synthetic oligonucleotide
cuuccaaagugcugggau

SEQ ID NO: 38123 - RNA, 18 nt, Artificial Sequence
  Description of Artificial Sequence: Synthetic oligonucleotide
uuggccuuccaaagugcu

SEQ ID NO: 38124 - RNA, 18 nt, Artificial Sequence
  Description of Artificial Sequence: Synthetic oligonucleotide
cugccuuggccuuccaaa

SEQ ID NO: 38125 - RNA, 18 nt, Artificial Sequence
  Description of Artificial Sequence: Synthetic oligonucleotide
uccuccugccuuggccuu

SEQ ID NO: 38126 - RNA, 18 nt, Artificial Sequence
  Description of Artificial Sequence: Synthetic oligonucleotide
agcaauccuccugccuug

SEQ ID NO: 38127 - RNA, 18 nt, Artificial Sequence
  Description of Artificial Sequence: Synthetic oligonucleotide
ccucaagcaauccuccug

SEQ ID NO: 38128 - RNA, 18 nt, Artificial Sequence
  Description of Artificial Sequence: Synthetic oligonucleotide
ccuggccucaagcaaucc

SEQ ID NO: 38129 - RNA, 18 nt, Artificial Sequence
  Description of Artificial Sequence: Synthetic oligonucleotide
gaauuccuggccucaagc

SEQ ID NO: 38130 - RNA, 18 nt, Artificial Sequence
  Description of Artificial Sequence: Synthetic oligonucleotide
gucuugaauuccuggccu

SEQ ID NO: 38131 - RNA, 18 nt, Artificial Sequence
  Description of Artificial Sequence: Synthetic oligonucleotide
ggcuggucuugaauuccu

SEQ ID NO: 38132 - RNA, 18 nt, Artificial Sequence
  Description of Artificial Sequence: Synthetic oligonucleotide
ucccaggcuggucuugaa

SEQ ID NO: 38133 - RNA, 18 nt, Artificial Sequence
  Description of Artificial Sequence: Synthetic oligonucleotide
uuguuucccaggcugguc

SEQ ID NO: 38134 - RNA, 18 nt, Artificial Sequence
  Description of Artificial Sequence: Synthetic oligonucleotide
ucacuuuguuucccaggc

SEQ ID NO: 38135 - RNA, 18 nt, Artificial Sequence
  Description of Artificial Sequence: Synthetic oligonucleotide
gggucucacuuuguuucc

SEQ ID NO: 38136 - RNA, 18 nt, Artificial Sequence
  Description of Artificial Sequence: Synthetic oligonucleotide
agacagggucucacuuug

SEQ ID NO: 38137 - RNA, 18 nt, Artificial Sequence
  Description of Artificial Sequence: Synthetic oligonucleotide
uguaaagacagggucuca

SEQ ID NO: 38138 - RNA, 18 nt, Artificial Sequence
  Description of Artificial Sequence: Synthetic oligonucleotide
uuuuuuguaaagacaggg

SEQ ID NO: 38139 - RNA, 18 nt, Artificial Sequence
  Description of Artificial Sequence: Synthetic oligonucleotide
uuuuauuuuuuguaaaga

SEQ ID NO: 38140 - RNA, 18 nt, Artificial Sequence
  Description of Artificial Sequence: Synthetic oligonucleotide
uuuguuuuuauuuuuugu

SEQ ID NO: 38141 - RNA, 18 nt, Artificial Sequence
  Description of Artificial Sequence: Synthetic oligonucleotide
aaauuuuuguuuuuauuu

SEQ ID NO: 38142 - RNA, 18 nt, Artificial Sequence
  Description of Artificial Sequence: Synthetic oligonucleotide
guuuuaaauuuuuguuuu

SEQ ID NO: 38143 - RNA, 18 nt, Artificial Sequence
  Description of Artificial Sequence: Synthetic oligonucleotide
auacaguuuuaaauuuuu

SEQ ID NO: 38144 - RNA, 18 nt, Artificial Sequence
  Description of Artificial Sequence: Synthetic oligonucleotide
agauuauacaguuuuaaa

SEQ ID NO: 38145 - RNA, 18 nt, Artificial Sequence
  Description of Artificial Sequence: Synthetic oligonucleotide
agugcagauuauacaguu

SEQ ID NO: 38146 - RNA, 18 nt, Artificial Sequence
  Description of Artificial Sequence: Synthetic oligonucleotide
cauaaagugcagauuaua

SEQ ID NO: 38147 - RNA, 18 nt, Artificial Sequence
  Description of Artificial Sequence: Synthetic oligonucleotide
uuuagcauaaagugcaga

SEQ ID NO: 38148 - RNA, 18 nt, Artificial Sequence
  Description of Artificial Sequence: Synthetic oligonucleotide
gcuaguuuagcauaaagu

SEQ ID NO: 38149 - RNA, 18 nt, Artificial Sequence
  Description of Artificial Sequence: Synthetic oligonucleotide
gcacagcuaguuuagcau

SEQ ID NO: 38150 - RNA, 18 nt, Artificial Sequence
  Description of Artificial Sequence: Synthetic oligonucleotide
uaagagcacagcuaguuu

SEQ ID NO: 38151 - RNA, 18 nt, Artificial Sequence
  Description of Artificial Sequence: Synthetic oligonucleotide
gaguuuaagagcacagcu

SEQ ID NO: 38152 - RNA, 18 nt, Artificial Sequence
  Description of Artificial Sequence: Synthetic oligonucleotide
aaauugaguuuaagagca

SEQ ID NO: 38153 - RNA, 18 nt, Artificial Sequence
  Description of Artificial Sequence: Synthetic oligonucleotide
ugaaaaaauugaguuuaa

SEQ ID NO: 38154 - RNA, 18 nt, Artificial Sequence
  Description of Artificial Sequence: Synthetic oligonucleotide
agagcugaaaaaauugag

SEQ ID NO: 38155 - RNA, 18 nt, Artificial Sequence
  Description of Artificial Sequence: Synthetic oligonucleotide
uuauuagagcugaaaaaa

SEQ ID NO: 38156 - RNA, 18 nt, Artificial Sequence
  Description of Artificial Sequence: Synthetic oligonucleotide
gcccuuuauuagagcuga

SEQ ID NO: 38157 - RNA, 18 nt, Artificial Sequence
  Description of Artificial Sequence: Synthetic oligonucleotide
auuaagcccuuuauuaga

SEQ ID NO: 38158 - RNA, 18 nt, Artificial Sequence
  Description of Artificial Sequence: Synthetic oligonucleotide
aucaaauuaagcccuuua

SEQ ID NO: 38159 - RNA, 18 nt, Artificial Sequence
  Description of Artificial Sequence: Synthetic oligonucleotide
auucuaucaaauuaagcc

SEQ ID NO: 38160 - RNA, 18 nt, Artificial Sequence
  Description of Artificial Sequence: Synthetic oligonucleotide
gaauaauucuaucaaauu

SEQ ID NO: 38161 - RNA, 18 nt, Artificial Sequence
  Description of Artificial Sequence: Synthetic oligonucleotide
ucguagaauaauucuauc

SEQ ID NO: 38162 - RNA, 18 nt, Artificial Sequence
  Description of Artificial Sequence: Synthetic oligonucleotide
uuuaaucguagaauaauu

SEQ ID NO: 38163 - RNA, 18 nt, Artificial Sequence
  Description of Artificial Sequence: Synthetic oligonucleotide
caaaauuuaaucguagaa

SEQ ID NO: 38164 - RNA, 18 nt, Artificial Sequence
  Description of Artificial Sequence: Synthetic oligonucleotide
gucuucaaaauuuaaucg

SEQ ID NO: 38165 - RNA, 18 nt, Artificial Sequence
  Description of Artificial Sequence: Synthetic oligonucleotide
aaacagucuucaaaauuu

SEQ ID NO: 38166 - RNA, 18 nt, Artificial Sequence
  Description of Artificial Sequence: Synthetic oligonucleotide
agugaaaacagucuucaa

SEQ ID NO: 38167 - RNA, 18 nt, Artificial Sequence
  Description of Artificial Sequence: Synthetic oligonucleotide
aggagagugaaaacaguc

SEQ ID NO: 38168 - RNA, 18 nt, Artificial Sequence
  Description of Artificial Sequence: Synthetic oligonucleotide
ggcagaggagagugaaaa

SEQ ID NO: 38169 - RNA, 18 nt, Artificial Sequence
  Description of Artificial Sequence: Synthetic oligonucleotide
ugggcggcagaggagagu

SEQ ID NO: 38170 - RNA, 18 nt, Artificial Sequence
  Description of Artificial Sequence: Synthetic oligonucleotide
ugcuaugggcggcagagg

SEQ ID NO: 38171 - RNA, 18 nt, Artificial Sequence
  Description of Artificial Sequence: Synthetic oligonucleotide
agucuugcuaugggcggc

SEQ ID NO: 38172 - RNA, 18 nt, Artificial Sequence
  Description of Artificial Sequence: Synthetic oligonucleotide
gaagcagucuugcuaugg

SEQ ID NO: 38173 - RNA, 18 nt, Artificial Sequence
  Description of Artificial Sequence: Synthetic oligonucleotide
cuauggaagcagucuugc

SEQ ID NO: 38174 - RNA, 18 nt, Artificial Sequence
  Description of Artificial Sequence: Synthetic oligonucleotide
gaaaucuauggaagcagu

SEQ ID NO: 38175 - RNA, 18 nt, Artificial Sequence
  Description of Artificial Sequence: Synthetic oligonucleotide
ucugagaaaucuauggaa

SEQ ID NO: 38176 - RNA, 18 nt, Artificial Sequence
  Description of Artificial Sequence: Synthetic oligonucleotide
acgguucugagaaaucua

SEQ ID NO: 38177 - RNA, 18 nt, Artificial Sequence
  Description of Artificial Sequence: Synthetic oligonucleotide
uggcuacgguucugagaa

SEQ ID NO: 38178 - RNA, 18 nt, Artificial Sequence
  Description of Artificial Sequence: Synthetic oligonucleotide
agaacuggcuacgguucu

SEQ ID NO: 38179 - RNA, 18 nt, Artificial Sequence
  Description of Artificial Sequence: Synthetic oligonucleotide
uagccagaacuggcuacg

SEQ ID NO: 38180 - RNA, 18 nt, Artificial Sequence
  Description of Artificial Sequence: Synthetic oligonucleotide
ccaaauagccagaacugg

SEQ ID NO: 38181 - RNA, 18 nt, Artificial Sequence
  Description of Artificial Sequence: Synthetic oligonucleotide
cuugaccaaauagccaga

SEQ ID NO: 38182 - RNA, 18 nt, Artificial Sequence
  Description of Artificial Sequence: Synthetic oligonucleotide
ccagacuugaccaaauag

SEQ ID NO: 38183 - RNA, 18 nt, Artificial Sequence
  Description of Artificial Sequence: Synthetic oligonucleotide
ggaucccagacuugacca

SEQ ID NO: 38184 - RNA, 18 nt, Artificial Sequence
  Description of Artificial Sequence: Synthetic oligonucleotide
aagagggaucccagacuu

SEQ ID NO: 38185 - RNA, 18 nt, Artificial Sequence
  Description of Artificial Sequence: Synthetic oligonucleotide
cagguaagagggauccca

SEQ ID NO: 38186 - RNA, 18 nt, Artificial Sequence
  Description of Artificial Sequence: Synthetic oligonucleotide
aauagcagguaagaggga

SEQ ID NO: 38187 - RNA, 18 nt, Artificial Sequence
  Description of Artificial Sequence: Synthetic oligonucleotide
ugcagaauagcagguaag

SEQ ID NO: 38188 - RNA, 18 nt, Artificial Sequence
  Description of Artificial Sequence: Synthetic oligonucleotide
gcagcugcagaauagcag

SEQ ID NO: 38189 - RNA, 18 nt, Artificial Sequence
  Description of Artificial Sequence: Synthetic oligonucleotide
agaaagcagcugcagaau

SEQ ID NO: 38190 - RNA, 18 nt, Artificial Sequence
  Description of Artificial Sequence: Synthetic oligonucleotide
gacagagaaagcagcugc

SEQ ID NO: 38191 - RNA, 18 nt, Artificial Sequence
  Description of Artificial Sequence: Synthetic oligonucleotide
uguaagacagagaaagca

SEQ ID NO: 38192 - RNA, 18 nt, Artificial Sequence
  Description of Artificial Sequence: Synthetic oligonucleotide
aaaaauguaagacagaga

SEQ ID NO: 38193 - RNA, 18 nt, Artificial Sequence
  Description of Artificial Sequence: Synthetic oligonucleotide
gcccaaaaaauguaagac

SEQ ID NO: 38194 - RNA, 18 nt, Artificial Sequence
  Description of Artificial Sequence: Synthetic oligonucleotide
acguggcccaaaaaaugu

SEQ ID NO: 38195 - RNA, 18 nt, Artificial Sequence
  Description of Artificial Sequence: Synthetic oligonucleotide
auuagacguggcccaaaa

SEQ ID NO: 38196 - RNA, 18 nt, Artificial Sequence
  Description of Artificial Sequence: Synthetic oligonucleotide
uuaagauuagacguggcc

SEQ ID NO: 38197 - RNA, 18 nt, Artificial Sequence
  Description of Artificial Sequence: Synthetic oligonucleotide
acucuuuaagauuagacg

SEQ ID NO: 38198 - RNA, 18 nt, Artificial Sequence
  Description of Artificial Sequence: Synthetic oligonucleotide
aguuuacucuuuaagauu

SEQ ID NO: 38199 - RNA, 18 nt, Artificial Sequence
  Description of Artificial Sequence: Synthetic oligonucleotide
gguagaguuuacucuuua

SEQ ID NO: 38200 - RNA, 18 nt, Artificial Sequence
  Description of Artificial Sequence: Synthetic oligonucleotide
ccaaggguagaguuuacu

SEQ ID NO: 38201 - RNA, 18 nt, Artificial Sequence
  Description of Artificial Sequence: Synthetic oligonucleotide
gcaaaccaaggguagagu

SEQ ID NO: 38202 - RNA, 18 nt, Artificial Sequence
  Description of Artificial Sequence: Synthetic oligonucleotide
acuaugcaaaccaagggu

SEQ ID NO: 38203 - RNA, 18 nt, Artificial Sequence
  Description of Artificial Sequence: Synthetic oligonucleotide
ugcacacuaugcaaacca

SEQ ID NO: 38204 - RNA, 18 nt, Artificial Sequence
  Description of Artificial Sequence: Synthetic oligonucleotide
ugucaugcacacuaugca

SEQ ID NO: 38205 - RNA, 18 nt, Artificial Sequence
  Description of Artificial Sequence: Synthetic oligonucleotide
auuuuugucaugcacacu

SEQ ID NO: 38206 - RNA, 18 nt, Artificial Sequence
  Description of Artificial Sequence: Synthetic oligonucleotide
uuguuauuuuugucaugc

SEQ ID NO: 38207 - RNA, 18 nt, Artificial Sequence
  Description of Artificial Sequence: Synthetic oligonucleotide
uauucuuguuauuuuugu

SEQ ID NO: 38208 - RNA, 18 nt, Artificial Sequence
  Description of Artificial Sequence: Synthetic oligonucleotide
accauuauucuuguuauu

SEQ ID NO: 38209 - RNA, 18 nt, Artificial Sequence
  Description of Artificial Sequence: Synthetic oligonucleotide
ucauuaccauuauucuug

SEQ ID NO: 38210 - RNA, 18 nt, Artificial Sequence
  Description of Artificial Sequence: Synthetic oligonucleotide
uuucaucauuaccauuau

SEQ ID NO: 38211 - RNA, 18 nt, Artificial Sequence
  Description of Artificial Sequence: Synthetic oligonucleotide
aucauuuucaucauuacc

SEQ ID NO: 38212 - RNA, 18 nt, Artificial Sequence
  Description of Artificial Sequence: Synthetic oligonucleotide
cucuuaucauuuucauca

SEQ ID NO: 38213 - RNA, 18 nt, Artificial Sequence
  Description of Artificial Sequence: Synthetic oligonucleotide
uuuugcucuuaucauuuu

SEQ ID NO: 38214 - RNA, 18 nt, Artificial Sequence
  Description of Artificial Sequence: Synthetic oligonucleotide
acaaauuuugcucuuauc

SEQ ID NO: 38215 - RNA, 18 nt, Artificial Sequence
  Description of Artificial Sequence: Synthetic oligonucleotide
acuccacaaauuuugcuc

SEQ ID NO: 38216 - RNA, 18 nt, Artificial Sequence
  Description of Artificial Sequence: Synthetic oligonucleotide
aaagcacuccacaaauuu

SEQ ID NO: 38217 - RNA, 18 nt, Artificial Sequence
  Description of Artificial Sequence: Synthetic oligonucleotide
uguggaaagcacuccaca

SEQ ID NO: 38218 - RNA, 18 nt, Artificial Sequence
  Description of Artificial Sequence: Synthetic oligonucleotide
uggaauguggaaagcacu

SEQ ID NO: 38219 - RNA, 18 nt, Artificial Sequence
  Description of Artificial Sequence: Synthetic oligonucleotide
uuaccuggaauguggaaa

SEQ ID NO: 38220 - RNA, 18 nt, Artificial Sequence
  Description of Artificial Sequence: Synthetic oligonucleotide
acacauuaccuggaaugu

SEQ ID NO: 38221 - RNA, 18 nt, Artificial Sequence
  Description of Artificial Sequence: Synthetic oligonucleotide
auguuacacauuaccugg

SEQ ID NO: 38222 - RNA, 18 nt, Artificial Sequence
  Description of Artificial Sequence: Synthetic oligonucleotide
auuguauguuacacauua

SEQ ID NO: 38223 - RNA, 18 nt, Artificial Sequence
  Description of Artificial Sequence: Synthetic oligonucleotide
auuaaauuguauguuaca

SEQ ID NO: 38224 - RNA, 18 nt, Artificial Sequence
  Description of Artificial Sequence: Synthetic oligonucleotide
uaagaauuaaauuguaug

SEQ ID NO: 38225 - RNA, 18 nt, Artificial Sequence
  Description of Artificial Sequence: Synthetic oligonucleotide
ugcuguaagaauuaaauu

SEQ ID NO: 38226 - RNA, 18 nt, Artificial Sequence
  Description of Artificial Sequence: Synthetic oligonucleotide
aagacugcuguaagaauu

SEQ ID NO: 38227 - RNA, 18 nt, Artificial Sequence
  Description of Artificial Sequence: Synthetic oligonucleotide
uccauaagacugcuguaa

SEQ ID NO: 38228 - RNA, 18 nt, Artificial Sequence
  Description of Artificial Sequence: Synthetic oligonucleotide
uucacuccauaagacugc

SEQ ID NO: 38229 - RNA, 18 nt, Artificial Sequence
  Description of Artificial Sequence: Synthetic oligonucleotide
guauuuucacuccauaag

SEQ ID NO: 38230 - RNA, 18 nt, Artificial Sequence
  Description of Artificial Sequence: Synthetic oligonucleotide
uaauaguauuuucacucc

SEQ ID NO: 38231 - RNA, 18 nt, Artificial Sequence
  Description of Artificial Sequence: Synthetic oligonucleotide
aaucauaauaguauuuuc

SEQ ID NO: 38232 - RNA, 18 nt, Artificial Sequence
  Description of Artificial Sequence: Synthetic oligonucleotide
acgggaaucauaauagua

SEQ ID NO: 38233 - RNA, 18 nt, Artificial Sequence
  Description of Artificial Sequence: Synthetic oligonucleotide
guaaaacgggaaucauaa

SEQ ID NO: 38234 - RNA, 18 nt, Artificial Sequence
  Description of Artificial Sequence: Synthetic oligonucleotide
caucuguaaaacgggaau

SEQ ID NO: 38235 - RNA, 18 nt, Artificial Sequence
  Description of Artificial Sequence: Synthetic oligonucleotide
ucuuucaucuguaaaacg

SEQ ID NO: 38236 - RNA, 18 nt, Artificial Sequence
  Description of Artificial Sequence: Synthetic oligonucleotide
uccauucuuucaucugua

SEQ ID NO: 38237 - RNA, 18 nt, Artificial Sequence
  Description of Artificial Sequence: Synthetic oligonucleotide
gugccuccauucuuucau

SEQ ID NO: 38238 - RNA, 18 nt, Artificial Sequence
  Description of Artificial Sequence: Synthetic oligonucleotide
uuucugugccuccauucu

SEQ ID NO: 38239 - RNA, 18 nt, Artificial Sequence
  Description of Artificial Sequence: Synthetic oligonucleotide
uaacuuuucugugccucc

SEQ ID NO: 38240 - RNA, 18 nt, Artificial Sequence
  Description of Artificial Sequence: Synthetic oligonucleotide
acaaguaacuuuucugug

SEQ ID NO: 38241 - RNA, 18 nt, Artificial Sequence
  Description of Artificial Sequence: Synthetic oligonucleotide
cuuagacaaguaacuuuu

SEQ ID NO: 38242 - RNA, 18 nt, Artificial Sequence
  Description of Artificial Sequence: Synthetic oligonucleotide
uguuacuuagacaaguaa

SEQ ID NO: 38243 - RNA, 18 nt, Artificial Sequence
  Description of Artificial Sequence: Synthetic oligonucleotide
uagacuguuacuuagaca

SEQ ID NO: 38244 - RNA, 18 nt, Artificial Sequence
  Description of Artificial Sequence: Synthetic oligonucleotide
aaggauagacuguuacuu

SEQ ID NO: 38245 - RNA, 18 nt, Artificial Sequence
  Description of Artificial Sequence: Synthetic oligonucleotide
acuuuaaggauagacugu

SEQ ID NO: 38246 - RNA, 18 nt, Artificial Sequence
  Description of Artificial Sequence: Synthetic oligonucleotide
uguggacuuuaaggauag

SEQ ID NO: 38247 - RNA, 18 nt, Artificial Sequence
  Description of Artificial Sequence: Synthetic oligonucleotide
aagacuguggacuuuaag

SEQ ID NO: 38248 - RNA, 18 nt, Artificial Sequence
  Description of Artificial Sequence: Synthetic oligonucleotide
ugguuaagacuguggacu

SEQ ID NO: 38249 - RNA, 18 nt, Artificial Sequence
  Description of Artificial Sequence: Synthetic oligonucleotide
ucaagugguuaagacugu

SEQ ID NO: 38250 - RNA, 18 nt, Artificial Sequence
  Description of Artificial Sequence: Synthetic oligonucleotide
aaaaaucaagugguuaag

SEQ ID NO: 38251 - RNA, 18 nt, Artificial Sequence
  Description of Artificial Sequence: Synthetic oligonucleotide
cuaugaaaaaucaagugg

SEQ ID NO: 38252 - RNA, 18 nt, Artificial Sequence
  Description of Artificial Sequence: Synthetic oligonucleotide
ccucacuaugaaaaauca

SEQ ID NO: 38253 - RNA, 18 nt, Artificial Sequence
  Description of Artificial Sequence: Synthetic oligonucleotide
auuuuccucacuaugaaa

SEQ ID NO: 38254 - RNA, 18 nt, Artificial Sequence
  Description of Artificial Sequence: Synthetic oligonucleotide
gggauauuuuccucacua

SEQ ID NO: 38255 - RNA, 18 nt, Artificial Sequence
  Description of Artificial Sequence: Synthetic oligonucleotide
uuucugggauauuuuccu

SEQ ID NO: 38256 - RNA, 18 nt, Artificial Sequence
  Description of Artificial Sequence: Synthetic oligonucleotide
gcaacuuucugggauauu

SEQ ID NO: 38257 - RNA, 18 nt, Artificial Sequence
  Description of Artificial Sequence: Synthetic oligonucleotide
aaacugcaacuuucuggg

SEQ ID NO: 38258 - RNA, 18 nt, Artificial Sequence
  Description of Artificial Sequence: Synthetic oligonucleotide
aauugaaacugcaacuuu

SEQ ID NO: 38259 - RNA, 18 nt, Artificial Sequence
  Description of Artificial Sequence: Synthetic oligonucleotide
ugauuaauugaaacugca

SEQ ID NO: 38260 - RNA, 18 nt, Artificial Sequence
  Description of Artificial Sequence: Synthetic oligonucleotide
auuagugauuaauugaaa

SEQ ID NO: 38261 - RNA, 18 nt, Artificial Sequence
  Description of Artificial Sequence: Synthetic oligonucleotide
cuacaauuagugauuaau

SEQ ID NO: 38262 - RNA, 18 nt, Artificial Sequence
  Description of Artificial Sequence: Synthetic oligonucleotide
uuacccuacaauuaguga

SEQ ID NO: 38263 - RNA, 18 nt, Artificial Sequence
  Description of Artificial Sequence: Synthetic oligonucleotide
uuaaauuacccuacaauu

SEQ ID NO: 38264 - RNA, 18 nt, Artificial Sequence
  Description of Artificial Sequence: Synthetic oligonucleotide
uauaguuaaauuacccua

SEQ ID NO: 38265 - RNA, 18 nt, Artificial Sequence
  Description of Artificial Sequence: Synthetic oligonucleotide
acugguauaguuaaauua

SEQ ID NO: 38266 - RNA, 18 nt, Artificial Sequence
  Description of Artificial Sequence: Synthetic oligonucleotide
gacucacugguauaguua

SEQ ID NO: 38267 - RNA, 18 nt, Artificial Sequence
  Description of Artificial Sequence: Synthetic oligonucleotide
aguaggacucacugguau

SEQ ID NO: 38268 - RNA, 18 nt, Artificial Sequence
  Description of Artificial Sequence: Synthetic oligonucleotide
cugcuaguaggacucacu

SEQ ID NO: 38269 - RNA, 18 nt, Artificial Sequence
  Description of Artificial Sequence: Synthetic oligonucleotide
uauuucugcuaguaggac

SEQ ID NO: 38270 - RNA, 18 nt, Artificial Sequence
  Description of Artificial Sequence: Synthetic oligonucleotide
ccaaauauuucugcuagu

SEQ ID NO: 38271 - RNA, 18 nt, Artificial Sequence
  Description of Artificial Sequence: Synthetic oligonucleotide
guugcccaaauauuucug

SEQ ID NO: 38272 - RNA, 18 nt, Artificial Sequence
  Description of Artificial Sequence: Synthetic oligonucleotide
cuuauguugcccaaauau

SEQ ID NO: 38273 - RNA, 18 nt, Artificial Sequence
  Description of Artificial Sequence: Synthetic oligonucleotide
gugggcuuauguugccca

SEQ ID NO: 38274 - RNA, 18 nt, Artificial Sequence
  Description of Artificial Sequence: Synthetic oligonucleotide
agucagugggcuuauguu

SEQ ID NO: 38275 - RNA, 18 nt, Artificial Sequence
  Description of Artificial Sequence: Synthetic oligonucleotide
gcuccagucagugggcuu

SEQ ID NO: 38276 - RNA, 18 nt, Artificial Sequence
  Description of Artificial Sequence: Synthetic oligonucleotide
caaaagcuccagucagug

SEQ ID NO: 38277 - RNA, 18 nt, Artificial Sequence
  Description of Artificial Sequence: Synthetic oligonucleotide
uaagacaaaagcuccagu

SEQ ID NO: 38278 - RNA, 18 nt, Artificial Sequence
  Description of Artificial Sequence: Synthetic oligonucleotide
uaugcuaagacaaaagcu

SEQ ID NO: 38279 - RNA, 18 nt, Artificial Sequence
  Description of Artificial Sequence: Synthetic oligonucleotide
guuauuaugcuaagacaa

SEQ ID NO: 38280 - RNA, 18 nt, Artificial Sequence
  Description of Artificial Sequence: Synthetic oligonucleotide
aacagguuauuaugcuaa

SEQ ID NO: 38281 - RNA, 18 nt, Artificial Sequence
  Description of Artificial Sequence: Synthetic oligonucleotide
cuggaaacagguuauuau

SEQ ID NO: 38282 - RNA, 18 nt, Artificial Sequence
  Description of Artificial Sequence: Synthetic oligonucleotide
ucuugcuggaaacagguu

SEQ ID NO: 38283 - RNA, 18 nt, Artificial Sequence
  Description of Artificial Sequence: Synthetic oligonucleotide
uauauucuugcuggaaac

SEQ ID NO: 38284 - RNA, 18 nt, Artificial Sequence
  Description of Artificial Sequence: Synthetic oligonucleotide
ucuguuauauucuugcug

SEQ ID NO: 38285 - RNA, 18 nt, Artificial Sequence
  Description of Artificial Sequence: Synthetic oligonucleotide
uuuuuucuguuauauucu

SEQ ID NO: 38286 - RNA, 18 nt, Artificial Sequence
  Description of Artificial Sequence: Synthetic oligonucleotide
gaaacuuuuuucuguuau

SEQ ID NO: 38287 - RNA, 18 nt, Artificial Sequence
  Description of Artificial Sequence: Synthetic oligonucleotide
gcugggaaacuuuuuucu

SEQ ID NO: 38288 - RNA, 18 nt, Artificial Sequence
  Description of Artificial Sequence: Synthetic oligonucleotide
ugaaagcugggaaacuuu

SEQ ID NO: 38289 - RNA, 18 nt, Artificial Sequence
  Description of Artificial Sequence: Synthetic oligonucleotide
accuuugaaagcugggaa

SEQ ID NO: 38290 - RNA, 18 nt, Artificial Sequence
  Description of Artificial Sequence: Synthetic oligonucleotide
uauaaaccuuugaaagcu

SEQ ID NO: 38291 - RNA, 18 nt, Artificial Sequence
  Description of Artificial Sequence: Synthetic oligonucleotide
aauauuauaaaccuuuga

SEQ ID NO: 38292 - RNA, 18 nt, Artificial Sequence
  Description of Artificial Sequence: Synthetic oligonucleotide
uaaucaauauuauaaacc

SEQ ID NO: 38293 - RNA, 18 nt, Artificial Sequence
  Description of Artificial Sequence: Synthetic oligonucleotide
aauuuuaaucaauauuau

SEQ ID NO: 38294 - RNA, 18 nt, Artificial Sequence
  Description of Artificial Sequence: Synthetic oligonucleotide
aucuaaauuuuaaucaau

SEQ ID NO: 38295 - RNA, 18 nt, Artificial Sequence
  Description of Artificial Sequence: Synthetic oligonucleotide
aguuuaucuaaauuuuaa

SEQ ID NO: 38296 - RNA, 18 nt, Artificial Sequence
  Description of Artificial Sequence: Synthetic oligonucleotide
gguuaaguuuaucuaaau

SEQ ID NO: 38297 - RNA, 18 nt, Artificial Sequence
  Description of Artificial Sequence: Synthetic oligonucleotide
uguaagguuaaguuuauc

SEQ ID NO: 38298 - RNA, 18 nt, Artificial Sequence
  Description of Artificial Sequence: Synthetic oligonucleotide
auuuguguaagguuaagu

SEQ ID NO: 38299 - RNA, 18 nt, Artificial Sequence
  Description of Artificial Sequence: Synthetic oligonucleotide
gagucauuuguguaaggu

SEQ ID NO: 38300 - RNA, 18 nt, Artificial Sequence
  Description of Artificial Sequence: Synthetic oligonucleotide
aguaagagucauuugugu

SEQ ID NO: 38301 - RNA, 18 nt, Artificial Sequence
  Description of Artificial Sequence: Synthetic oligonucleotide
aggaaaguaagagucauu

SEQ ID NO: 38302 - RNA, 18 nt, Artificial Sequence
  Description of Artificial Sequence: Synthetic oligonucleotide
uaaaaaggaaaguaagag

SEQ ID NO: 38303 - RNA, 18 nt, Artificial Sequence
  Description of Artificial Sequence: Synthetic oligonucleotide
cucaauaaaaaggaaagu

SEQ ID NO: 38304 - RNA, 18 nt, Artificial Sequence
  Description of Artificial Sequence: Synthetic oligonucleotide
augcucucaauaaaaagg

SEQ ID NO: 38305 - RNA, 18 nt, Artificial Sequence
  Description of Artificial Sequence: Synthetic oligonucleotide
agaaaaugcucucaauaa

SEQ ID NO: 38306 - RNA, 18 nt, Artificial Sequence
  Description of Artificial Sequence: Synthetic oligonucleotide
uccaaagaaaaugcucuc

SEQ ID NO: 38307 - RNA, 18 nt, Artificial Sequence
  Description of Artificial Sequence: Synthetic oligonucleotide
aaugcuccaaagaaaaug

SEQ ID NO: 38308 - RNA, 18 nt, Artificial Sequence
  Description of Artificial Sequence: Synthetic oligonucleotide
aagaaaaugcuccaaaga

SEQ ID NO: 38309 - RNA, 18 nt, Artificial Sequence
  Description of Artificial Sequence: Synthetic oligonucleotide
caaagaagaaaaugcucc

SEQ ID NO: 38310 - RNA, 18 nt, Artificial Sequence
  Description of Artificial Sequence: Synthetic oligonucleotide
uccuccaaagaagaaaau

SEQ ID NO: 38311 - RNA, 18 nt, Artificial Sequence
  Description of Artificial Sequence: Synthetic oligonucleotide
uauaauccuccaaagaag

SEQ ID NO: 38312 - RNA, 18 nt, Artificial Sequence
  Description of Artificial Sequence: Synthetic oligonucleotide
caagguauaauccuccaa

SEQ ID NO: 38313 - RNA, 18 nt, Artificial Sequence
  Description of Artificial Sequence: Synthetic oligonucleotide
augagcaagguauaaucc

SEQ ID NO: 38314 - RNA, 18 nt, Artificial Sequence
  Description of Artificial Sequence: Synthetic oligonucleotide
ccaagaugagcaagguau

SEQ ID NO: 38315 - RNA, 18 nt, Artificial Sequence
  Description of Artificial Sequence: Synthetic oligonucleotide
uugugccaagaugagcaa

SEQ ID NO: 38316 - RNA, 18 nt, Artificial Sequence
  Description of Artificial Sequence: Synthetic oligonucleotide
uucuuuugugccaagaug

SEQ ID NO: 38317 - RNA, 18 nt, Artificial Sequence
  Description of Artificial Sequence: Synthetic oligonucleotide
ucgccuucuuuugugcca

SEQ ID NO: 38318 - RNA, 18 nt, Artificial Sequence
  Description of Artificial Sequence: Synthetic oligonucleotide
uccuuucgccuucuuuug

SEQ ID NO: 38319 - RNA, 18 nt, Artificial Sequence
  Description of Artificial Sequence: Synthetic oligonucleotide
uuacuuccuuucgccuuc

SEQ ID NO: 38320 - RNA, 18 nt, Artificial Sequence
  Description of Artificial Sequence: Synthetic oligonucleotide
ccauguuacuuccuuucg

SEQ ID NO: 38321 - RNA, 18 nt, Artificial Sequence
  Description of Artificial Sequence: Synthetic oligonucleotide
caaucccauguuacuucc

SEQ ID NO: 38322 - RNA, 18 nt, Artificial Sequence
  Description of Artificial Sequence: Synthetic oligonucleotide
uuucccaaucccauguua

SEQ ID NO: 38323 - RNA, 18 nt, Artificial Sequence
  Description of Artificial Sequence: Synthetic oligonucleotide
gcucuuuucccaauccca

SEQ ID NO: 38324 - RNA, 18 nt, Artificial Sequence
  Description of Artificial Sequence: Synthetic oligonucleotide
uccuugcucuuuucccaa

SEQ ID NO: 38325 - RNA, 18 nt, Artificial Sequence
  Description of Artificial Sequence: Synthetic oligonucleotide
uuaucuccuugcucuuuu

SEQ ID NO: 38326 - RNA, 18 nt, Artificial Sequence
  Description of Artificial Sequence: Synthetic oligonucleotide
aaacuuuaucuccuugcu

SEQ ID NO: 38327 - RNA, 18 nt, Artificial Sequence
  Description of Artificial Sequence: Synthetic oligonucleotide
uccucaaacuuuaucucc

SEQ ID NO: 38328 - RNA, 18 nt, Artificial Sequence
  Description of Artificial Sequence: Synthetic oligonucleotide
uuuuuuccucaaacuuua

SEQ ID NO: 38329 - RNA, 18 nt, Artificial Sequence
  Description of Artificial Sequence: Synthetic oligonucleotide
ugauuuuuuuuccucaaa

SEQ ID NO: 38330 - RNA, 18 nt, Artificial Sequence
  Description of Artificial Sequence: Synthetic oligonucleotide
cauggugauuuuuuuucc

SEQ ID NO: 38331 - RNA, 18 nt, Artificial Sequence
  Description of Artificial Sequence: Synthetic oligonucleotide
aucaacauggugauuuuu

SEQ ID NO: 38332 - RNA, 18 nt, Artificial Sequence
  Description of Artificial Sequence: Synthetic oligonucleotide
aagacaucaacaugguga

SEQ ID NO: 38333 - RNA, 18 nt, Artificial Sequence
  Description of Artificial Sequence: Synthetic oligonucleotide
ucaagaagacaucaacau

SEQ ID NO: 38334 - RNA, 18 nt, Artificial Sequence
  Description of Artificial Sequence: Synthetic oligonucleotide
ccuacucaagaagacauc

SEQ ID NO: 38335 - RNA, 18 nt, Artificial Sequence
  Description of Artificial Sequence: Synthetic oligonucleotide
cuuggccuacucaagaag

SEQ ID NO: 38336 - RNA, 18 nt, Artificial Sequence
  Description of Artificial Sequence: Synthetic oligonucleotide
cgcaacuuggccuacuca

SEQ ID NO: 38337 - RNA, 18 nt, Artificial Sequence
  Description of Artificial Sequence: Synthetic oligonucleotide
uuauacgcaacuuggccu

SEQ ID NO: 38338 - RNA, 18 nt, Artificial Sequence
  Description of Artificial Sequence: Synthetic oligonucleotide
ucucuuuauacgcaacuu

SEQ ID NO: 38339 - RNA, 18 nt, Artificial Sequence
  Description of Artificial Sequence: Synthetic oligonucleotide
cauuuucucuuuauacgc

SEQ ID NO: 38340 - RNA, 18 nt, Artificial Sequence
  Description of Artificial Sequence: Synthetic oligonucleotide
guugucauuuucucuuua

SEQ ID NO: 38341 - RNA, 18 nt, Artificial Sequence
  Description of Artificial Sequence: Synthetic oligonucleotide
cuccuguugucauuuucu

SEQ ID NO: 38342 - RNA, 18 nt, Artificial Sequence
  Description of Artificial Sequence: Synthetic oligonucleotide
aaaaucuccuguugucau

SEQ ID NO: 38343 - RNA, 18 nt, Artificial Sequence
  Description of Artificial Sequence: Synthetic oligonucleotide
accuuaaaaucuccuguu

SEQ ID NO: 38344 - RNA, 18 nt, Artificial Sequence
  Description of Artificial Sequence: Synthetic oligonucleotide
aucauaccuuaaaaucuc

SEQ ID NO: 38345 - RNA, 18 nt, Artificial Sequence
  Description of Artificial Sequence: Synthetic oligonucleotide
aauauaucauaccuuaaa

SEQ ID NO: 38346 - RNA, 18 nt, Artificial Sequence
  Description of Artificial Sequence: Synthetic oligonucleotide
uuaacaauauaucauacc

SEQ ID NO: 38347 - RNA, 18 nt, Artificial Sequence
  Description of Artificial Sequence: Synthetic oligonucleotide
uacucuuaacaauauauc

SEQ ID NO: 38348 - RNA, 18 nt, Artificial Sequence
  Description of Artificial Sequence: Synthetic oligonucleotide
uguacuacucuuaacaau

SEQ ID NO: 38349 - RNA, 18 nt, Artificial Sequence
  Description of Artificial Sequence: Synthetic oligonucleotide
aaauauguacuacucuua

SEQ ID NO: 38350 - RNA, 18 nt, Artificial Sequence
  Description of Artificial Sequence: Synthetic oligonucleotide
uucuuaaauauguacuac

SEQ ID NO: 38351 - RNA, 18 nt, Artificial Sequence
  Description of Artificial Sequence: Synthetic oligonucleotide
uucucuucuuaaauaugu

SEQ ID NO: 38352 - RNA, 18 nt, Artificial Sequence
  Description of Artificial Sequence: Synthetic oligonucleotide
auauuuucucuucuuaaa

SEQ ID NO: 38353 - RNA, 18 nt, Artificial Sequence
  Description of Artificial Sequence: Synthetic oligonucleotide
aaaacauauuuucucuuc

SEQ ID NO: 38354 - RNA, 18 nt, Artificial Sequence
  Description of Artificial Sequence: Synthetic oligonucleotide
uuucaaaaacauauuuuc

SEQ ID NO: 38355 - RNA, 18 nt, Artificial Sequence
  Description of Artificial Sequence: Synthetic oligonucleotide
uuuguuuucaaaaacaua

SEQ ID NO: 38356 - RNA, 18 nt, Artificial Sequence
  Description of Artificial Sequence: Synthetic oligonucleotide
uuaaauuuguuuucaaaa

SEQ ID NO: 38357 - RNA, 18 nt, Artificial Sequence
  Description of Artificial Sequence: Synthetic oligonucleotide
caaguuuaaauuuguuuu

SEQ ID NO: 38358 - RNA, 18 nt, Artificial Sequence
  Description of Artificial Sequence: Synthetic oligonucleotide
ccuuucaaguuuaaauuu

SEQ ID NO: 38359 - RNA, 18 nt, Artificial Sequence
  Description of Artificial Sequence: Synthetic oligonucleotide
aucauccuuucaaguuua

SEQ ID NO: 38360 - RNA, 18 nt, Artificial Sequence
  Description of Artificial Sequence: Synthetic oligonucleotide
ugaaaaucauccuuucaa

SEQ ID NO: 38361 - RNA, 18 nt, Artificial Sequence
  Description of Artificial Sequence: Synthetic oligonucleotide
aaauaugaaaaucauccu

SEQ ID NO: 38362 - RNA, 18 nt, Artificial Sequence
  Description of Artificial Sequence: Synthetic oligonucleotide
cuucaaaauaugaaaauc

SEQ ID NO: 38363 - RNA, 18 nt, Artificial Sequence
  Description of Artificial Sequence: Synthetic oligonucleotide
aaucccuucaaaauauga

SEQ ID NO: 38364 - RNA, 18 nt, Artificial Sequence
  Description of Artificial Sequence: Synthetic oligonucleotide
uuauaaaucccuucaaaa

SEQ ID NO: 38365 - RNA, 18 nt, Artificial Sequence
  Description of Artificial Sequence: Synthetic oligonucleotide
ugaaguuauaaaucccuu

SEQ ID NO: 38366 - RNA, 18 nt, Artificial Sequence
  Description of Artificial Sequence: Synthetic oligonucleotide
cuuugugaaguuauaaau

SEQ ID NO: 38367 - RNA, 18 nt, Artificial Sequence
  Description of Artificial Sequence: Synthetic oligonucleotide
agaugcuuugugaaguua

SEQ ID NO: 38368 - RNA, 18 nt, Artificial Sequence
  Description of Artificial Sequence: Synthetic oligonucleotide
aauggagaugcuuuguga

SEQ ID NO: 38369 - RNA, 18 nt, Artificial Sequence
  Description of Artificial Sequence: Synthetic oligonucleotide
gauagaauggagaugcuu

SEQ ID NO: 38370 - RNA, 18 nt, Artificial Sequence
  Description of Artificial Sequence: Synthetic oligonucleotide
aacaagauagaauggaga

SEQ ID NO: 38371 - RNA, 18 nt, Artificial Sequence
  Description of Artificial Sequence: Synthetic oligonucleotide
agcugaacaagauagaau

SEQ ID NO: 38372 - RNA, 18 nt, Artificial Sequence
  Description of Artificial Sequence: Synthetic oligonucleotide
uguaaagcugaacaagau

SEQ ID NO: 38373 - RNA, 18 nt, Artificial Sequence
  Description of Artificial Sequence: Synthetic oligonucleotide
uuaaauguaaagcugaac

SEQ ID NO: 38374 - RNA, 18 nt, Artificial Sequence
  Description of Artificial Sequence: Synthetic oligonucleotide
uauuuuuaaauguaaagc

SEQ ID NO: 38375 - RNA, 18 nt, Artificial Sequence
  Description of Artificial Sequence: Synthetic oligonucleotide
gaguuuauuuuuaaaugu

SEQ ID NO: 38376 - RNA, 18 nt, Artificial Sequence
  Description of Artificial Sequence: Synthetic oligonucleotide
aagaagaguuuauuuuua

SEQ ID NO: 38377 - RNA, 18 nt, Artificial Sequence
  Description of Artificial Sequence: Synthetic oligonucleotide
ugaacaagaagaguuuau

SEQ ID NO: 38378 - RNA, 18 nt, Artificial Sequence
  Description of Artificial Sequence: Synthetic oligonucleotide
uuauaugaacaagaagag

SEQ ID NO: 38379 - RNA, 18 nt, Artificial Sequence
  Description of Artificial Sequence: Synthetic oligonucleotide
aagguuuauaugaacaag

SEQ ID NO: 38380 - RNA, 18 nt, Artificial Sequence
  Description of Artificial Sequence: Synthetic oligonucleotide
gagauaagguuuauauga

SEQ ID NO: 38381 - RNA, 18 nt, Artificial Sequence
  Description of Artificial Sequence: Synthetic oligonucleotide
uguaagagauaagguuua

SEQ ID NO: 38382 - RNA, 18 nt, Artificial Sequence
  Description of Artificial Sequence: Synthetic oligonucleotide
cuuuauguaagagauaag

SEQ ID NO: 38383 - RNA, 18 nt, Artificial Sequence
  Description of Artificial Sequence: Synthetic oligonucleotide
uuucacuuuauguaagag

SEQ ID NO: 38384 - RNA, 18 nt, Artificial Sequence
  Description of Artificial Sequence: Synthetic oligonucleotide
acagauuucacuuuaugu

SEQ ID NO: 38385 - RNA, 18 nt, Artificial Sequence
  Description of Artificial Sequence: Synthetic oligonucleotide
aauuaacagauuucacuu

SEQ ID NO: 38386 - RNA, 18 nt, Artificial Sequence
  Description of Artificial Sequence: Synthetic oligonucleotide
caaaaaauuaacagauuu

SEQ ID NO: 38387 - RNA, 18 nt, Artificial Sequence
  Description of Artificial Sequence: Synthetic oligonucleotide
caaaacaaaaaauuaaca

SEQ ID NO: 38388 - RNA, 18 nt, Artificial Sequence
  Description of Artificial Sequence: Synthetic oligonucleotide
cuugucaaaacaaaaaau

SEQ ID NO: 38389 - RNA, 18 nt, Artificial Sequence
  Description of Artificial Sequence: Synthetic oligonucleotide
uuauccuugucaaaacaa

SEQ ID NO: 38390 - RNA, 18 nt, Artificial Sequence
  Description of Artificial Sequence: Synthetic oligonucleotide
guaguuuauccuugucaa

SEQ ID NO: 38391 - RNA, 18 nt, Artificial Sequence
  Description of Artificial Sequence: Synthetic oligonucleotide
gguaaguaguuuauccuu

SEQ ID NO: 38392 - RNA, 18 nt, Artificial Sequence
  Description of Artificial Sequence: Synthetic oligonucleotide
augcagguaaguaguuua

SEQ ID NO: 38393 - RNA, 18 nt, Artificial Sequence
  Description of Artificial Sequence: Synthetic oligonucleotide
aacagaugcagguaagua

SEQ ID NO: 38394 - RNA, 18 nt, Artificial Sequence
  Description of Artificial Sequence: Synthetic oligonucleotide
ucuuaaacagaugcaggu

SEQ ID NO: 38395 - RNA, 18 nt, Artificial Sequence
  Description of Artificial Sequence: Synthetic oligonucleotide
ucuauucuuaaacagaug

SEQ ID NO: 38396 - RNA, 18 nt, Artificial Sequence
  Description of Artificial Sequence: Synthetic oligonucleotide
guuaaucuauucuuaaac

SEQ ID NO: 38397 - RNA, 18 nt, Artificial Sequence
  Description of Artificial Sequence: Synthetic oligonucleotide
aauaaguuaaucuauucu

SEQ ID NO: 38398 - RNA, 18 nt, Artificial Sequence
  Description of Artificial Sequence: Synthetic oligonucleotide
cucaaaauaaguuaaucu

SEQ ID NO: 38399 - RNA, 18 nt, Artificial Sequence
  Description of Artificial Sequence: Synthetic oligonucleotide
uucuucucaaaauaaguu

SEQ ID NO: 38400 - RNA, 18 nt, Artificial Sequence
  Description of Artificial Sequence: Synthetic oligonucleotide
agaauuucuucucaaaau

SEQ ID NO: 38401 - RNA, 18 nt, Artificial Sequence
  Description of Artificial Sequence: Synthetic oligonucleotide
ugcccagaauuucuucuc

SEQ ID NO: 38402 - RNA, 18 nt, Artificial Sequence
  Description of Artificial Sequence: Synthetic oligonucleotide
aauggugcccagaauuuc

SEQ ID NO: 38403 - RNA, 18 nt, Artificial Sequence
  Description of Artificial Sequence: Synthetic oligonucleotide
ucaaaaauggugcccaga

SEQ ID NO: 38404 - RNA, 18 nt, Artificial Sequence
  Description of Artificial Sequence: Synthetic oligonucleotide
aauggucaaaaauggugc

SEQ ID NO: 38405 - RNA, 18 nt, Artificial Sequence
  Description of Artificial Sequence: Synthetic oligonucleotide
ucuucaauggucaaaaau

SEQ ID NO: 38406 - RNA, 18 nt, Artificial Sequence
  Description of Artificial Sequence: Synthetic oligonucleotide
auaagucuucaaugguca

SEQ ID NO: 38407 - RNA, 18 nt, Artificial Sequence
  Description of Artificial Sequence: Synthetic oligonucleotide
uacaaauaagucuucaau

SEQ ID NO: 38408 - RNA, 18 nt, Artificial Sequence
  Description of Artificial Sequence: Synthetic oligonucleotide
uaaauuacaaauaagucu

SEQ ID NO: 38409 - RNA, 18 nt, Artificial Sequence
  Description of Artificial Sequence: Synthetic oligonucleotide
gaaauuaaauuacaaaua

SEQ ID NO: 38410 - RNA, 18 nt, Artificial Sequence
  Description of Artificial Sequence: Synthetic oligonucleotide
aaguagaaauuaaauuac

SEQ ID NO: 38411 - RNA, 18 nt, Artificial Sequence
  Description of Artificial Sequence: Synthetic oligonucleotide
auguaaaguagaaauuaa

SEQ ID NO: 38412 - RNA, 18 nt, Artificial Sequence
  Description of Artificial Sequence: Synthetic oligonucleotide
ucacaauguaaaguagaa

SEQ ID NO: 38413 - RNA, 18 nt, Artificial Sequence
  Description of Artificial Sequence: Synthetic oligonucleotide
aacauucacaauguaaag

SEQ ID NO: 38414 - RNA, 18 nt, Artificial Sequence
  Description of Artificial Sequence: Synthetic oligonucleotide
aaaugaacauucacaaug

SEQ ID NO: 38415 - RNA, 18 nt, Artificial Sequence
  Description of Artificial Sequence: Synthetic oligonucleotide
uuagaaaaugaacauuca

SEQ ID NO: 38416 - RNA, 18 nt, Artificial Sequence
  Description of Artificial Sequence: Synthetic oligonucleotide
guuuauuagaaaaugaac

SEQ ID NO: 38417 - RNA, 18 nt, Artificial Sequence
  Description of Artificial Sequence: Synthetic oligonucleotide
aucuuguuuauuagaaaa

SEQ ID NO: 38418 - RNA, 18 nt, Artificial Sequence
  Description of Artificial Sequence: Synthetic oligonucleotide
aaauaaucuuguuuauua

SEQ ID NO: 38419 - RNA, 18 nt, Artificial Sequence
  Description of Artificial Sequence: Synthetic oligonucleotide
augcaaaauaaucuuguu

SEQ ID NO: 38420 - RNA, 18 nt, Artificial Sequence
  Description of Artificial Sequence: Synthetic oligonucleotide
uacauaugcaaaauaauc

SEQ ID NO: 38421 - RNA, 18 nt, Artificial Sequence
  Description of Artificial Sequence: Synthetic oligonucleotide
ccccguccaguggacccc

SEQ ID NO: 38422 - RNA, 18 nt, Artificial Sequence
  Description of Artificial Sequence: Synthetic oligonucleotide
ucaggccccguccagugg

SEQ ID NO: 38423 - RNA, 18 nt, Artificial Sequence
  Description of Artificial Sequence: Synthetic oligonucleotide
guagcucaggccccgucc

SEQ ID NO: 38424 - RNA, 18 nt, Artificial Sequence
  Description of Artificial Sequence: Synthetic oligonucleotide
aaguuguagcucaggccc

SEQ ID NO: 38425 - RNA, 18 nt, Artificial Sequence
  Description of Artificial Sequence: Synthetic oligonucleotide
gggugaaguuguagcuca

SEQ ID NO: 38426 - RNA, 18 nt, Artificial Sequence
  Description of Artificial Sequence: Synthetic oligonucleotide
caggugggugaaguugua

SEQ ID NO: 38427 - RNA, 18 nt, Artificial Sequence
  Description of Artificial Sequence: Synthetic oligonucleotide
ccguccaggugggugaag

SEQ ID NO: 38428 - RNA, 18 nt, Artificial Sequence
  Description of Artificial Sequence: Synthetic oligonucleotide
gguacccguccagguggg

SEQ ID NO: 38429 - RNA, 18 nt, Artificial Sequence
  Description of Artificial Sequence: Synthetic oligonucleotide
guccagguacccguccag

SEQ ID NO: 38430 - RNA, 18 nt, Artificial Sequence
  Description of Artificial Sequence: Synthetic oligonucleotide
agaagguccagguacccg

SEQ ID NO: 38431 - RNA, 18 nt, Artificial Sequence
  Description of Artificial Sequence: Synthetic oligonucleotide
cccugagaagguccaggu

SEQ ID NO: 38432 - RNA, 18 nt, Artificial Sequence
  Description of Artificial Sequence: Synthetic oligonucleotide
guucucccugagaagguc

SEQ ID NO: 38433 - RNA, 18 nt, Artificial Sequence
  Description of Artificial Sequence: Synthetic oligonucleotide
agcugguucucccugaga

SEQ ID NO: 38434 - RNA, 18 nt, Artificial Sequence
  Description of Artificial Sequence: Synthetic oligonucleotide
ggaggagcugguucuccc

SEQ ID NO: 38435 - RNA, 18 nt, Artificial Sequence
  Description of Artificial Sequence: Synthetic oligonucleotide
ggagggcagagcccacag

SEQ ID NO: 38436 - RNA, 18 nt, Artificial Sequence
  Description of Artificial Sequence: Synthetic oligonucleotide
ggcugggagggcagagcc

SEQ ID NO: 38437 - RNA, 18 nt, Artificial Sequence
  Description of Artificial Sequence: Synthetic oligonucleotide
aggcgggcugggagggca

SEQ ID NO: 38438 - RNA, 18 nt, Artificial Sequence
  Description of Artificial Sequence: Synthetic oligonucleotide
ggugcaggcgggcuggga

SEQ ID NO: 38439 - RNA, 18 nt, Artificial Sequence
  Description of Artificial Sequence: Synthetic oligonucleotide
gggugcaggcgggcuggg

SEQ ID NO: 38440 - RNA, 18 nt, Artificial Sequence
  Description of Artificial Sequence: Synthetic oligonucleotide
gggugggcagggcaaggg

SEQ ID NO: 38441 - RNA, 18 nt, Artificial Sequence
  Description of Artificial Sequence: Synthetic oligonucleotide
ggagagggugggcagggc

SEQ ID NO: 38442 - RNA, 18 nt, Artificial Sequence
  Description of Artificial Sequence: Synthetic oligonucleotide
gugagggagagggugggc

SEQ ID NO: 38443 - RNA, 18 nt, Artificial Sequence
  Description of Artificial Sequence: Synthetic oligonucleotide
gcugggugagggagaggg

SEQ ID NO: 38444 - RNA, 18 nt, Artificial Sequence
  Description of Artificial Sequence: Synthetic oligonucleotide
gggcugggugagggagag

SEQ ID NO: 38445 - RNA, 18 nt, Artificial Sequence
  Description of Artificial Sequence: Synthetic oligonucleotide
auccaaggacucagaggg

SEQ ID NO: 38446 - RNA, 18 nt, Artificial Sequence
  Description of Artificial Sequence: Synthetic oligonucleotide
uggacauccaaggacuca

SEQ ID NO: 38447 - RNA, 18 nt, Artificial Sequence
  Description of Artificial Sequence: Synthetic oligonucleotide
cugaauggacauccaagg

SEQ ID NO: 38448 - RNA, 18 nt, Artificial Sequence
  Description of Artificial Sequence: Synthetic oligonucleotide
cagcccugaauggacauc

SEQ ID NO: 38449 - RNA, 18 nt, Artificial Sequence
  Description of Artificial Sequence: Synthetic oligonucleotide
aaggccagcccugaaugg

SEQ ID NO: 38450 - RNA, 18 nt, Artificial Sequence
  Description of Artificial Sequence: Synthetic oligonucleotide
gcaccaaggccagcccug

SEQ ID NO: 38451 - RNA, 18 nt, Artificial Sequence
  Description of Artificial Sequence: Synthetic oligonucleotide
cuccggcaccaaggccag

SEQ ID NO: 38452 - RNA, 18 nt, Artificial Sequence
  Description of Artificial Sequence: Synthetic oligonucleotide
auccaaggacucagaggg

SEQ ID NO: 38453 - RNA, 18 nt, Artificial Sequence
  Description of Artificial Sequence: Synthetic oligonucleotide
uggacauccaaggacuca

SEQ ID NO: 38454 - RNA, 18 nt, Artificial Sequence
  Description of Artificial Sequence: Synthetic oligonucleotide
cugaauggacauccaagg

SEQ ID NO: 38455 - RNA, 18 nt, Artificial Sequence
  Description of Artificial Sequence: Synthetic oligonucleotide
cagcccugaauggacauc

SEQ ID NO: 38456 - RNA, 18 nt, Artificial Sequence
  Description of Artificial Sequence: Synthetic oligonucleotide
aaggccagcccugaaugg

SEQ ID NO: 38457 - RNA, 18 nt, Artificial Sequence
  Description of Artificial Sequence: Synthetic oligonucleotide
gcaccaaggccagcccug

SEQ ID NO: 38458 - RNA, 18 nt, Artificial Sequence
  Description of Artificial Sequence: Synthetic oligonucleotide
cuccggcaccaaggccag

SEQ ID NO: 38459 - RNA, 18 nt, Artificial Sequence
  Description of Artificial Sequence: Synthetic oligonucleotide
cugugcuccggcaccaag

SEQ ID NO: 38460 - RNA, 18 nt, Artificial Sequence
  Description of Artificial Sequence: Synthetic oligonucleotide
caggccugugcuccggca

SEQ ID NO: 38461 - RNA, 18 nt, Artificial Sequence
  Description of Artificial Sequence: Synthetic oligonucleotide
ucugccaggccugugcuc

SEQ ID NO: 38462 - RNA, 18 nt, Artificial Sequence
  Description of Artificial Sequence: Synthetic oligonucleotide
caugcucugccaggccug

SEQ ID NO: 38463 - RNA, 18 nt, Artificial Sequence
  Description of Artificial Sequence: Synthetic oligonucleotide
acacccaugcucugccag

SEQ ID NO: 38464 - RNA, 18 nt, Artificial Sequence
  Description of Artificial Sequence: Synthetic oligonucleotide
acaccacacccaugcucu

SEQ ID NO: 38465 - RNA, 18 nt, Artificial Sequence
  Description of Artificial Sequence: Synthetic oligonucleotide
accacacaccacacccau

SEQ ID NO: 38466 - RNA, 18 nt, Artificial Sequence
  Description of Artificial Sequence: Synthetic oligonucleotide
cgcccaccacacaccaca

SEQ ID NO: 38467 - RNA, 18 nt, Artificial Sequence
  Description of Artificial Sequence: Synthetic oligonucleotide
cccaccgcccaccacaca

SEQ ID NO: 38468 - RNA, 18 nt, Artificial Sequence
  Description of Artificial Sequence: Synthetic oligonucleotide
gcugccccaccgcccacc

SEQ ID NO: 38469 - RNA, 18 nt, Artificial Sequence
  Description of Artificial Sequence: Synthetic oligonucleotide
cugcccaucagcucaaac

SEQ ID NO: 38470 - RNA, 18 nt, Artificial Sequence
  Description of Artificial Sequence: Synthetic oligonucleotide
aggcgcugcccaucagcu

SEQ ID NO: 38471 - RNA, 18 nt, Artificial Sequence
  Description of Artificial Sequence: Synthetic oligonucleotide
gcccgaggcgcugcccau

SEQ ID NO: 38472 - RNA, 18 nt, Artificial Sequence
  Description of Artificial Sequence: Synthetic oligonucleotide
aaguggcccgaggcgcug

SEQ ID NO: 38473 - RNA, 18 nt, Artificial Sequence
  Description of Artificial Sequence: Synthetic oligonucleotide
cagugaaguggcccgagg

SEQ ID NO: 38474 - RNA, 18 nt, Artificial Sequence
  Description of Artificial Sequence: Synthetic oligonucleotide
aaagucagugaaguggcc

SEQ ID NO: 38475 - RNA, 18 nt, Artificial Sequence
  Description of Artificial Sequence: Synthetic oligonucleotide
uccucaaagucagugaag

SEQ ID NO: 38476 - RNA, 18 nt, Artificial Sequence
  Description of Artificial Sequence: Synthetic oligonucleotide
gcuuguccucaaagucag

SEQ ID NO: 38477 - RNA, 18 nt, Artificial Sequence
  Description of Artificial Sequence: Synthetic oligonucleotide
cugcugcuuguccucaaa

SEQ ID NO: 38478 - RNA, 18 nt, Artificial Sequence
  Description of Artificial Sequence: Synthetic oligonucleotide
aacaccugcugcuugucc

SEQ ID NO: 38479 - RNA, 18 nt, Artificial Sequence
  Description of Artificial Sequence: Synthetic oligonucleotide
acucaaacaccugcugcu

SEQ ID NO: 38480 - RNA, 18 nt, Artificial Sequence
  Description of Artificial Sequence: Synthetic oligonucleotide
cuuccacucaaacaccug

SEQ ID NO: 38481 - RNA, 18 nt, Artificial Sequence
  Description of Artificial Sequence: Synthetic oligonucleotide
aaguccuuccacucaaac

SEQ ID NO: 38482 - RNA, 18 nt, Artificial Sequence
  Description of Artificial Sequence: Synthetic oligonucleotide
agaccaaguccuuccacu

SEQ ID NO: 38483 - RNA, 18 nt, Artificial Sequence
  Description of Artificial Sequence: Synthetic oligonucleotide
gcuggagaccaaguccuu

SEQ ID NO: 38484 - RNA, 18 nt, Artificial Sequence
  Description of Artificial Sequence: Synthetic oligonucleotide
gccaggcuggagaccaag

SEQ ID NO: 38485 - RNA, 18 nt, Artificial Sequence
  Description of Artificial Sequence: Synthetic oligonucleotide
uccuggccaggcuggaga

SEQ ID NO: 38486 - RNA, 18 nt, Artificial Sequence
  Description of Artificial Sequence: Synthetic oligonucleotide
guaucuccuggccaggcu

SEQ ID NO: 38487 - RNA, 18 nt, Artificial Sequence
  Description of Artificial Sequence: Synthetic oligonucleotide
gcugcccaucagcucaaa

SEQ ID NO: 38488 - RNA, 18 nt, Artificial Sequence
  Description of Artificial Sequence: Synthetic oligonucleotide
gaggcgcugcccaucagc

SEQ ID NO: 38489 - RNA, 18 nt, Artificial Sequence
  Description of Artificial Sequence: Synthetic oligonucleotide
ggcccgaggcgcugccca

SEQ ID NO: 38490 - RNA, 18 nt, Artificial Sequence
  Description of Artificial Sequence: Synthetic oligonucleotide
gaaguggcccgaggcgcu

SEQ ID NO: 38491 - RNA, 18 nt, Artificial Sequence
  Description of Artificial Sequence: Synthetic oligonucleotide
ucagugaaguggcccgag

SEQ ID NO: 38492 - RNA, 18 nt, Artificial Sequence
  Description of Artificial Sequence: Synthetic oligonucleotide
caaagucagugaaguggc

SEQ ID NO: 38493 - RNA, 18 nt, Artificial Sequence
  Description of Artificial Sequence: Synthetic oligonucleotide
guccucaaagucagugaa

SEQ ID NO: 38494 - RNA, 18 nt, Artificial Sequence
  Description of Artificial Sequence: Synthetic oligonucleotide
ugcuuguccucaaaguca

SEQ ID NO: 38495 - RNA, 18 nt, Artificial Sequence
  Description of Artificial Sequence: Synthetic oligonucleotide
ccugcugcuuguccucaa

SEQ ID NO: 38496 - RNA, 18 nt, Artificial Sequence
  Description of Artificial Sequence: Synthetic oligonucleotide
aaacaccugcugcuuguc

SEQ ID NO: 38497 - RNA, 18 nt, Artificial Sequence
  Description of Artificial Sequence: Synthetic oligonucleotide
cacucaaacaccugcugc

SEQ ID NO: 38498 - RNA, 18 nt, Artificial Sequence
  Description of Artificial Sequence: Synthetic oligonucleotide
ccuuccacucaaacaccu

SEQ ID NO: 38499 - RNA, 18 nt, Artificial Sequence
  Description of Artificial Sequence: Synthetic oligonucleotide
caaguccuuccacucaaa

SEQ ID NO: 38500 - RNA, 18 nt, Artificial Sequence
  Description of Artificial Sequence: Synthetic oligonucleotide
gagaccaaguccuuccac

SEQ ID NO: 38501 - RNA, 18 nt, Artificial Sequence
  Description of Artificial Sequence: Synthetic oligonucleotide
ggcuggagaccaaguccu

SEQ ID NO: 38502 - RNA, 18 nt, Artificial Sequence
  Description of Artificial Sequence: Synthetic oligonucleotide
ggccaggcuggagaccaa

SEQ ID NO: 38503 - RNA, 18 nt, Artificial Sequence
  Description of Artificial Sequence: Synthetic oligonucleotide
cuccuggccaggcuggag

SEQ ID NO: 38504 - RNA, 18 nt, Artificial Sequence
  Description of Artificial Sequence: Synthetic oligonucleotide
uguaucuccuggccaggc

SEQ ID NO: 38505 - RNA, 18 nt, Artificial Sequence
  Description of Artificial Sequence: Synthetic oligonucleotide
ccccagggccugcgcucg

SEQ ID NO: 38506 - RNA, 18 nt, Artificial Sequence
  Description of Artificial Sequence: Synthetic oligonucleotide
cagggccccagggccugc

SEQ ID NO: 38507 - RNA, 18 nt, Artificial Sequence
  Description of Artificial Sequence: Synthetic oligonucleotide
ccggccagggccccaggg

SEQ ID NO: 38508 - RNA, 18 nt, Artificial Sequence
  Description of Artificial Sequence: Synthetic oligonucleotide
ccgccccggccagggccc

SEQ ID NO: 38509 - RNA, 18 nt, Artificial Sequence
  Description of Artificial Sequence: Synthetic oligonucleotide
uacccccgccccggccag

SEQ ID NO: 38510 - RNA, 18 nt, Artificial Sequence
  Description of Artificial Sequence: Synthetic oligonucleotide
aggaguacccccgccccg

SEQ ID NO: 38511 - RNA, 18 nt, Artificial Sequence
  Description of Artificial Sequence: Synthetic oligonucleotide
ugcccaggaguacccccg

SEQ ID NO: 38512 - RNA, 18 nt, Artificial Sequence
  Description of Artificial Sequence: Synthetic oligonucleotide
caaccugcccaggaguac

SEQ ID NO: 38513 - RNA, 18 nt, Artificial Sequence
  Description of Artificial Sequence: Synthetic oligonucleotide
gggugcaaccugcccagg

SEQ ID NO: 38514 - RNA, 18 nt, Artificial Sequence
  Description of Artificial Sequence: Synthetic oligonucleotide
ggcagcagccugcgugau

SEQ ID NO: 38515 - RNA, 18 nt, Artificial Sequence
  Description of Artificial Sequence: Synthetic oligonucleotide
gaccaggcagcagccugc

SEQ ID NO: 38516 - RNA, 18 nt, Artificial Sequence
  Description of Artificial Sequence: Synthetic oligonucleotide
cuccugaccaggcagcag

SEQ ID NO: 38517 - RNA, 18 nt, Artificial Sequence
  Description of Artificial Sequence: Synthetic oligonucleotide
uguaucuccugaccaggc

SEQ ID NO: 38518 - RNA, 18 nt, Artificial Sequence
  Description of Artificial Sequence: Synthetic oligonucleotide
accaauguaucuccugac

SEQ ID NO: 38519 - RNA, 18 nt, Artificial Sequence
  Description of Artificial Sequence: Synthetic oligonucleotide
ugcccaccaauguaucuc

SEQ ID NO: 38520 - RNA, 18 nt, Artificial Sequence
  Description of Artificial Sequence: Synthetic oligonucleotide
gcgccugcccaccaaugu

SEQ ID NO: 38521 - RNA, 18 nt, Artificial Sequence
  Description of Artificial Sequence: Synthetic oligonucleotide
ggccugcgccugcccacc

SEQ ID NO: 38522 - RNA, 18 nt, Artificial Sequence
  Description of Artificial Sequence: Synthetic oligonucleotide
acaagggccugcgccugc

SEQ ID NO: 38523 - RNA, 18 nt, Artificial Sequence
  Description of Artificial Sequence: Synthetic oligonucleotide
cccccacaagggccugcg

SEQ ID NO: 38524 - RNA, 18 nt, Artificial Sequence
  Description of Artificial Sequence: Synthetic oligonucleotide
ccauccccccacaagggc

SEQ ID NO: 38525 - RNA, 18 nt, Artificial Sequence
  Description of Artificial Sequence: Synthetic oligonucleotide
cacccccauccccccaca

SEQ ID NO: 38526 - RNA, 18 nt, Artificial Sequence
  Description of Artificial Sequence: Synthetic oligonucleotide
cuugucacccccaucccc

SEQ ID NO: 38527 - RNA, 18 nt, Artificial Sequence
  Description of Artificial Sequence: Synthetic oligonucleotide
uaucccuugucaccccca

SEQ ID NO: 38528 - RNA, 18 nt, Artificial Sequence
  Description of Artificial Sequence: Synthetic oligonucleotide
caaccuaucccuugucac

SEQ ID NO: 38529 - RNA, 18 nt, Artificial Sequence
  Description of Artificial Sequence: Synthetic oligonucleotide
accaccaaccuaucccuu

SEQ ID NO: 38530 - RNA, 18 nt, Artificial Sequence
  Description of Artificial Sequence: Synthetic oligonucleotide
cgccgaccaccaaccuau

SEQ ID NO: 38531 - RNA, 18 nt, Artificial Sequence
  Description of Artificial Sequence: Synthetic oligonucleotide
gccugcgccgaccaccaa

SEQ ID NO: 38532 - RNA, 18 nt, Artificial Sequence
  Description of Artificial Sequence: Synthetic oligonucleotide
ccagggccugcgccgacc

SEQ ID NO: 38533 - RNA, 18 nt, Artificial Sequence
  Description of Artificial Sequence: Synthetic oligonucleotide
gggccccagggccugcgc

SEQ ID NO: 38534 - RNA, 18 nt, Artificial Sequence
  Description of Artificial Sequence: Synthetic oligonucleotide
caggaguaccccccagcc

SEQ ID NO: 38535 - RNA, 18 nt, Artificial Sequence
  Description of Artificial Sequence: Synthetic oligonucleotide
aagcccaggaguaccccc

SEQ ID NO: 38536 - RNA, 18 nt, Artificial Sequence
  Description of Artificial Sequence: Synthetic oligonucleotide
ccaccaagcccaggagua

SEQ ID NO: 38537 - RNA, 18 nt, Artificial Sequence
  Description of Artificial Sequence: Synthetic oligonucleotide
cccacccaccaagcccag

SEQ ID NO: 38538 - RNA, 18 nt, Artificial Sequence
  Description of Artificial Sequence: Synthetic oligonucleotide
cuucgcccacccaccaag

SEQ ID NO: 38539 - RNA, 18 nt, Artificial Sequence
  Description of Artificial Sequence: Synthetic oligonucleotide
agggccuucgcccaccca

SEQ ID NO: 38540 - RNA, 18 nt, Artificial Sequence
  Description of Artificial Sequence: Synthetic oligonucleotide
ggcccagggccuucgccc

SEQ ID NO: 38541 - RNA, 18 nt, Artificial Sequence
  Description of Artificial Sequence: Synthetic oligonucleotide
gggcccagggccuucgcc

SEQ ID NO: 38542 - RNA, 18 nt, Artificial Sequence
  Description of Artificial Sequence: Synthetic oligonucleotide
guaccccccaccccaggg

SEQ ID NO: 38543 - RNA, 18 nt, Artificial Sequence
  Description of Artificial Sequence: Synthetic oligonucleotide
caggaguaccccccaccc

SEQ ID NO: 38544 - RNA, 18 nt, Artificial Sequence
  Description of Artificial Sequence: Synthetic oligonucleotide
cugcccaggaguaccccc

SEQ ID NO: 38545 - RNA, 18 nt, Artificial Sequence
  Description of Artificial Sequence: Synthetic oligonucleotide
gcagccugcccaggagua

SEQ ID NO: 38546 - RNA, 18 nt, Artificial Sequence
  Description of Artificial Sequence: Synthetic oligonucleotide
gggugcagccugcccagg

SEQ ID NO: 38547 - RNA, 18 nt, Artificial Sequence
  Description of Artificial Sequence: Synthetic oligonucleotide
gggcccagggccuucgcc

SEQ ID NO: 38548 - RNA, 18 nt, Artificial Sequence
  Description of Artificial Sequence: Synthetic oligonucleotide
guaccccccaccccaggg

SEQ ID NO: 38549 - RNA, 18 nt, Artificial Sequence
  Description of Artificial Sequence: Synthetic oligonucleotide
aggaguaccccccacccc

SEQ ID NO: 38550 - RNA, 18 nt, Artificial Sequence
  Description of Artificial Sequence: Synthetic oligonucleotide
ugcccaggaguacccccc

SEQ ID NO: 38551 - RNA, 18 nt, Artificial Sequence
  Description of Artificial Sequence: Synthetic oligonucleotide
cagccugcccaggaguac

SEQ ID NO: 38552 - RNA, 18 nt, Artificial Sequence
  Description of Artificial Sequence: Synthetic oligonucleotide
gggugcagccugcccagg

SEQ ID NO: 38553 - RNA, 18 nt, Artificial Sequence
  Description of Artificial Sequence: Synthetic oligonucleotide
gcggccugggugauaggg

SEQ ID NO: 38554 - RNA, 18 nt, Artificial Sequence
  Description of Artificial Sequence: Synthetic oligonucleotide
gggugcggccugggugau

SEQ ID NO: 38555 - RNA, 18 nt, Artificial Sequence
  Description of Artificial Sequence: Synthetic oligonucleotide
gcggccugggugauaggg

SEQ ID NO: 38556 - RNA, 18 nt, Artificial Sequence
  Description of Artificial Sequence: Synthetic oligonucleotide
gcggcggccugggugaua

SEQ ID NO: 38557 - RNA, 18 nt, Artificial Sequence
  Description of Artificial Sequence: Synthetic oligonucleotide
ccugggcggcggccuggg

SEQ ID NO: 38558 - RNA, 18 nt, Artificial Sequence
  Description of Artificial Sequence: Synthetic oligonucleotide
caagaccugggcggcggc

SEQ ID NO: 38559 - RNA, 18 nt, Artificial Sequence
  Description of Artificial Sequence: Synthetic oligonucleotide
ggguccaagaccugggcg

SEQ ID NO: 38560 - RNA, 18 nt, Artificial Sequence
  Description of Artificial Sequence: Synthetic oligonucleotide
gaagcgcuggcucaaggg

SEQ ID NO: 38561 - RNA, 18 nt, Artificial Sequence
  Description of Artificial Sequence: Synthetic oligonucleotide
caggaagcgcuggcucaa

SEQ ID NO: 38562 - RNA, 18 nt, Artificial Sequence
  Description of Artificial Sequence: Synthetic oligonucleotide
cacaucaggaagcgcugg

SEQ ID NO: 38563 - RNA, 18 nt, Artificial Sequence
  Description of Artificial Sequence: Synthetic oligonucleotide
cgccccacaucaggaagc

SEQ ID NO: 38564 - RNA, 18 nt, Artificial Sequence
  Description of Artificial Sequence: Synthetic oligonucleotide
ccucccgccccacaucag

SEQ ID NO: 38565 - RNA, 18 nt, Artificial Sequence
  Description of Artificial Sequence: Synthetic oligonucleotide
gccagccucccgccccac

SEQ ID NO: 38566 - RNA, 18 nt, Artificial Sequence
  Description of Artificial Sequence: Synthetic oligonucleotide
ugcaggccagccucccgc

SEQ ID NO: 38567 - RNA, 18 nt, Artificial Sequence
  Description of Artificial Sequence: Synthetic oligonucleotide
cuccaugcaggccagccu

SEQ ID NO: 38568 - RNA, 18 nt, Artificial Sequence
  Description of Artificial Sequence: Synthetic oligonucleotide
cccaucuccaugcaggcc

SEQ ID NO: 38569 - RNA, 18 nt, Artificial Sequence
  Description of Artificial Sequence: Synthetic oligonucleotide
ugaaccccaucuccaugc

SEQ ID NO: 38570 - RNA, 18 nt, Artificial Sequence
  Description of Artificial Sequence: Synthetic oligonucleotide
caagaugaaccccaucuc

SEQ ID NO: 38571 - RNA, 18 nt, Artificial Sequence
  Description of Artificial Sequence: Synthetic oligonucleotide
ugacucaagaugaacccc

SEQ ID NO: 38572 - RNA, 18 nt, Artificial Sequence
  Description of Artificial Sequence: Synthetic oligonucleotide
gcgucugacucaagauga

SEQ ID NO: 38573 - RNA, 18 nt, Artificial Sequence
  Description of Artificial Sequence: Synthetic oligonucleotide
gaagggcgucugacucaa

SEQ ID NO: 38574 - RNA, 18 nt, Artificial Sequence
  Description of Artificial Sequence: Synthetic oligonucleotide
gugaugaagggcgucuga

SEQ ID NO: 38575 - RNA, 18 nt, Artificial Sequence
  Description of Artificial Sequence: Synthetic oligonucleotide
gcaaggugaugaagggcg

SEQ ID NO: 38576 - RNA, 18 nt, Artificial Sequence
  Description of Artificial Sequence: Synthetic oligonucleotide
agggugcaaggugaugaa

SEQ ID NO: 38577 - RNA, 18 nt, Artificial Sequence
  Description of Artificial Sequence: Synthetic oligonucleotide
gagggagggugcaaggug

SEQ ID NO: 38578 - RNA, 18 nt, Artificial Sequence
  Description of Artificial Sequence: Synthetic oligonucleotide
ccacggagggagggugca

SEQ ID NO: 38579 - RNA, 18 nt, Artificial Sequence
  Description of Artificial Sequence: Synthetic oligonucleotide
gacucccacggagggagg

SEQ ID NO: 38580 - RNA, 18 nt, Artificial Sequence
  Description of Artificial Sequence: Synthetic oligonucleotide
ucagugacucccacggag

SEQ ID NO: 38581 - RNA, 18 nt, Artificial Sequence
  Description of Artificial Sequence: Synthetic oligonucleotide
ucgccucagugacuccca

SEQ ID NO: 38582 - RNA, 18 nt, Artificial Sequence
  Description of Artificial Sequence: Synthetic oligonucleotide
gaaucucgccucagugac

SEQ ID NO: 38583 - RNA, 18 nt, Artificial Sequence
  Description of Artificial Sequence: Synthetic oligonucleotide
caggugaaucucgccuca

SEQ ID NO: 38584 - RNA, 18 nt, Artificial Sequence
  Description of Artificial Sequence: Synthetic oligonucleotide
cagcacaggugaaucucg

SEQ ID NO: 38585 - RNA, 18 nt, Artificial Sequence
  Description of Artificial Sequence: Synthetic oligonucleotide
ccccccagcacaggugaa

SEQ ID NO: 38586 - RNA, 18 nt, Artificial Sequence
  Description of Artificial Sequence: Synthetic oligonucleotide
gcuguccccccagcacag

SEQ ID NO: 38587 - RNA, 18 nt, Artificial Sequence
  Description of Artificial Sequence: Synthetic oligonucleotide
ugcgccaguccguaccua

SEQ ID NO: 38588 - RNA, 18 nt, Artificial Sequence
  Description of Artificial Sequence: Synthetic oligonucleotide
aaacaugcgccaguccgu

SEQ ID NO: 38589 - RNA, 18 nt, Artificial Sequence
  Description of Artificial Sequence: Synthetic oligonucleotide
cuuggaaacaugcgccag

SEQ ID NO: 38590 - RNA, 18 nt, Artificial Sequence
  Description of Artificial Sequence: Synthetic oligonucleotide
uuccacuuggaaacaugc

SEQ ID NO: 38591 - RNA, 18 nt, Artificial Sequence
  Description of Artificial Sequence: Synthetic oligonucleotide
cgaaguuccacuuggaaa

SEQ ID NO: 38592 - RNA, 18 nt, Artificial Sequence
  Description of Artificial Sequence: Synthetic oligonucleotide
cgucucgaaguuccacuu

SEQ ID NO: 38593 - RNA, 18 nt, Artificial Sequence
  Description of Artificial Sequence: Synthetic oligonucleotide
uuccacgucucgaaguuc

SEQ ID NO: 38594 - RNA, 18 nt, Artificial Sequence
  Description of Artificial Sequence: Synthetic oligonucleotide
gcucauuccacgucucga

SEQ ID NO: 38595 - RNA, 18 nt, Artificial Sequence
  Description of Artificial Sequence: Synthetic oligonucleotide
gucuggcucauuccacgu

SEQ ID NO: 38596 - RNA, 18 nt, Artificial Sequence
  Description of Artificial Sequence: Synthetic oligonucleotide
ugguggucuggcucauuc

SEQ ID NO: 38597 - RNA, 18 nt, Artificial Sequence
  Description of Artificial Sequence: Synthetic oligonucleotide
agucgugguggucuggcu

SEQ ID NO: 38598 - RNA, 18 nt, Artificial Sequence
  Description of Artificial Sequence: Synthetic oligonucleotide
gucaaagucguggugguc

SEQ ID NO: 38599 - RNA, 18 nt, Artificial Sequence
  Description of Artificial Sequence: Synthetic oligonucleotide
acguugucaaagucgugg

SEQ ID NO: 38600 - RNA, 18 nt, Artificial Sequence
  Description of Artificial Sequence: Synthetic oligonucleotide
uggagacguugucaaagu

SEQ ID NO: 38601 - RNA, 18 nt, Artificial Sequence
  Description of Artificial Sequence: Synthetic oligonucleotide
ggucauggagacguuguc

SEQ ID NO: 38602 - RNA, 18 nt, Artificial Sequence
  Description of Artificial Sequence: Synthetic oligonucleotide
ugcauggucauggagacg

SEQ ID NO: 38603 - RNA, 18 nt, Artificial Sequence
  Description of Artificial Sequence: Synthetic oligonucleotide
gcgccaguccguaccuac

SEQ ID NO: 38604 - RNA, 18 nt, Artificial Sequence
  Description of Artificial Sequence: Synthetic oligonucleotide
aacaugcgccaguccgua

SEQ ID NO: 38605 - RNA, 18 nt, Artificial Sequence
  Description of Artificial Sequence: Synthetic oligonucleotide
uuggaaacaugcgccagu

SEQ ID NO: 38606 - RNA, 18 nt, Artificial Sequence
  Description of Artificial Sequence: Synthetic oligonucleotide
uccacuuggaaacaugcg

SEQ ID NO: 38607 - RNA, 18 nt, Artificial Sequence
  Description of Artificial Sequence: Synthetic oligonucleotide
gaaguuccacuuggaaac

SEQ ID NO: 38608 - RNA, 18 nt, Artificial Sequence
  Description of Artificial Sequence: Synthetic oligonucleotide
gucucgaaguuccacuug

SEQ ID NO: 38609 - RNA, 18 nt, Artificial Sequence
  Description of Artificial Sequence: Synthetic oligonucleotide
uccacgucucgaaguucc

SEQ ID NO: 38610 - RNA, 18 nt, Artificial Sequence
  Description of Artificial Sequence: Synthetic oligonucleotide
cucauuccacgucucgaa

SEQ ID NO: 38611 - RNA, 18 nt, Artificial Sequence
  Description of Artificial Sequence: Synthetic oligonucleotide
ucuggcucauuccacguc

SEQ ID NO: 38612 - RNA, 18 nt, Artificial Sequence
  Description of Artificial Sequence: Synthetic oligonucleotide
gguggucuggcucauucc

SEQ ID NO: 38613 - RNA, 18 nt, Artificial Sequence
  Description of Artificial Sequence: Synthetic oligonucleotide
gucgugguggucuggcuc

SEQ ID NO: 38614 - RNA, 18 nt, Artificial Sequence
  Description of Artificial Sequence: Synthetic oligonucleotide
ucaaagucgugguggucu

SEQ ID NO: 38615 - RNA, 18 nt, Artificial Sequence
  Description of Artificial Sequence: Synthetic oligonucleotide
cguugucaaagucguggu

SEQ ID NO: 38616 - RNA, 18 nt, Artificial Sequence
  Description of Artificial Sequence: Synthetic oligonucleotide
ggagacguugucaaaguc

SEQ ID NO: 38617 - RNA, 18 nt, Artificial Sequence
  Description of Artificial Sequence: Synthetic oligonucleotide
gucauggagacguuguca

SEQ ID NO: 38618 - RNA, 18 nt, Artificial Sequence
  Description of Artificial Sequence: Synthetic oligonucleotide
gcauggucauggagacgu

SEQ ID NO: 38619 - RNA, 18 nt, Artificial Sequence
  Description of Artificial Sequence: Synthetic oligonucleotide
ggaccccaggaagcggug

SEQ ID NO: 38620 - RNA, 18 nt, Artificial Sequence
  Description of Artificial Sequence: Synthetic oligonucleotide
gggcaggaccccaggaag

SEQ ID NO: 38621 - RNA, 18 nt, Artificial Sequence
  Description of Artificial Sequence: Synthetic oligonucleotide
cagccgggcaggacccca

SEQ ID NO: 38622 - RNA, 18 nt, Artificial Sequence
  Description of Artificial Sequence: Synthetic oligonucleotide
ccuuucagccgggcagga

SEQ ID NO: 38623 - RNA, 18 nt, Artificial Sequence
  Description of Artificial Sequence: Synthetic oligonucleotide
ugcccccuuucagccggg

SEQ ID NO: 38624 - RNA, 18 nt, Artificial Sequence
  Description of Artificial Sequence: Synthetic oligonucleotide
uccucugcccccuuucag

SEQ ID NO: 38625 - RNA, 18 nt, Artificial Sequence
  Description of Artificial Sequence: Synthetic oligonucleotide
ugccuuccucugcccccu

SEQ ID NO: 38626 - RNA, 18 nt, Artificial Sequence
  Description of Artificial Sequence: Synthetic oligonucleotide
gcuccugccuuccucugc

SEQ ID NO: 38627 - RNA, 18 nt, Artificial Sequence
  Description of Artificial Sequence: Synthetic oligonucleotide
ccucugcuccugccuucc

SEQ ID NO: 38628 - RNA, 18 nt, Artificial Sequence
  Description of Artificial Sequence: Synthetic oligonucleotide
cuuagccucugcuccugc

SEQ ID NO: 38629 - RNA, 18 nt, Artificial Sequence
  Description of Artificial Sequence: Synthetic oligonucleotide
agcggcuuagccucugcu

SEQ ID NO: 38630 - RNA, 18 nt, Artificial Sequence
  Description of Artificial Sequence: Synthetic oligonucleotide
ggaugagcggcuuagccu

SEQ ID NO: 38631 - RNA, 18 nt, Artificial Sequence
  Description of Artificial Sequence: Synthetic oligonucleotide
gggaugagcggcuuagcc

SEQ ID NO: 38632 - RNA, 18 nt, Artificial Sequence
  Description of Artificial Sequence: Synthetic oligonucleotide
ucugcccccuuucagccg

SEQ ID NO: 38633 - RNA, 18 nt, Artificial Sequence
  Description of Artificial Sequence: Synthetic oligonucleotide
cuuccucugcccccuuuc

SEQ ID NO: 38634 - RNA, 18 nt, Artificial Sequence
  Description of Artificial Sequence: Synthetic oligonucleotide
ccugccuuccucugcccc

SEQ ID NO: 38635 - RNA, 18 nt, Artificial Sequence
  Description of Artificial Sequence: Synthetic oligonucleotide
cugcuccugccuuccucu

SEQ ID NO: 38636 - RNA, 18 nt, Artificial Sequence
  Description of Artificial Sequence: Synthetic oligonucleotide
agccucugcuccugccuu

SEQ ID NO: 38637 - RNA, 18 nt, Artificial Sequence
  Description of Artificial Sequence: Synthetic oligonucleotide
ggcuuagccucugcuccu

SEQ ID NO: 38638 - RNA, 18 nt, Artificial Sequence
  Description of Artificial Sequence: Synthetic oligonucleotide
ugagcggcuuagccucug

SEQ ID NO: 38639 - RNA, 18 nt, Artificial Sequence
  Description of Artificial Sequence: Synthetic oligonucleotide
gucuacaccugcccuggg

SEQ ID NO: 38640 - RNA, 18 nt, Artificial Sequence
  Description of Artificial Sequence: Synthetic oligonucleotide
acugcgucuacaccugcc

SEQ ID NO: 38641 - RNA, 18 nt, Artificial Sequence
  Description of Artificial Sequence: Synthetic oligonucleotide
ucguaguaguucaggaag

SEQ ID NO: 38642 - RNA, 18 nt, Artificial Sequence
  Description of Artificial Sequence: Synthetic oligonucleotide
aggcaucguaguaguuca

SEQ ID NO: 38643 - RNA, 18 nt, Artificial Sequence
  Description of Artificial Sequence: Synthetic oligonucleotide
cgagcaggcaucguagua

SEQ ID NO: 38644 - RNA, 18 nt, Artificial Sequence
  Description of Artificial Sequence: Synthetic oligonucleotide
cccuccgagcaggcaucg

SEQ ID NO: 38645 - RNA, 18 nt, Artificial Sequence
  Description of Artificial Sequence: Synthetic oligonucleotide
gcagacccuccgagcagg

SEQ ID NO: 38646 - RNA, 18 nt, Artificial Sequence
  Description of Artificial Sequence: Synthetic oligonucleotide
ggcgcgcagacccuccga

SEQ ID NO: 38647 - RNA, 18 nt, Artificial Sequence
  Description of Artificial Sequence: Synthetic oligonucleotide
cuggcggcgcgcagaccc

SEQ ID NO: 38648 - RNA, 18 nt, Artificial Sequence
  Description of Artificial Sequence: Synthetic oligonucleotide
gggcuggcggcgcgcaga

SEQ ID NO: 38649 - RNA, 18 nt, Artificial Sequence
  Description of Artificial Sequence: Synthetic oligonucleotide
ucccagccgcagggcggg

SEQ ID NO: 38650 - RNA, 18 nt, Artificial Sequence
  Description of Artificial Sequence: Synthetic oligonucleotide
gggccucccagccgcagg

SEQ ID NO: 38651 - RNA, 18 nt, Artificial Sequence
  Description of Artificial Sequence: Synthetic oligonucleotide
ggguguggaaggagucgc

SEQ ID NO: 38652 - RNA, 18 nt, Artificial Sequence
  Description of Artificial Sequence: Synthetic oligonucleotide
ggaggccccagcucagcg

SEQ ID NO: 38653 - RNA, 18 nt, Artificial Sequence
  Description of Artificial Sequence: Synthetic oligonucleotide
gcgcaggaggccccagcu

SEQ ID NO: 38654 - RNA, 18 nt, Artificial Sequence
  Description of Artificial Sequence: Synthetic oligonucleotide
caguggcgcaggaggccc

SEQ ID NO: 38655 - RNA, 18 nt, Artificial Sequence
  Description of Artificial Sequence: Synthetic oligonucleotide
cguggcaguggcgcagga

SEQ ID NO: 38656 - RNA, 18 nt, Artificial Sequence
  Description of Artificial Sequence: Synthetic oligonucleotide
accgucguggcaguggcg

SEQ ID NO: 38657 - RNA, 18 nt, Artificial Sequence
  Description of Artificial Sequence: Synthetic oligonucleotide
uugguaccgucguggcag

SEQ ID NO: 38658 - RNA, 18 nt, Artificial Sequence
  Description of Artificial Sequence: Synthetic oligonucleotide
agaaguugguaccgucgu

SEQ ID NO: 38659 - RNA, 18 nt, Artificial Sequence
  Description of Artificial Sequence: Synthetic oligonucleotide
agugaagaaguugguacc

SEQ ID NO: 38660 - RNA, 18 nt, Artificial Sequence
  Description of Artificial Sequence: Synthetic oligonucleotide
uccccagugaagaaguug

SEQ ID NO: 38661 - RNA, 18 nt, Artificial Sequence
  Description of Artificial Sequence: Synthetic oligonucleotide
ccgccuccccagugaaga

SEQ ID NO: 38662 - RNA, 18 nt, Artificial Sequence
  Description of Artificial Sequence: Synthetic oligonucleotide
cacgcccgccuccccagu

SEQ ID NO: 38663 - RNA, 18 nt, Artificial Sequence
  Description of Artificial Sequence: Synthetic oligonucleotide
agccgcacgcccgccucc

SEQ ID NO: 38664 - RNA, 18 nt, Artificial Sequence
  Description of Artificial Sequence: Synthetic oligonucleotide
aguccagccgcacgcccg

SEQ ID NO: 38665 - RNA, 18 nt, Artificial Sequence
  Description of Artificial Sequence: Synthetic oligonucleotide
gauguaguccagccgcac

SEQ ID NO: 38666 - RNA, 18 nt, Artificial Sequence
  Description of Artificial Sequence: Synthetic oligonucleotide
agggagauguaguccagc

SEQ ID NO: 38667 - RNA, 18 nt, Artificial Sequence
  Description of Artificial Sequence: Synthetic oligonucleotide
uguggagggagauguagu

SEQ ID NO: 38668 - RNA, 18 nt, Artificial Sequence
  Description of Artificial Sequence: Synthetic oligonucleotide
cuuccuguggagggagau

SEQ ID NO: 38669 - RNA, 18 nt, Artificial Sequence
  Description of Artificial Sequence: Synthetic oligonucleotide
cguaguaguucaggaagc

SEQ ID NO: 38670 - RNA, 18 nt, Artificial Sequence
  Description of Artificial Sequence: Synthetic oligonucleotide
ggcaucguaguaguucag

SEQ ID NO: 38671 - RNA, 18 nt, Artificial Sequence
  Description of Artificial Sequence: Synthetic oligonucleotide
gagcaggcaucguaguag

SEQ ID NO: 38672 - RNA, 18 nt, Artificial Sequence
  Description of Artificial Sequence: Synthetic oligonucleotide
ccuccgagcaggcaucgu

SEQ ID NO: 38673 - RNA, 18 nt, Artificial Sequence
  Description of Artificial Sequence: Synthetic oligonucleotide
cagacccuccgagcaggc

SEQ ID NO: 38674 - RNA, 18 nt, Artificial Sequence
  Description of Artificial Sequence: Synthetic oligonucleotide
gcgcgcagacccuccgag

SEQ ID NO: 38675 - RNA, 18 nt, Artificial Sequence
  Description of Artificial Sequence: Synthetic oligonucleotide
uggcggcgcgcagacccu

SEQ ID NO: 38676 - RNA, 18 nt, Artificial Sequence
  Description of Artificial Sequence: Synthetic oligonucleotide
ucccagccgcagggcggg

SEQ ID NO: 38677 - RNA, 18 nt, Artificial Sequence
  Description of Artificial Sequence: Synthetic oligonucleotide
gggccucccagccgcagg

SEQ ID NO: 38678 - RNA, 18 nt, Artificial Sequence
  Description of Artificial Sequence: Synthetic oligonucleotide
guggaaggagucgccggg

SEQ ID NO: 38679 - RNA, 18 nt, Artificial Sequence
  Description of Artificial Sequence: Synthetic oligonucleotide
ggguguggaaggagucgc

SEQ ID NO: 38680 - RNA, 18 nt, Artificial Sequence
  Description of Artificial Sequence: Synthetic oligonucleotide
aggccccagcucagcggg

SEQ ID NO: 38681 - RNA, 18 nt, Artificial Sequence
  Description of Artificial Sequence: Synthetic oligonucleotide
caggaggccccagcucag

SEQ ID NO: 38682 - RNA, 18 nt, Artificial Sequence
  Description of Artificial Sequence: Synthetic oligonucleotide
uggcgcaggaggccccag

SEQ ID NO: 38683 - RNA, 18 nt, Artificial Sequence
  Description of Artificial Sequence: Synthetic oligonucleotide
ggcaguggcgcaggaggc

SEQ ID NO: 38684 - RNA, 18 nt, Artificial Sequence
  Description of Artificial Sequence: Synthetic oligonucleotide
gucguggcaguggcgcag

SEQ ID NO: 38685 - RNA, 18 nt, Artificial Sequence
  Description of Artificial Sequence: Synthetic oligonucleotide
guaccgucguggcagugg

SEQ ID NO: 38686 - RNA, 18 nt, Artificial Sequence
  Description of Artificial Sequence: Synthetic oligonucleotide
aguugguaccgucguggc

SEQ ID NO: 38687 - RNA, 18 nt, Artificial Sequence
  Description of Artificial Sequence: Synthetic oligonucleotide
gaagaaguugguaccguc

SEQ ID NO: 38688 - RNA, 18 nt, Artificial Sequence
  Description of Artificial Sequence: Synthetic oligonucleotide
ccagugaagaaguuggua

SEQ ID NO: 38689 - RNA, 18 nt, Artificial Sequence
  Description of Artificial Sequence: Synthetic oligonucleotide
ccuccccagugaagaagu

SEQ ID NO: 38690 - RNA, 18 nt, Artificial Sequence
  Description of Artificial Sequence: Synthetic oligonucleotide
gcccgccuccccagugaa

SEQ ID NO: 38691 - RNA, 18 nt, Artificial Sequence
  Description of Artificial Sequence: Synthetic oligonucleotide
cgcacgcccgccucccca

SEQ ID NO: 38692 - RNA, 18 nt, Artificial Sequence
  Description of Artificial Sequence: Synthetic oligonucleotide
ccagccgcacgcccgccu

SEQ ID NO: 38693 - RNA, 18 nt, Artificial Sequence
  Description of Artificial Sequence: Synthetic oligonucleotide
guaguccagccgcacgcc

SEQ ID NO: 38694 - RNA, 18 nt, Artificial Sequence
  Description of Artificial Sequence: Synthetic oligonucleotide
gagauguaguccagccgc

SEQ ID NO: 38695 - RNA, 18 nt, Artificial Sequence
  Description of Artificial Sequence: Synthetic oligonucleotide
ggagggagauguagucca

SEQ ID NO: 38696 - RNA, 18 nt, Artificial Sequence
  Description of Artificial Sequence: Synthetic oligonucleotide
ccuguggagggagaugua

SEQ ID NO: 38697 - RNA, 18 nt, Artificial Sequence
  Description of Artificial Sequence: Synthetic oligonucleotide
ugagggcgcagaacaccg

SEQ ID NO: 38698 - RNA, 18 nt, Artificial Sequence
  Description of Artificial Sequence: Synthetic oligonucleotide
gcggcugagggcgcagaa

SEQ ID NO: 38699 - RNA, 18 nt, Artificial Sequence
  Description of Artificial Sequence: Synthetic oligonucleotide
gcacagcggcugagggcg

SEQ ID NO: 38700 - RNA, 18 nt, Artificial Sequence
  Description of Artificial Sequence: Synthetic oligonucleotide
gggcacagcggcugaggg

SEQ ID NO: 38701 - RNA, 18 nt, Artificial Sequence
  Description of Artificial Sequence: Synthetic oligonucleotide
gggucagcgcggcccggg

SEQ ID NO: 38702 - RNA, 18 nt, Artificial Sequence
  Description of Artificial Sequence: Synthetic oligonucleotide
caccagggucagcgcggc

SEQ ID NO: 38703 - RNA, 18 nt, Artificial Sequence
  Description of Artificial Sequence: Synthetic oligonucleotide
agcaccaccagggucagc

SEQ ID NO: 38704 - RNA, 18 nt, Artificial Sequence
  Description of Artificial Sequence: Synthetic oligonucleotide
agggcgcagaacaccggg

SEQ ID NO: 38705 - RNA, 18 nt, Artificial Sequence
  Description of Artificial Sequence: Synthetic oligonucleotide
gcugagggcgcagaacac

SEQ ID NO: 38706 - RNA, 18 nt, Artificial Sequence
  Description of Artificial Sequence: Synthetic oligonucleotide
cagcggcugagggcgcag

SEQ ID NO: 38707 - RNA, 18 nt, Artificial Sequence
  Description of Artificial Sequence: Synthetic oligonucleotide
gggcacagcggcugaggg

SEQ ID NO: 38708 - RNA, 18 nt, Artificial Sequence
  Description of Artificial Sequence: Synthetic oligonucleotide
gggucagcgcggcccggg

SEQ ID NO: 38709 - RNA, 18 nt, Artificial Sequence
  Description of Artificial Sequence: Synthetic oligonucleotide
accagggucagcgcggcc

SEQ ID NO: 38710 - RNA, 18 nt, Artificial Sequence
  Description of Artificial Sequence: Synthetic oligonucleotide
gcaccaccagggucagcg

SEQ ID NO: 38711 - RNA, 18 nt, Artificial Sequence
  Description of Artificial Sequence: Synthetic oligonucleotide
ccucagcaccaccagggu

SEQ ID NO: 38712 - RNA, 18 nt, Artificial Sequence
  Description of Artificial Sequence: Synthetic oligonucleotide
agauggagcugcgcgcac

SEQ ID NO: 38713 - RNA, 18 nt, Artificial Sequence
  Description of Artificial Sequence: Synthetic oligonucleotide
gauggagauggagcugcg

SEQ ID NO: 38714 - RNA, 18 nt, Artificial Sequence
  Description of Artificial Sequence: Synthetic oligonucleotide
uccaggauggagauggag

SEQ ID NO: 38715 - RNA, 18 nt, Artificial Sequence
  Description of Artificial Sequence: Synthetic oligonucleotide
ccugcuccaggauggaga

SEQ ID NO: 38716 - RNA, 18 nt, Artificial Sequence
  Description of Artificial Sequence: Synthetic oligonucleotide
cuucuccugcuccaggau

SEQ ID NO: 38717 - RNA, 18 nt, Artificial Sequence
  Description of Artificial Sequence: Synthetic oligonucleotide
acgaccuucuccugcucc

SEQ ID NO: 38718 - RNA, 18 nt, Artificial Sequence
  Description of Artificial Sequence: Synthetic oligonucleotide
gcgcgacgaccuucuccu

SEQ ID NO: 38719 - RNA, 18 nt, Artificial Sequence
  Description of Artificial Sequence: Synthetic oligonucleotide
cugcugcgcgacgaccuu

SEQ ID NO: 38720 - RNA, 18 nt, Artificial Sequence
  Description of Artificial Sequence: Synthetic oligonucleotide
cggaucugcugcgcgacg

SEQ ID NO: 38721 - RNA, 18 nt, Artificial Sequence
  Description of Artificial Sequence: Synthetic oligonucleotide
gcugccggaucugcugcg

SEQ ID NO: 38722 - RNA, 18 nt, Artificial Sequence
  Description of Artificial Sequence: Synthetic oligonucleotide
gaagagcugccggaucug

SEQ ID NO: 38723 - RNA, 18 nt, Artificial Sequence
  Description of Artificial Sequence: Synthetic oligonucleotide
gggaagagcugccggauc

SEQ ID NO: 38724 - RNA, 18 nt, Artificial Sequence
  Description of Artificial Sequence: Synthetic oligonucleotide
gguguccgcgaacuuggg

SEQ ID NO: 38725 - RNA, 18 nt, Artificial Sequence
  Description of Artificial Sequence: Synthetic oligonucleotide
ggguguccgcgaacuugg

SEQ ID NO: 38726 - RNA, 18 nt, Artificial Sequence
  Description of Artificial Sequence: Synthetic oligonucleotide
cucgucguuguaaauggg

SEQ ID NO: 38727 - RNA, 18 nt, Artificial Sequence
  Description of Artificial Sequence: Synthetic oligonucleotide
uccgccucgucguuguaa

SEQ ID NO: 38728 - RNA, 18 nt, Artificial Sequence
  Description of Artificial Sequence: Synthetic oligonucleotide
gcggguccgccucgucgu

SEQ ID NO: 38729 - RNA, 18 nt, Artificial Sequence
  Description of Artificial Sequence: Synthetic oligonucleotide
caccagcggguccgccuc

SEQ ID NO: 38730 - RNA, 18 nt, Artificial Sequence
  Description of Artificial Sequence: Synthetic oligonucleotide
cagcccaccagcgggucc

SEQ ID NO: 38731 - RNA, 18 nt, Artificial Sequence
  Description of Artificial Sequence: Synthetic oligonucleotide
gggaccagcccaccagcg

SEQ ID NO: 38732 - RNA, 18 nt, Artificial Sequence
  Description of Artificial Sequence: Synthetic oligonucleotide
uggcagggaccagcccac

SEQ ID NO: 38733 - RNA, 18 nt, Artificial Sequence
  Description of Artificial Sequence: Synthetic oligonucleotide
ggcuguggcagggaccag

SEQ ID NO: 38734 - RNA, 18 nt, Artificial Sequence
  Description of Artificial Sequence: Synthetic oligonucleotide
uccacggcuguggcaggg

SEQ ID NO: 38735 - RNA, 18 nt, Artificial Sequence
  Description of Artificial Sequence: Synthetic oligonucleotide
cgcccuccacggcugugg

SEQ ID NO: 38736 - RNA, 18 nt, Artificial Sequence
  Description of Artificial Sequence: Synthetic oligonucleotide
acguccgcccuccacggc

SEQ ID NO: 38737 - RNA, 18 nt, Artificial Sequence
  Description of Artificial Sequence: Synthetic oligonucleotide
aggucacguccgcccucc

SEQ ID NO: 38738 - RNA, 18 nt, Artificial Sequence
  Description of Artificial Sequence: Synthetic oligonucleotide
cgcguaggucacguccgc

SEQ ID NO: 38739 - RNA, 18 nt, Artificial Sequence
  Description of Artificial Sequence: Synthetic oligonucleotide
auggccgcguaggucacg

SEQ ID NO: 38740 - RNA, 18 nt, Artificial Sequence
  Description of Artificial Sequence: Synthetic oligonucleotide
ccaccauggccgcguagg

SEQ ID NO: 38741 - RNA, 18 nt, Artificial Sequence
  Description of Artificial Sequence: Synthetic oligonucleotide
cuucaccaccauggccgc

SEQ ID NO: 38742 - RNA, 18 nt, Artificial Sequence
  Description of Artificial Sequence: Synthetic oligonucleotide
ggagauggagcugcgcgc

SEQ ID NO: 38743 - RNA, 18 nt, Artificial Sequence
  Description of Artificial Sequence: Synthetic oligonucleotide
aggauggagauggagcug

SEQ ID NO: 38744 - RNA, 18 nt, Artificial Sequence
  Description of Artificial Sequence: Synthetic oligonucleotide
gcuccaggauggagaugg

SEQ ID NO: 38745 - RNA, 18 nt, Artificial Sequence
  Description of Artificial Sequence: Synthetic oligonucleotide
cuccugcuccaggaugga

SEQ ID NO: 38746 - RNA, 18 nt, Artificial Sequence
  Description of Artificial Sequence: Synthetic oligonucleotide
accuucuccugcuccagg

SEQ ID NO: 38747 - RNA, 18 nt, Artificial Sequence
  Description of Artificial Sequence: Synthetic oligonucleotide
cgacgaccuucuccugcu

SEQ ID NO: 38748 - RNA, 18 nt, Artificial Sequence
  Description of Artificial Sequence: Synthetic oligonucleotide
cugcgcgacgaccuucuc

SEQ ID NO: 38749 - RNA, 18 nt, Artificial Sequence
  Description of Artificial Sequence: Synthetic oligonucleotide
aucugcugcgcgacgacc

SEQ ID NO: 38750 - RNA, 18 nt, Artificial Sequence
  Description of Artificial Sequence: Synthetic oligonucleotide
gccggaucugcugcgcga

SEQ ID NO: 38751 - RNA, 18 nt, Artificial Sequence
  Description of Artificial Sequence: Synthetic oligonucleotide
gagcugccggaucugcug

SEQ ID NO: 38752 - RNA, 18 nt, Artificial Sequence
  Description of Artificial Sequence: Synthetic oligonucleotide
gggaagagcugccggauc

SEQ ID NO: 38753 - RNA, 18 nt, Artificial Sequence
  Description of Artificial Sequence: Synthetic oligonucleotide
gguguccgcgaacuuggg

SEQ ID NO: 38754 - RNA, 18 nt, Artificial Sequence
  Description of Artificial Sequence: Synthetic oligonucleotide
ggguguccgcgaacuugg

SEQ ID NO: 38755 - RNA, 18 nt, Artificial Sequence
  Description of Artificial Sequence: Synthetic oligonucleotide
cucgucguuguaaauggg

SEQ ID NO: 38756 - RNA, 18 nt, Artificial Sequence
  Description of Artificial Sequence: Synthetic oligonucleotide
gccucgucguuguaaaug

SEQ ID NO: 38757 - RNA, 18 nt, Artificial Sequence
  Description of Artificial Sequence: Synthetic oligonucleotide
gguccgccucgucguugu

SEQ ID NO: 38758 - RNA, 18 nt, Artificial Sequence
  Description of Artificial Sequence: Synthetic oligonucleotide
cagcggguccgccucguc

SEQ ID NO: 38759 - RNA, 18 nt, Artificial Sequence
  Description of Artificial Sequence: Synthetic oligonucleotide
cccaccagcggguccgcc

SEQ ID NO: 38760 - RNA, 18 nt, Artificial Sequence
  Description of Artificial Sequence: Synthetic oligonucleotide
accagcccaccagcgggu

SEQ ID NO: 38761 - RNA, 18 nt, Artificial Sequence
  Description of Artificial Sequence: Synthetic oligonucleotide
cagggaccagcccaccag

SEQ ID NO: 38762 - RNA, 18 nt, Artificial Sequence
  Description of Artificial Sequence: Synthetic oligonucleotide
uguggcagggaccagccc

SEQ ID NO: 38763 - RNA, 18 nt, Artificial Sequence
  Description of Artificial Sequence: Synthetic oligonucleotide
acggcuguggcagggacc

SEQ ID NO: 38764 - RNA, 18 nt, Artificial Sequence
  Description of Artificial Sequence: Synthetic oligonucleotide
ccuccacggcuguggcag

SEQ ID NO: 38765 - RNA, 18 nt, Artificial Sequence
  Description of Artificial Sequence: Synthetic oligonucleotide
uccgcccuccacggcugu

SEQ ID NO: 38766 - RNA, 18 nt, Artificial Sequence
  Description of Artificial Sequence: Synthetic oligonucleotide
ucacguccgcccuccacg

SEQ ID NO: 38767 - RNA, 18 nt, Artificial Sequence
  Description of Artificial Sequence: Synthetic oligonucleotide
guaggucacguccgcccu

SEQ ID NO: 38768 - RNA, 18 nt, Artificial Sequence
  Description of Artificial Sequence: Synthetic oligonucleotide
gccgcguaggucacgucc

SEQ ID NO: 38769 - RNA, 18 nt, Artificial Sequence
  Description of Artificial Sequence: Synthetic oligonucleotide
ccauggccgcguagguca

SEQ ID NO: 38770 - RNA, 18 nt, Artificial Sequence
  Description of Artificial Sequence: Synthetic oligonucleotide
caccaccauggccgcgua

SEQ ID NO: 38771 - RNA, 18 nt, Artificial Sequence
  Description of Artificial Sequence: Synthetic oligonucleotide
cgcagggcguugggccgg

SEQ ID NO: 38772 - RNA, 18 nt, Artificial Sequence
  Description of Artificial Sequence: Synthetic oligonucleotide
gggcgcgcagggcguugg

SEQ ID NO: 38773 - RNA, 18 nt, Artificial Sequence
  Description of Artificial Sequence: Synthetic oligonucleotide
ucgggaggaagguggccg

SEQ ID NO: 38774 - RNA, 18 nt, Artificial Sequence
  Description of Artificial Sequence: Synthetic oligonucleotide
ccgucucgggaggaaggu

SEQ ID NO: 38775 - RNA, 18 nt, Artificial Sequence
  Description of Artificial Sequence: Synthetic oligonucleotide
cugucccgucucgggagg

SEQ ID NO: 38776 - RNA, 18 nt, Artificial Sequence
  Description of Artificial Sequence: Synthetic oligonucleotide
cucgccugucccgucucg

SEQ ID NO: 38777 - RNA, 18 nt, Artificial Sequence
  Description of Artificial Sequence: Synthetic oligonucleotide
caccgcucgccugucccg

SEQ ID NO: 38778 - RNA, 18 nt, Artificial Sequence
  Description of Artificial Sequence: Synthetic oligonucleotide
gcggccaccgcucgccug

SEQ ID NO: 38779 - RNA, 18 nt, Artificial Sequence
  Description of Artificial Sequence: Synthetic oligonucleotide
guggcgcggccaccgcuc

SEQ ID NO: 38780 - RNA, 18 nt, Artificial Sequence
  Description of Artificial Sequence: Synthetic oligonucleotide
accggguggcgcggccac

SEQ ID NO: 38781 - RNA, 18 nt, Artificial Sequence
  Description of Artificial Sequence: Synthetic oligonucleotide
gggaggaagguggccggg

SEQ ID NO: 38782 - RNA, 18 nt, Artificial Sequence
  Description of Artificial Sequence: Synthetic oligonucleotide
cgggaggaagguggccgg

SEQ ID NO: 38783 - RNA, 18 nt, Artificial Sequence
  Description of Artificial Sequence: Synthetic oligonucleotide
cgucucgggaggaaggug

SEQ ID NO: 38784 - RNA, 18 nt, Artificial Sequence
  Description of Artificial Sequence: Synthetic oligonucleotide
ugucccgucucgggagga

SEQ ID NO: 38785 - RNA, 18 nt, Artificial Sequence
  Description of Artificial Sequence: Synthetic oligonucleotide
ucgccugucccgucucgg

SEQ ID NO: 38786 - RNA, 18 nt, Artificial Sequence
  Description of Artificial Sequence: Synthetic oligonucleotide
accgcucgccugucccgu

SEQ ID NO: 38787 - RNA, 18 nt, Artificial Sequence
  Description of Artificial Sequence: Synthetic oligonucleotide
cggccaccgcucgccugu

SEQ ID NO: 38788 - RNA, 18 nt, Artificial Sequence
  Description of Artificial Sequence: Synthetic oligonucleotide
uggcgcggccaccgcucg

SEQ ID NO: 38789 - RNA, 18 nt, Artificial Sequence
  Description of Artificial Sequence: Synthetic oligonucleotide
ccggguggcgcggccacc

SEQ ID NO: 38790 - RNA, 18 nt, Artificial Sequence
  Description of Artificial Sequence: Synthetic oligonucleotide
ugggaccggguggcgcgg

SEQ ID NO: 38791 - RNA, 18 nt, Artificial Sequence
  Description of Artificial Sequence: Synthetic oligonucleotide
gcagcugggaccgggugg

SEQ ID NO: 38792 - RNA, 18 nt, Artificial Sequence
  Description of Artificial Sequence: Synthetic oligonucleotide
ucugaugcugcgcgauga

SEQ ID NO: 38793 - RNA, 18 nt, Artificial Sequence
  Description of Artificial Sequence: Synthetic oligonucleotide
cagguucugaugcugcgc

SEQ ID NO: 38794 - RNA, 18 nt, Artificial Sequence
  Description of Artificial Sequence: Synthetic oligonucleotide
aguagcagguucugaugc

SEQ ID NO: 38795 - RNA, 18 nt, Artificial Sequence
  Description of Artificial Sequence: Synthetic oligonucleotide
uggccaguagcagguucu

SEQ ID NO: 38796 - RNA, 18 nt, Artificial Sequence
  Description of Artificial Sequence: Synthetic oligonucleotide
gguguuggccaguagcag

SEQ ID NO: 38797 - RNA, 18 nt, Artificial Sequence
  Description of Artificial Sequence: Synthetic oligonucleotide
gaggugguguuggccagu

SEQ ID NO: 38798 - RNA, 18 nt, Artificial Sequence
  Description of Artificial Sequence: Synthetic oligonucleotide
aggcggaggugguguugg

SEQ ID NO: 38799 - RNA, 18 nt, Artificial Sequence
  Description of Artificial Sequence: Synthetic oligonucleotide
gggaaggcggagguggug

SEQ ID NO: 38800 - RNA, 18 nt, Artificial Sequence
  Description of Artificial Sequence: Synthetic oligonucleotide
gcucaggagcgcguaggg

SEQ ID NO: 38801 - RNA, 18 nt, Artificial Sequence
  Description of Artificial Sequence: Synthetic oligonucleotide
ucguugcucaggagcgcg

SEQ ID NO: 38802 - RNA, 18 nt, Artificial Sequence
  Description of Artificial Sequence: Synthetic oligonucleotide
cauugucguugcucagga

SEQ ID NO: 38803 - RNA, 18 nt, Artificial Sequence
  Description of Artificial Sequence: Synthetic oligonucleotide
gaaggcauugucguugcu

SEQ ID NO: 38804 - RNA, 18 nt, Artificial Sequence
  Description of Artificial Sequence: Synthetic oligonucleotide
cucaggaaggcauugucg

SEQ ID NO: 38805 - RNA, 18 nt, Artificial Sequence
  Description of Artificial Sequence: Synthetic oligonucleotide
gguagcucaggaaggcau

SEQ ID NO: 38806 - RNA, 18 nt, Artificial Sequence
  Description of Artificial Sequence: Synthetic oligonucleotide
cgggugguagcucaggaa

SEQ ID NO: 38807 - RNA, 18 nt, Artificial Sequence
  Description of Artificial Sequence: Synthetic oligonucleotide
gggugcgggugguagcuc

SEQ ID NO: 38808 - RNA, 18 nt, Artificial Sequence
  Description of Artificial Sequence: Synthetic oligonucleotide
ugagcgugcgcugcgcga

SEQ ID NO: 38809 - RNA, 18 nt, Artificial Sequence
  Description of Artificial Sequence: Synthetic oligonucleotide
cgcggugagcgugcgcug

SEQ ID NO: 38810 - RNA, 18 nt, Artificial Sequence
  Description of Artificial Sequence: Synthetic oligonucleotide
aagcgcgcggugagcgug

SEQ ID NO: 38811 - RNA, 18 nt, Artificial Sequence
  Description of Artificial Sequence: Synthetic oligonucleotide
ccuggaagcgcgcgguga

SEQ ID NO: 38812 - RNA, 18 nt, Artificial Sequence
  Description of Artificial Sequence: Synthetic oligonucleotide
guugaccuggaagcgcgc

SEQ ID NO: 38813 - RNA, 18 nt, Artificial Sequence
  Description of Artificial Sequence: Synthetic oligonucleotide
guguuguugaccuggaag

SEQ ID NO: 38814 - RNA, 18 nt, Artificial Sequence
  Description of Artificial Sequence: Synthetic oligonucleotide
ggcggguguuguugaccu

SEQ ID NO: 38815 - RNA, 18 nt, Artificial Sequence
  Description of Artificial Sequence: Synthetic oligonucleotide
cggcgggcggguguuguu

SEQ ID NO: 38816 - RNA, 18 nt, Artificial Sequence
  Description of Artificial Sequence: Synthetic oligonucleotide
acgugcggcgggcgggug

SEQ ID NO: 38817 - RNA, 18 nt, Artificial Sequence
  Description of Artificial Sequence: Synthetic oligonucleotide
gcugcacgugcggcgggc

SEQ ID NO: 38818 - RNA, 18 nt, Artificial Sequence
  Description of Artificial Sequence: Synthetic oligonucleotide
caacagcugcacgugcgg

SEQ ID NO: 38819 - RNA, 18 nt, Artificial Sequence
  Description of Artificial Sequence: Synthetic oligonucleotide
uugcgcaacagcugcacg

SEQ ID NO: 38820 - RNA, 18 nt, Artificial Sequence
  Description of Artificial Sequence: Synthetic oligonucleotide
ccggcuugcgcaacagcu

SEQ ID NO: 38821 - RNA, 18 nt, Artificial Sequence
  Description of Artificial Sequence: Synthetic oligonucleotide
gagcaccggcuugcgcaa

SEQ ID NO: 38822 - RNA, 18 nt, Artificial Sequence
  Description of Artificial Sequence: Synthetic oligonucleotide
gccgugagcaccggcuug

SEQ ID NO: 38823 - RNA, 18 nt, Artificial Sequence
  Description of Artificial Sequence: Synthetic oligonucleotide
ccauggccgugagcaccg

SEQ ID NO: 38824 - RNA, 18 nt, Artificial Sequence
  Description of Artificial Sequence: Synthetic oligonucleotide
cagccccauggccgugag

SEQ ID NO: 38825 - RNA, 18 nt, Artificial Sequence
  Description of Artificial Sequence: Synthetic oligonucleotide
gccagcagccccauggcc

SEQ ID NO: 38826 - RNA, 18 nt, Artificial Sequence
  Description of Artificial Sequence: Synthetic oligonucleotide
gcagcgccagcagcccca

SEQ ID NO: 38827 - RNA, 18 nt, Artificial Sequence
  Description of Artificial Sequence: Synthetic oligonucleotide
ccccguccaguggacccc

SEQ ID NO: 38828 - RNA, 18 nt, Artificial Sequence
  Description of Artificial Sequence: Synthetic oligonucleotide
ucaggccccguccagugg

SEQ ID NO: 38829 - RNA, 18 nt, Artificial Sequence
  Description of Artificial Sequence: Synthetic oligonucleotide
guagcucaggccccgucc

SEQ ID NO: 38830 - RNA, 18 nt, Artificial Sequence
  Description of Artificial Sequence: Synthetic oligonucleotide
aaguuguagcucaggccc

SEQ ID NO: 38831 - RNA, 18 nt, Artificial Sequence
  Description of Artificial Sequence: Synthetic oligonucleotide
gggugaaguuguagcuca

SEQ ID NO: 38832 - RNA, 18 nt, Artificial Sequence
  Description of Artificial Sequence: Synthetic oligonucleotide
caggugggugaaguugua

SEQ ID NO: 38833 - RNA, 18 nt, Artificial Sequence
  Description of Artificial Sequence: Synthetic oligonucleotide
ccguccaggugggugaag

SEQ ID NO: 38834 - RNA, 18 nt, Artificial Sequence
  Description of Artificial Sequence: Synthetic oligonucleotide
gguacccguccagguggg

SEQ ID NO: 38835 - RNA, 18 nt, Artificial Sequence
  Description of Artificial Sequence: Synthetic oligonucleotide
guccagguacccguccag

SEQ ID NO: 38836 - RNA, 18 nt, Artificial Sequence
  Description of Artificial Sequence: Synthetic oligonucleotide
agaagguccagguacccg

SEQ ID NO: 38837 - RNA, 18 nt, Artificial Sequence
  Description of Artificial Sequence: Synthetic oligonucleotide
cccugagaagguccaggu

SEQ ID NO: 38838 - RNA, 18 nt, Artificial Sequence
  Description of Artificial Sequence: Synthetic oligonucleotide
guucucccugagaagguc

SEQ ID NO: 38839 - RNA, 18 nt, Artificial Sequence
  Description of Artificial Sequence: Synthetic oligonucleotide
agcugguucucccugaga

SEQ ID NO: 38840 - RNA, 18 nt, Artificial Sequence
  Description of Artificial Sequence: Synthetic oligonucleotide
ggaggagcugguucuccc

SEQ ID NO: 38841 - RNA, 18 nt, Artificial Sequence
  Description of Artificial Sequence: Synthetic oligonucleotide
ggagggcagagcccacag

SEQ ID NO: 38842 - RNA, 18 nt, Artificial Sequence
  Description of Artificial Sequence: Synthetic oligonucleotide
ggcugggagggcagagcc

SEQ ID NO: 38843 - RNA, 18 nt, Artificial Sequence
  Description of Artificial Sequence: Synthetic oligonucleotide
aggcgggcugggagggca

SEQ ID NO: 38844 - RNA, 18 nt, Artificial Sequence
  Description of Artificial Sequence: Synthetic oligonucleotide
ggugcaggcgggcuggga

SEQ ID NO: 38845 - RNA, 18 nt, Artificial Sequence
  Description of Artificial Sequence: Synthetic oligonucleotide
gggugcaggcgggcuggg

SEQ ID NO: 38846 - RNA, 18 nt, Artificial Sequence
  Description of Artificial Sequence: Synthetic oligonucleotide
gggugggcagggcaaggg

SEQ ID NO: 38847 - RNA, 18 nt, Artificial Sequence
  Description of Artificial Sequence: Synthetic oligonucleotide
ggagagggugggcagggc

SEQ ID NO: 38848 - RNA, 18 nt, Artificial Sequence
  Description of Artificial Sequence: Synthetic oligonucleotide
gugagggagagggugggc

SEQ ID NO: 38849 - RNA, 18 nt, Artificial Sequence
  Description of Artificial Sequence: Synthetic oligonucleotide
gcugggugagggagaggg

SEQ ID NO: 38850 - RNA, 18 nt, Artificial Sequence
  Description of Artificial Sequence: Synthetic oligonucleotide
gggcugggugagggagag

SEQ ID NO: 38851 - RNA, 18 nt, Artificial Sequence
  Description of Artificial Sequence: Synthetic oligonucleotide
auccaaggacucagaggg

SEQ ID NO: 38852 - RNA, 18 nt, Artificial Sequence
  Description of Artificial Sequence: Synthetic oligonucleotide
uggacauccaaggacuca

SEQ ID NO: 38853 - RNA, 18 nt, Artificial Sequence
  Description of Artificial Sequence: Synthetic oligonucleotide
cugaauggacauccaagg

SEQ ID NO: 38854 - RNA, 18 nt, Artificial Sequence
  Description of Artificial Sequence: Synthetic oligonucleotide
cagcccugaauggacauc

SEQ ID NO: 38855 - RNA, 18 nt, Artificial Sequence
  Description of Artificial Sequence: Synthetic oligonucleotide
aaggccagcccugaaugg

SEQ ID NO: 38856 - RNA, 18 nt, Artificial Sequence
  Description of Artificial Sequence: Synthetic oligonucleotide
gcaccaaggccagcccug

SEQ ID NO: 38857 - RNA, 18 nt, Artificial Sequence
  Description of Artificial Sequence: Synthetic oligonucleotide
cuccggcaccaaggccag

SEQ ID NO: 38858 - RNA, 18 nt, Artificial Sequence
  Description of Artificial Sequence: Synthetic oligonucleotide
auccaaggacucagaggg

SEQ ID NO: 38859 - RNA, 18 nt, Artificial Sequence
  Description of Artificial Sequence: Synthetic oligonucleotide
uggacauccaaggacuca

SEQ ID NO: 38860 - RNA, 18 nt, Artificial Sequence
  Description of Artificial Sequence: Synthetic oligonucleotide
cugaauggacauccaagg

SEQ ID NO: 38861 - RNA, 18 nt, Artificial Sequence
  Description of Artificial Sequence: Synthetic oligonucleotide
cagcccugaauggacauc

SEQ ID NO: 38862 - RNA, 18 nt, Artificial Sequence
  Description of Artificial Sequence: Synthetic oligonucleotide
aaggccagcccugaaugg

SEQ ID NO: 38863 - RNA, 18 nt, Artificial Sequence
  Description of Artificial Sequence: Synthetic oligonucleotide
gcaccaaggccagcccug

SEQ ID NO: 38864 - RNA, 18 nt, Artificial Sequence
  Description of Artificial Sequence: Synthetic oligonucleotide
cuccggcaccaaggccag

SEQ ID NO: 38865 - RNA, 18 nt, Artificial Sequence
  Description of Artificial Sequence: Synthetic oligonucleotide
cugugcuccggcaccaag

SEQ ID NO: 38866 - RNA, 18 nt, Artificial Sequence
  Description of Artificial Sequence: Synthetic oligonucleotide
caggccugugcuccggca

SEQ ID NO: 38867 - RNA, 18 nt, Artificial Sequence
  Description of Artificial Sequence: Synthetic oligonucleotide
ucugccaggccugugcuc

SEQ ID NO: 38868 - RNA, 18 nt, Artificial Sequence
  Description of Artificial Sequence: Synthetic oligonucleotide
caugcucugccaggccug

SEQ ID NO: 38869 - RNA, 18 nt, Artificial Sequence
  Description of Artificial Sequence: Synthetic oligonucleotide
acacccaugcucugccag

SEQ ID NO: 38870 - RNA, 18 nt, Artificial Sequence
  Description of Artificial Sequence: Synthetic oligonucleotide
acaccacacccaugcucu

SEQ ID NO: 38871 - RNA, 18 nt, Artificial Sequence
  Description of Artificial Sequence: Synthetic oligonucleotide
accacacaccacacccau

SEQ ID NO: 38872 - RNA, 18 nt, Artificial Sequence
  Description of Artificial Sequence: Synthetic oligonucleotide
cgcccaccacacaccaca

SEQ ID NO: 38873 - RNA, 18 nt, Artificial Sequence
  Description of Artificial Sequence: Synthetic oligonucleotide
cccaccgcccaccacaca

SEQ ID NO: 38874 - RNA, 18 nt, Artificial Sequence
  Description of Artificial Sequence: Synthetic oligonucleotide
gcugccccaccgcccacc

SEQ ID NO: 38875 - RNA, 18 nt, Artificial Sequence
  Description of Artificial Sequence: Synthetic oligonucleotide
cugcccaucagcucaaac

SEQ ID NO: 38876 - RNA, 18 nt, Artificial Sequence
  Description of Artificial Sequence: Synthetic oligonucleotide
aggcgcugcccaucagcu

SEQ ID NO: 38877 - RNA, 18 nt, Artificial Sequence
  Description of Artificial Sequence: Synthetic oligonucleotide
gcccgaggcgcugcccau

SEQ ID NO: 38878 - RNA, 18 nt, Artificial Sequence
  Description of Artificial Sequence: Synthetic oligonucleotide
aaguggcccgaggcgcug

SEQ ID NO: 38879 - RNA, 18 nt, Artificial Sequence
  Description of Artificial Sequence: Synthetic oligonucleotide
cagugaaguggcccgagg

SEQ ID NO: 38880 - RNA, 18 nt, Artificial Sequence
  Description of Artificial Sequence: Synthetic oligonucleotide
aaagucagugaaguggcc

SEQ ID NO: 38881 - RNA, 18 nt, Artificial Sequence
  Description of Artificial Sequence: Synthetic oligonucleotide
uccucaaagucagugaag

SEQ ID NO: 38882 - RNA, 18 nt, Artificial Sequence
  Description of Artificial Sequence: Synthetic oligonucleotide
gcuuguccucaaagucag

SEQ ID NO: 38883 - RNA, 18 nt, Artificial Sequence
  Description of Artificial Sequence: Synthetic oligonucleotide
cugcugcuuguccucaaa

SEQ ID NO: 38884 - RNA, 18 nt, Artificial Sequence
  Description of Artificial Sequence: Synthetic oligonucleotide
aacaccugcugcuugucc

SEQ ID NO: 38885 - RNA, 18 nt, Artificial Sequence
  Description of Artificial Sequence: Synthetic oligonucleotide
acucaaacaccugcugcu

SEQ ID NO: 38886 - RNA, 18 nt, Artificial Sequence
  Description of Artificial Sequence: Synthetic oligonucleotide
cuuccacucaaacaccug

SEQ ID NO: 38887 - RNA, 18 nt, Artificial Sequence
  Description of Artificial Sequence: Synthetic oligonucleotide
aaguccuuccacucaaac

SEQ ID NO: 38888 - RNA, 18 nt, Artificial Sequence
  Description of Artificial Sequence: Synthetic oligonucleotide
agaccaaguccuuccacu

SEQ ID NO: 38889 - RNA, 18 nt, Artificial Sequence
  Description of Artificial Sequence: Synthetic oligonucleotide
gcuggagaccaaguccuu

SEQ ID NO: 38890 - RNA, 18 nt, Artificial Sequence
  Description of Artificial Sequence: Synthetic oligonucleotide
gccaggcuggagaccaag

SEQ ID NO: 38891 - RNA, 18 nt, Artificial Sequence
  Description of Artificial Sequence: Synthetic oligonucleotide
uccuggccaggcuggaga

SEQ ID NO: 38892 - RNA, 18 nt, Artificial Sequence
  Description of Artificial Sequence: Synthetic oligonucleotide
guaucuccuggccaggcu

SEQ ID NO: 38893 - RNA, 18 nt, Artificial Sequence
  Description of Artificial Sequence: Synthetic oligonucleotide
gcugcccaucagcucaaa

SEQ ID NO: 38894 - RNA, 18 nt, Artificial Sequence
  Description of Artificial Sequence: Synthetic oligonucleotide
gaggcgcugcccaucagc

SEQ ID NO: 38895 - RNA, 18 nt, Artificial Sequence
  Description of Artificial Sequence: Synthetic oligonucleotide
ggcccgaggcgcugccca

SEQ ID NO: 38896 - RNA, 18 nt, Artificial Sequence
  Description of Artificial Sequence: Synthetic oligonucleotide
gaaguggcccgaggcgcu

SEQ ID NO: 38897 - RNA, 18 nt, Artificial Sequence
  Description of Artificial Sequence: Synthetic oligonucleotide
ucagugaaguggcccgag

SEQ ID NO: 38898 - RNA, 18 nt, Artificial Sequence
  Description of Artificial Sequence: Synthetic oligonucleotide
caaagucagugaaguggc

SEQ ID NO: 38899 - RNA, 18 nt, Artificial Sequence
  Description of Artificial Sequence: Synthetic oligonucleotide
guccucaaagucagugaa

SEQ ID NO: 38900 - RNA, 18 nt, Artificial Sequence
  Description of Artificial Sequence: Synthetic oligonucleotide
ugcuuguccucaaaguca

SEQ ID NO: 38901 - RNA, 18 nt, Artificial Sequence
  Description of Artificial Sequence: Synthetic oligonucleotide
ccugcugcuuguccucaa

SEQ ID NO: 38902 - RNA, 18 nt, Artificial Sequence
  Description of Artificial Sequence: Synthetic oligonucleotide
aaacaccugcugcuuguc

SEQ ID NO: 38903 - RNA, 18 nt, Artificial Sequence
  Description of Artificial Sequence: Synthetic oligonucleotide
cacucaaacaccugcugc

SEQ ID NO: 38904 - RNA, 18 nt, Artificial Sequence
  Description of Artificial Sequence: Synthetic oligonucleotide
ccuuccacucaaacaccu

SEQ ID NO: 38905 - RNA, 18 nt, Artificial Sequence
  Description of Artificial Sequence: Synthetic oligonucleotide
caaguccuuccacucaaa

SEQ ID NO: 38906 - RNA, 18 nt, Artificial Sequence
  Description of Artificial Sequence: Synthetic oligonucleotide
gagaccaaguccuuccac

SEQ ID NO: 38907 - RNA, 18 nt, Artificial Sequence
  Description of Artificial Sequence: Synthetic oligonucleotide
ggcuggagaccaaguccu

SEQ ID NO: 38908 - RNA, 18 nt, Artificial Sequence
  Description of Artificial Sequence: Synthetic oligonucleotide
ggccaggcuggagaccaa

SEQ ID NO: 38909 - RNA, 18 nt, Artificial Sequence
  Description of Artificial Sequence: Synthetic oligonucleotide
cuccuggccaggcuggag

SEQ ID NO: 38910 - RNA, 18 nt, Artificial Sequence
  Description of Artificial Sequence: Synthetic oligonucleotide
uguaucuccuggccaggc

SEQ ID NO: 38911 - RNA, 18 nt, Artificial Sequence
  Description of Artificial Sequence: Synthetic oligonucleotide
ccccagggccugcgcucg

SEQ ID NO: 38912 - RNA, 18 nt, Artificial Sequence
  Description of Artificial Sequence: Synthetic oligonucleotide
cagggccccagggccugc

SEQ ID NO: 38913 - RNA, 18 nt, Artificial Sequence
  Description of Artificial Sequence: Synthetic oligonucleotide
ccggccagggccccaggg

SEQ ID NO: 38914 - RNA, 18 nt, Artificial Sequence
  Description of Artificial Sequence: Synthetic oligonucleotide
ccgccccggccagggccc

SEQ ID NO: 38915 - RNA, 18 nt, Artificial Sequence
  Description of Artificial Sequence: Synthetic oligonucleotide
uacccccgccccggccag

SEQ ID NO: 38916 - RNA, 18 nt, Artificial Sequence
  Description of Artificial Sequence: Synthetic oligonucleotide
aggaguacccccgccccg

SEQ ID NO: 38917 - RNA, 18 nt, Artificial Sequence
  Description of Artificial Sequence: Synthetic oligonucleotide
ugcccaggaguacccccg

SEQ ID NO: 38918 - RNA, 18 nt, Artificial Sequence
  Description of Artificial Sequence: Synthetic oligonucleotide
caaccugcccaggaguac

SEQ ID NO: 38919 - RNA, 18 nt, Artificial Sequence
  Description of Artificial Sequence: Synthetic oligonucleotide
gggugcaaccugcccagg

SEQ ID NO: 38920 - RNA, 18 nt, Artificial Sequence
  Description of Artificial Sequence: Synthetic oligonucleotide
ggcagcagccugcgugau

SEQ ID NO: 38921 - RNA, 18 nt, Artificial Sequence
  Description of Artificial Sequence: Synthetic oligonucleotide
gaccaggcagcagccugc

SEQ ID NO: 38922 - RNA, 18 nt, Artificial Sequence
  Description of Artificial Sequence: Synthetic oligonucleotide
cuccugaccaggcagcag

SEQ ID NO: 38923 - RNA, 18 nt, Artificial Sequence
  Description of Artificial Sequence: Synthetic oligonucleotide
uguaucuccugaccaggc

SEQ ID NO: 38924 - RNA, 18 nt, Artificial Sequence
  Description of Artificial Sequence: Synthetic oligonucleotide
accaauguaucuccugac

SEQ ID NO: 38925 - RNA, 18 nt, Artificial Sequence
  Description of Artificial Sequence: Synthetic oligonucleotide
ugcccaccaauguaucuc

SEQ ID NO: 38926 - RNA, 18 nt, Artificial Sequence
  Description of Artificial Sequence: Synthetic oligonucleotide
gcgccugcccaccaaugu

SEQ ID NO: 38927 - RNA, 18 nt, Artificial Sequence
  Description of Artificial Sequence: Synthetic oligonucleotide
ggccugcgccugcccacc

SEQ ID NO: 38928 - RNA, 18 nt, Artificial Sequence
  Description of Artificial Sequence: Synthetic oligonucleotide
acaagggccugcgccugc

SEQ ID NO: 38929 - RNA, 18 nt, Artificial Sequence
  Description of Artificial Sequence: Synthetic oligonucleotide
cccccacaagggccugcg

SEQ ID NO: 38930 - RNA, 18 nt, Artificial Sequence
  Description of Artificial Sequence: Synthetic oligonucleotide
ccauccccccacaagggc

SEQ ID NO: 38931 - RNA, 18 nt, Artificial Sequence
  Description of Artificial Sequence: Synthetic oligonucleotide
cacccccauccccccaca

SEQ ID NO: 38932 - RNA, 18 nt, Artificial Sequence
  Description of Artificial Sequence: Synthetic oligonucleotide
cuugucacccccaucccc

SEQ ID NO: 38933 - RNA, 18 nt, Artificial Sequence
  Description of Artificial Sequence: Synthetic oligonucleotide
uaucccuugucaccccca

SEQ ID NO: 38934 - RNA, 18 nt, Artificial Sequence
  Description of Artificial Sequence: Synthetic oligonucleotide
caaccuaucccuugucac

SEQ ID NO: 38935 - RNA, 18 nt, Artificial Sequence
  Description of Artificial Sequence: Synthetic oligonucleotide
accaccaaccuaucccuu

SEQ ID NO: 38936 - RNA, 18 nt, Artificial Sequence
  Description of Artificial Sequence: Synthetic oligonucleotide
cgccgaccaccaaccuau

SEQ ID NO: 38937 - RNA, 18 nt, Artificial Sequence
  Description of Artificial Sequence: Synthetic oligonucleotide
gccugcgccgaccaccaa

SEQ ID NO: 38938 - RNA, 18 nt, Artificial Sequence
  Description of Artificial Sequence: Synthetic oligonucleotide
ccagggccugcgccgacc

SEQ ID NO: 38939 - RNA, 18 nt, Artificial Sequence
  Description of Artificial Sequence: Synthetic oligonucleotide
gggccccagggccugcgc

SEQ ID NO: 38940 - RNA, 18 nt, Artificial Sequence
  Description of Artificial Sequence: Synthetic oligonucleotide
caggaguaccccccagcc

SEQ ID NO: 38941 - RNA, 18 nt, Artificial Sequence
  Description of Artificial Sequence: Synthetic oligonucleotide
aagcccaggaguaccccc

SEQ ID NO: 38942 - RNA, 18 nt, Artificial Sequence
  Description of Artificial Sequence: Synthetic oligonucleotide
ccaccaagcccaggagua

SEQ ID NO: 38943 - RNA, 18 nt, Artificial Sequence
  Description of Artificial Sequence: Synthetic oligonucleotide
cccacccaccaagcccag

SEQ ID NO: 38944 - RNA, 18 nt, Artificial Sequence
  Description of Artificial Sequence: Synthetic oligonucleotide
cuucgcccacccaccaag

SEQ ID NO: 38945 - RNA, 18 nt, Artificial Sequence
  Description of Artificial Sequence: Synthetic oligonucleotide
agggccuucgcccaccca

SEQ ID NO: 38946 - RNA, 18 nt, Artificial Sequence
  Description of Artificial Sequence: Synthetic oligonucleotide
ggcccagggccuucgccc

SEQ ID NO: 38947 - RNA, 18 nt, Artificial Sequence
  Description of Artificial Sequence: Synthetic oligonucleotide
gggcccagggccuucgcc

SEQ ID NO: 38948 - RNA, 18 nt, Artificial Sequence
  Description of Artificial Sequence: Synthetic oligonucleotide
guaccccccaccccaggg

SEQ ID NO: 38949 - RNA, 18 nt, Artificial Sequence
  Description of Artificial Sequence: Synthetic oligonucleotide
caggaguaccccccaccc

SEQ ID NO: 38950 - RNA, 18 nt, Artificial Sequence
  Description of Artificial Sequence: Synthetic oligonucleotide
cugcccaggaguaccccc

SEQ ID NO: 38951 - RNA, 18 nt, Artificial Sequence
  Description of Artificial Sequence: Synthetic oligonucleotide
gcagccugcccaggagua

SEQ ID NO: 38952 - RNA, 18 nt, Artificial Sequence
  Description of Artificial Sequence: Synthetic oligonucleotide
gggugcagccugcccagg

SEQ ID NO: 38953 - RNA, 18 nt, Artificial Sequence
  Description of Artificial Sequence: Synthetic oligonucleotide
gggcccagggccuucgcc

SEQ ID NO: 38954 - RNA, 18 nt, Artificial Sequence
  Description of Artificial Sequence: Synthetic oligonucleotide
guaccccccaccccaggg

SEQ ID NO: 38955 - RNA, 18 nt, Artificial Sequence
  Description of Artificial Sequence: Synthetic oligonucleotide
aggaguaccccccacccc

SEQ ID NO: 38956 - RNA, 18 nt, Artificial Sequence
  Description of Artificial Sequence: Synthetic oligonucleotide
ugcccaggaguacccccc

SEQ ID NO: 38957 - RNA, 18 nt, Artificial Sequence
  Description of Artificial Sequence: Synthetic oligonucleotide
cagccugcccaggaguac

SEQ ID NO: 38958 - RNA, 18 nt, Artificial Sequence
  Description of Artificial Sequence: Synthetic oligonucleotide
gggugcagccugcccagg

SEQ ID NO: 38959 - RNA, 18 nt, Artificial Sequence
  Description of Artificial Sequence: Synthetic oligonucleotide
gcggccugggugauaggg

SEQ ID NO: 38960 - RNA, 18 nt, Artificial Sequence
  Description of Artificial Sequence: Synthetic oligonucleotide
gggugcggccugggugau

SEQ ID NO: 38961 - RNA, 18 nt, Artificial Sequence
  Description of Artificial Sequence: Synthetic oligonucleotide
gcggccugggugauaggg

SEQ ID NO: 38962 - RNA, 18 nt, Artificial Sequence
  Description of Artificial Sequence: Synthetic oligonucleotide
gcggcggccugggugaua

SEQ ID NO: 38963 - RNA, 18 nt, Artificial Sequence
  Description of Artificial Sequence: Synthetic oligonucleotide
ccugggcggcggccuggg

SEQ ID NO: 38964 - RNA, 18 nt, Artificial Sequence
  Description of Artificial Sequence: Synthetic oligonucleotide
caagaccugggcggcggc

SEQ ID NO: 38965 - RNA, 18 nt, Artificial Sequence
  Description of Artificial Sequence: Synthetic oligonucleotide
ggguccaagaccugggcg

SEQ ID NO: 38966 - RNA, 18 nt, Artificial Sequence
  Description of Artificial Sequence: Synthetic oligonucleotide
gaagcgcuggcucaaggg

SEQ ID NO: 38967 - RNA, 18 nt, Artificial Sequence
  Description of Artificial Sequence: Synthetic oligonucleotide
caggaagcgcuggcucaa

SEQ ID NO: 38968 - RNA, 18 nt, Artificial Sequence
  Description of Artificial Sequence: Synthetic oligonucleotide
cacaucaggaagcgcugg

SEQ ID NO: 38969 - RNA, 18 nt, Artificial Sequence
  Description of Artificial Sequence: Synthetic oligonucleotide
cgccccacaucaggaagc

SEQ ID NO: 38970 - RNA, 18 nt, Artificial Sequence
  Description of Artificial Sequence: Synthetic oligonucleotide
ccucccgccccacaucag

SEQ ID NO: 38971 - RNA, 18 nt, Artificial Sequence
  Description of Artificial Sequence: Synthetic oligonucleotide
gccagccucccgccccac

SEQ ID NO: 38972 - RNA, 18 nt, Artificial Sequence
  Description of Artificial Sequence: Synthetic oligonucleotide
ugcaggccagccucccgc

SEQ ID NO: 38973 - RNA, 18 nt, Artificial Sequence
  Description of Artificial Sequence: Synthetic oligonucleotide
cuccaugcaggccagccu

SEQ ID NO: 38974 - RNA, 18 nt, Artificial Sequence
  Description of Artificial Sequence: Synthetic oligonucleotide
cccaucuccaugcaggcc

SEQ ID NO: 38975 - RNA, 18 nt, Artificial Sequence
  Description of Artificial Sequence: Synthetic oligonucleotide
ugaaccccaucuccaugc

SEQ ID NO: 38976 - RNA, 18 nt, Artificial Sequence
  Description of Artificial Sequence: Synthetic oligonucleotide
caagaugaaccccaucuc

SEQ ID NO: 38977 - RNA, 18 nt, Artificial Sequence
  Description of Artificial Sequence: Synthetic oligonucleotide
ugacucaagaugaacccc

SEQ ID NO: 38978 - RNA, 18 nt, Artificial Sequence
  Description of Artificial Sequence: Synthetic oligonucleotide
gcgucugacucaagauga

SEQ ID NO: 38979 - RNA, 18 nt, Artificial Sequence
  Description of Artificial Sequence: Synthetic oligonucleotide
gaagggcgucugacucaa

SEQ ID NO: 38980 - RNA, 18 nt, Artificial Sequence
  Description of Artificial Sequence: Synthetic oligonucleotide
gugaugaagggcgucuga

SEQ ID NO: 38981 - RNA, 18 nt, Artificial Sequence
  Description of Artificial Sequence: Synthetic oligonucleotide
gcaaggugaugaagggcg

SEQ ID NO: 38982 - RNA, 18 nt, Artificial Sequence
  Description of Artificial Sequence: Synthetic oligonucleotide
agggugcaaggugaugaa

SEQ ID NO: 38983 - RNA, 18 nt, Artificial Sequence
  Description of Artificial Sequence: Synthetic oligonucleotide
gagggagggugcaaggug

SEQ ID NO: 38984 - RNA, 18 nt, Artificial Sequence
  Description of Artificial Sequence: Synthetic oligonucleotide
ccacggagggagggugca

SEQ ID NO: 38985 - RNA, 18 nt, Artificial Sequence
  Description of Artificial Sequence: Synthetic oligonucleotide
gacucccacggagggagg

SEQ ID NO: 38986 - RNA, 18 nt, Artificial Sequence
  Description of Artificial Sequence: Synthetic oligonucleotide
ucagugacucccacggag

SEQ ID NO: 38987 - RNA, 18 nt, Artificial Sequence
  Description of Artificial Sequence: Synthetic oligonucleotide
ucgccucagugacuccca

SEQ ID NO: 38988 - RNA, 18 nt, Artificial Sequence
  Description of Artificial Sequence: Synthetic oligonucleotide
gaaucucgccucagugac

SEQ ID NO: 38989 - RNA, 18 nt, Artificial Sequence
  Description of Artificial Sequence: Synthetic oligonucleotide
caggugaaucucgccuca

SEQ ID NO: 38990 - RNA, 18 nt, Artificial Sequence
  Description of Artificial Sequence: Synthetic oligonucleotide
cagcacaggugaaucucg

SEQ ID NO: 38991 - RNA, 18 nt, Artificial Sequence
  Description of Artificial Sequence: Synthetic oligonucleotide
ccccccagcacaggugaa

SEQ ID NO: 38992 - RNA, 18 nt, Artificial Sequence
  Description of Artificial Sequence: Synthetic oligonucleotide
gcuguccccccagcacag

SEQ ID NO: 38993 - RNA, 18 nt, Artificial Sequence
  Description of Artificial Sequence: Synthetic oligonucleotide
ugcgccaguccguaccua

SEQ ID NO: 38994 - RNA, 18 nt, Artificial Sequence
  Description of Artificial Sequence: Synthetic oligonucleotide
aaacaugcgccaguccgu

SEQ ID NO: 38995 - RNA, 18 nt, Artificial Sequence
  Description of Artificial Sequence: Synthetic oligonucleotide
cuuggaaacaugcgccag

SEQ ID NO: 38996 - RNA, 18 nt, Artificial Sequence
  Description of Artificial Sequence: Synthetic oligonucleotide
uuccacuuggaaacaugc

SEQ ID NO: 38997 - RNA, 18 nt, Artificial Sequence
  Description of Artificial Sequence: Synthetic oligonucleotide
cgaaguuccacuuggaaa

SEQ ID NO: 38998 - RNA, 18 nt, Artificial Sequence
  Description of Artificial Sequence: Synthetic oligonucleotide
cgucucgaaguuccacuu

SEQ ID NO: 38999 - RNA, 18 nt, Artificial Sequence
  Description of Artificial Sequence: Synthetic oligonucleotide
uuccacgucucgaaguuc

SEQ ID NO: 39000 - RNA, 18 nt, Artificial Sequence
  Description of Artificial Sequence: Synthetic oligonucleotide
gcucauuccacgucucga

SEQ ID NO: 39001 - RNA, 18 nt, Artificial Sequence
  Description of Artificial Sequence: Synthetic oligonucleotide
gucuggcucauuccacgu

SEQ ID NO: 39002 - RNA, 18 nt, Artificial Sequence
  Description of Artificial Sequence: Synthetic oligonucleotide
ugguggucuggcucauuc

SEQ ID NO: 39003 - RNA, 18 nt, Artificial Sequence
  Description of Artificial Sequence: Synthetic oligonucleotide
agucgugguggucuggcu

SEQ ID NO: 39004 - RNA, 18 nt, Artificial Sequence
  Description of Artificial Sequence: Synthetic oligonucleotide
gucaaagucguggugguc

SEQ ID NO: 39005 - RNA, 18 nt, Artificial Sequence
  Description of Artificial Sequence: Synthetic oligonucleotide
acguugucaaagucgugg

SEQ ID NO: 39006 - RNA, 18 nt, Artificial Sequence
  Description of Artificial Sequence: Synthetic oligonucleotide
uggagacguugucaaagu

SEQ ID NO: 39007 - RNA, 18 nt, Artificial Sequence
  Description of Artificial Sequence: Synthetic oligonucleotide
ggucauggagacguuguc

SEQ ID NO: 39008 - RNA, 18 nt, Artificial Sequence
  Description of Artificial Sequence: Synthetic oligonucleotide
ugcauggucauggagacg

SEQ ID NO: 39009 - RNA, 18 nt, Artificial Sequence
  Description of Artificial Sequence: Synthetic oligonucleotide
gcgccaguccguaccuac

SEQ ID NO: 39010 - RNA, 18 nt, Artificial Sequence
  Description of Artificial Sequence: Synthetic oligonucleotide
aacaugcgccaguccgua

SEQ ID NO: 39011 - RNA, 18 nt, Artificial Sequence
  Description of Artificial Sequence: Synthetic oligonucleotide
uuggaaacaugcgccagu

SEQ ID NO: 39012 - RNA, 18 nt, Artificial Sequence
  Description of Artificial Sequence: Synthetic oligonucleotide
uccacuuggaaacaugcg

SEQ ID NO: 39013 - RNA, 18 nt, Artificial Sequence
  Description of Artificial Sequence: Synthetic oligonucleotide
gaaguuccacuuggaaac

SEQ ID NO: 39014 - RNA, 18 nt, Artificial Sequence
  Description of Artificial Sequence: Synthetic oligonucleotide
gucucgaaguuccacuug

SEQ ID NO: 39015 - RNA, 18 nt, Artificial Sequence
  Description of Artificial Sequence: Synthetic oligonucleotide
uccacgucucgaaguucc

SEQ ID NO: 39016 - RNA, 18 nt, Artificial Sequence
  Description of Artificial Sequence: Synthetic oligonucleotide
cucauuccacgucucgaa

SEQ ID NO: 39017 - RNA, 18 nt, Artificial Sequence
  Description of Artificial Sequence: Synthetic oligonucleotide
ucuggcucauuccacguc

SEQ ID NO: 39018 - RNA, 18 nt, Artificial Sequence
  Description of Artificial Sequence: Synthetic oligonucleotide
gguggucuggcucauucc

SEQ ID NO: 39019 - RNA, 18 nt, Artificial Sequence
  Description of Artificial Sequence: Synthetic oligonucleotide
gucgugguggucuggcuc

SEQ ID NO: 39020 - RNA, 18 nt, Artificial Sequence
  Description of Artificial Sequence: Synthetic oligonucleotide
ucaaagucgugguggucu

SEQ ID NO: 39021 - RNA, 18 nt, Artificial Sequence
  Description of Artificial Sequence: Synthetic oligonucleotide
cguugucaaagucguggu

SEQ ID NO: 39022 - RNA, 18 nt, Artificial Sequence
  Description of Artificial Sequence: Synthetic oligonucleotide
ggagacguugucaaaguc

SEQ ID NO: 39023 - RNA, 18 nt, Artificial Sequence
  Description of Artificial Sequence: Synthetic oligonucleotide
gucauggagacguuguca

SEQ ID NO: 39024 - RNA, 18 nt, Artificial Sequence
  Description of Artificial Sequence: Synthetic oligonucleotide
gcauggucauggagacgu

SEQ ID NO: 39025 - RNA, 18 nt, Artificial Sequence
  Description of Artificial Sequence: Synthetic oligonucleotide
ggaccccaggaagcggug

SEQ ID NO: 39026 - RNA, 18 nt, Artificial Sequence
  Description of Artificial Sequence: Synthetic oligonucleotide
gggcaggaccccaggaag

SEQ ID NO: 39027 - RNA, 18 nt, Artificial Sequence
  Description of Artificial Sequence: Synthetic oligonucleotide
cagccgggcaggacccca

SEQ ID NO: 39028 - RNA, 18 nt, Artificial Sequence
  Description of Artificial Sequence: Synthetic oligonucleotide
ccuuucagccgggcagga

SEQ ID NO: 39029 - RNA, 18 nt, Artificial Sequence
  Description of Artificial Sequence: Synthetic oligonucleotide
ugcccccuuucagccggg

SEQ ID NO: 39030 - RNA, 18 nt, Artificial Sequence
  Description of Artificial Sequence: Synthetic oligonucleotide
uccucugcccccuuucag

SEQ ID NO: 39031 - RNA, 18 nt, Artificial Sequence
  Description of Artificial Sequence: Synthetic oligonucleotide
ugccuuccucugcccccu

SEQ ID NO: 39032 - RNA, 18 nt, Artificial Sequence
  Description of Artificial Sequence: Synthetic oligonucleotide
gcuccugccuuccucugc

SEQ ID NO: 39033 - RNA, 18 nt, Artificial Sequence
  Description of Artificial Sequence: Synthetic oligonucleotide
ccucugcuccugccuucc

SEQ ID NO: 39034 - RNA, 18 nt, Artificial Sequence
  Description of Artificial Sequence: Synthetic oligonucleotide
cuuagccucugcuccugc

SEQ ID NO: 39035 - RNA, 18 nt, Artificial Sequence
  Description of Artificial Sequence: Synthetic oligonucleotide
agcggcuuagccucugcu

SEQ ID NO: 39036 - RNA, 18 nt, Artificial Sequence
  Description of Artificial Sequence: Synthetic oligonucleotide
ggaugagcggcuuagccu

SEQ ID NO: 39037 - RNA, 18 nt, Artificial Sequence
  Description of Artificial Sequence: Synthetic oligonucleotide
gggaugagcggcuuagcc

SEQ ID NO: 39038 - RNA, 18 nt, Artificial Sequence
  Description of Artificial Sequence: Synthetic oligonucleotide
ucugcccccuuucagccg

SEQ ID NO: 39039 - RNA, 18 nt, Artificial Sequence
  Description of Artificial Sequence: Synthetic oligonucleotide
cuuccucugcccccuuuc

SEQ ID NO: 39040 - RNA, 18 nt, Artificial Sequence
  Description of Artificial Sequence: Synthetic oligonucleotide
ccugccuuccucugcccc

SEQ ID NO: 39041 - RNA, 18 nt, Artificial Sequence
  Description of Artificial Sequence: Synthetic oligonucleotide
cugcuccugccuuccucu

SEQ ID NO: 39042 - RNA, 18 nt, Artificial Sequence
  Description of Artificial Sequence: Synthetic oligonucleotide
agccucugcuccugccuu

SEQ ID NO: 39043 - RNA, 18 nt, Artificial Sequence
  Description of Artificial Sequence: Synthetic oligonucleotide
ggcuuagccucugcuccu

SEQ ID NO: 39044 - RNA, 18 nt, Artificial Sequence
  Description of Artificial Sequence: Synthetic oligonucleotide
ugagcggcuuagccucug

SEQ ID NO: 39045 - RNA, 18 nt, Artificial Sequence
  Description of Artificial Sequence: Synthetic oligonucleotide
gucuacaccugcccuggg

SEQ ID NO: 39046 - RNA, 18 nt, Artificial Sequence
  Description of Artificial Sequence: Synthetic oligonucleotide
acugcgucuacaccugcc

SEQ ID NO: 39047 - RNA, 18 nt, Artificial Sequence
  Description of Artificial Sequence: Synthetic oligonucleotide
ucguaguaguucaggaag

SEQ ID NO: 39048 - RNA, 18 nt, Artificial Sequence
  Description of Artificial Sequence: Synthetic oligonucleotide
aggcaucguaguaguuca

SEQ ID NO: 39049 - RNA, 18 nt, Artificial Sequence
  Description of Artificial Sequence: Synthetic oligonucleotide
cgagcaggcaucguagua

SEQ ID NO: 39050 - RNA, 18 nt, Artificial Sequence
  Description of Artificial Sequence: Synthetic oligonucleotide
cccuccgagcaggcaucg

SEQ ID NO: 39051 - RNA, 18 nt, Artificial Sequence
  Description of Artificial Sequence: Synthetic oligonucleotide
gcagacccuccgagcagg

SEQ ID NO: 39052 - RNA, 18 nt, Artificial Sequence
  Description of Artificial Sequence: Synthetic oligonucleotide
ggcgcgcagacccuccga

SEQ ID NO: 39053 - RNA, 18 nt, Artificial Sequence
  Description of Artificial Sequence: Synthetic oligonucleotide
cuggcggcgcgcagaccc

SEQ ID NO: 39054 - RNA, 18 nt, Artificial Sequence
  Description of Artificial Sequence: Synthetic oligonucleotide
gggcuggcggcgcgcaga

SEQ ID NO: 39055 - RNA, 18 nt, Artificial Sequence
  Description of Artificial Sequence: Synthetic oligonucleotide
ucccagccgcagggcggg

SEQ ID NO: 39056 - RNA, 18 nt, Artificial Sequence
  Description of Artificial Sequence: Synthetic oligonucleotide
gggccucccagccgcagg

SEQ ID NO: 39057 - RNA, 18 nt, Artificial Sequence
  Description of Artificial Sequence: Synthetic oligonucleotide
ggguguggaaggagucgc

SEQ ID NO: 39058 - RNA, 18 nt, Artificial Sequence
  Description of Artificial Sequence: Synthetic oligonucleotide
ggaggccccagcucagcg

SEQ ID NO: 39059 - RNA, 18 nt, Artificial Sequence
  Description of Artificial Sequence: Synthetic oligonucleotide
gcgcaggaggccccagcu

SEQ ID NO: 39060 - RNA, 18 nt, Artificial Sequence
  Description of Artificial Sequence: Synthetic oligonucleotide
caguggcgcaggaggccc

SEQ ID NO: 39061 - RNA, 18 nt, Artificial Sequence
  Description of Artificial Sequence: Synthetic oligonucleotide
cguggcaguggcgcagga

SEQ ID NO: 39062 - RNA, 18 nt, Artificial Sequence
  Description of Artificial Sequence: Synthetic oligonucleotide
accgucguggcaguggcg

SEQ ID NO: 39063 - RNA, 18 nt, Artificial Sequence
  Description of Artificial Sequence: Synthetic oligonucleotide
uugguaccgucguggcag

SEQ ID NO: 39064 - RNA, 18 nt, Artificial Sequence
  Description of Artificial Sequence: Synthetic oligonucleotide
agaaguugguaccgucgu

SEQ ID NO: 39065 - RNA, 18 nt, Artificial Sequence
  Description of Artificial Sequence: Synthetic oligonucleotide
agugaagaaguugguacc

SEQ ID NO: 39066 - RNA, 18 nt, Artificial Sequence
  Description of Artificial Sequence: Synthetic oligonucleotide
uccccagugaagaaguug

SEQ ID NO: 39067 - RNA, 18 nt, Artificial Sequence
  Description of Artificial Sequence: Synthetic oligonucleotide
ccgccuccccagugaaga

SEQ ID NO: 39068 - RNA, 18 nt, Artificial Sequence
  Description of Artificial Sequence: Synthetic oligonucleotide
cacgcccgccuccccagu

SEQ ID NO: 39069 - RNA, 18 nt, Artificial Sequence
  Description of Artificial Sequence: Synthetic oligonucleotide
agccgcacgcccgccucc

SEQ ID NO: 39070 - RNA, 18 nt, Artificial Sequence
  Description of Artificial Sequence: Synthetic oligonucleotide
aguccagccgcacgcccg

SEQ ID NO: 39071 - RNA, 18 nt, Artificial Sequence
  Description of Artificial Sequence: Synthetic oligonucleotide
gauguaguccagccgcac

SEQ ID NO: 39072 - RNA, 18 nt, Artificial Sequence
  Description of Artificial Sequence: Synthetic oligonucleotide
agggagauguaguccagc

SEQ ID NO: 39073 - RNA, 18 nt, Artificial Sequence
  Description of Artificial Sequence: Synthetic oligonucleotide
uguggagggagauguagu

SEQ ID NO: 39074 - RNA, 18 nt, Artificial Sequence
  Description of Artificial Sequence: Synthetic oligonucleotide
cuuccuguggagggagau

SEQ ID NO: 39075 - RNA, 18 nt, Artificial Sequence
  Description of Artificial Sequence: Synthetic oligonucleotide
cguaguaguucaggaagc

SEQ ID NO: 39076 - RNA, 18 nt, Artificial Sequence
  Description of Artificial Sequence: Synthetic oligonucleotide
ggcaucguaguaguucag

SEQ ID NO: 39077 - RNA, 18 nt, Artificial Sequence
  Description of Artificial Sequence: Synthetic oligonucleotide
gagcaggcaucguaguag

SEQ ID NO: 39078 - RNA, 18 nt, Artificial Sequence
  Description of Artificial Sequence: Synthetic oligonucleotide
ccuccgagcaggcaucgu

SEQ ID NO: 39079 - RNA, 18 nt, Artificial Sequence
  Description of Artificial Sequence: Synthetic oligonucleotide
cagacccuccgagcaggc

SEQ ID NO: 39080 - RNA, 18 nt, Artificial Sequence
  Description of Artificial Sequence: Synthetic oligonucleotide
gcgcgcagacccuccgag

SEQ ID NO: 39081 - RNA, 18 nt, Artificial Sequence
  Description of Artificial Sequence: Synthetic oligonucleotide
uggcggcgcgcagacccu

SEQ ID NO: 39082 - RNA, 18 nt, Artificial Sequence
  Description of Artificial Sequence: Synthetic oligonucleotide
ucccagccgcagggcggg

SEQ ID NO: 39083 - RNA, 18 nt, Artificial Sequence
  Description of Artificial Sequence: Synthetic oligonucleotide
gggccucccagccgcagg

SEQ ID NO: 39084 - RNA, 18 nt, Artificial Sequence
  Description of Artificial Sequence: Synthetic oligonucleotide
guggaaggagucgccggg

SEQ ID NO: 39085 - RNA, 18 nt, Artificial Sequence
  Description of Artificial Sequence: Synthetic oligonucleotide
ggguguggaaggagucgc

SEQ ID NO: 39086 - RNA, 18 nt, Artificial Sequence
  Description of Artificial Sequence: Synthetic oligonucleotide
aggccccagcucagcggg

SEQ ID NO: 39087 - RNA, 18 nt, Artificial Sequence
  Description of Artificial Sequence: Synthetic oligonucleotide
caggaggccccagcucag

SEQ ID NO: 39088 - RNA, 18 nt, Artificial Sequence
  Description of Artificial Sequence: Synthetic oligonucleotide
uggcgcaggaggccccag

SEQ ID NO: 39089 - RNA, 18 nt, Artificial Sequence
  Description of Artificial Sequence: Synthetic oligonucleotide
ggcaguggcgcaggaggc

SEQ ID NO: 39090 - RNA, 18 nt, Artificial Sequence
  Description of Artificial Sequence: Synthetic oligonucleotide
gucguggcaguggcgcag

SEQ ID NO: 39091 - RNA, 18 nt, Artificial Sequence
  Description of Artificial Sequence: Synthetic oligonucleotide
guaccgucguggcagugg

SEQ ID NO: 39092 - RNA, 18 nt, Artificial Sequence
  Description of Artificial Sequence: Synthetic oligonucleotide
aguugguaccgucguggc

SEQ ID NO: 39093 - RNA, 18 nt, Artificial Sequence
  Description of Artificial Sequence: Synthetic oligonucleotide
gaagaaguugguaccguc

SEQ ID NO: 39094 - RNA, 18 nt, Artificial Sequence
  Description of Artificial Sequence: Synthetic oligonucleotide
ccagugaagaaguuggua

SEQ ID NO: 39095 - RNA, 18 nt, Artificial Sequence
  Description of Artificial Sequence: Synthetic oligonucleotide
ccuccccagugaagaagu

SEQ ID NO: 39096 - RNA, 18 nt, Artificial Sequence
  Description of Artificial Sequence: Synthetic oligonucleotide
gcccgccuccccagugaa

SEQ ID NO: 39097 - RNA, 18 nt, Artificial Sequence
  Description of Artificial Sequence: Synthetic oligonucleotide
cgcacgcccgccucccca

SEQ ID NO: 39098 - RNA, 18 nt, Artificial Sequence
  Description of Artificial Sequence: Synthetic oligonucleotide
ccagccgcacgcccgccu

SEQ ID NO: 39099 - RNA, 18 nt, Artificial Sequence
  Description of Artificial Sequence: Synthetic oligonucleotide
guaguccagccgcacgcc

SEQ ID NO: 39100 - RNA, 18 nt, Artificial Sequence
  Description of Artificial Sequence: Synthetic oligonucleotide
gagauguaguccagccgc

SEQ ID NO: 39101 - RNA, 18 nt, Artificial Sequence
  Description of Artificial Sequence: Synthetic oligonucleotide
ggagggagauguagucca

SEQ ID NO: 39102 - RNA, 18 nt, Artificial Sequence
  Description of Artificial Sequence: Synthetic oligonucleotide
ccuguggagggagaugua

SEQ ID NO: 39103 - RNA, 18 nt, Artificial Sequence
  Description of Artificial Sequence: Synthetic oligonucleotide
ugagggcgcagaacaccg

SEQ ID NO: 39104 - RNA, 18 nt, Artificial Sequence
  Description of Artificial Sequence: Synthetic oligonucleotide
gcggcugagggcgcagaa

SEQ ID NO: 39105 - RNA, 18 nt, Artificial Sequence
  Description of Artificial Sequence: Synthetic oligonucleotide
gcacagcggcugagggcg

SEQ ID NO: 39106 - RNA, 18 nt, Artificial Sequence
  Description of Artificial Sequence: Synthetic oligonucleotide
gggcacagcggcugaggg

SEQ ID NO: 39107 - RNA, 18 nt, Artificial Sequence
  Description of Artificial Sequence: Synthetic oligonucleotide
gggucagcgcggcccggg

SEQ ID NO: 39108 - RNA, 18 nt, Artificial Sequence
  Description of Artificial Sequence: Synthetic oligonucleotide
caccagggucagcgcggc

SEQ ID NO: 39109 - RNA, 18 nt, Artificial Sequence
  Description of Artificial Sequence: Synthetic oligonucleotide
agcaccaccagggucagc

SEQ ID NO: 39110 - RNA, 18 nt, Artificial Sequence
  Description of Artificial Sequence: Synthetic oligonucleotide
agggcgcagaacaccggg

SEQ ID NO: 39111 - RNA, 18 nt, Artificial Sequence
  Description of Artificial Sequence: Synthetic oligonucleotide
gcugagggcgcagaacac

SEQ ID NO: 39112 - RNA, 18 nt, Artificial Sequence
  Description of Artificial Sequence: Synthetic oligonucleotide
cagcggcugagggcgcag

SEQ ID NO: 39113 - RNA, 18 nt, Artificial Sequence
  Description of Artificial Sequence: Synthetic oligonucleotide
gggcacagcggcugaggg

SEQ ID NO: 39114 - RNA, 18 nt, Artificial Sequence
  Description of Artificial Sequence: Synthetic oligonucleotide
gggucagcgcggcccggg

SEQ ID NO: 39115 - RNA, 18 nt, Artificial Sequence
  Description of Artificial Sequence: Synthetic oligonucleotide
accagggucagcgcggcc

SEQ ID NO: 39116 - RNA, 18 nt, Artificial Sequence
  Description of Artificial Sequence: Synthetic oligonucleotide
gcaccaccagggucagcg

SEQ ID NO: 39117 - RNA, 18 nt, Artificial Sequence
  Description of Artificial Sequence: Synthetic oligonucleotide
ccucagcaccaccagggu

SEQ ID NO: 39118 - RNA, 18 nt, Artificial Sequence
  Description of Artificial Sequence: Synthetic oligonucleotide
agauggagcugcgcgcac

SEQ ID NO: 39119 - RNA, 18 nt, Artificial Sequence
  Description of Artificial Sequence: Synthetic oligonucleotide
gauggagauggagcugcg

SEQ ID NO: 39120 - RNA, 18 nt, Artificial Sequence
  Description of Artificial Sequence: Synthetic oligonucleotide
uccaggauggagauggag

SEQ ID NO: 39121 - RNA, 18 nt, Artificial Sequence
  Description of Artificial Sequence: Synthetic oligonucleotide
ccugcuccaggauggaga

SEQ ID NO: 39122 - RNA, 18 nt, Artificial Sequence
  Description of Artificial Sequence: Synthetic oligonucleotide
cuucuccugcuccaggau

SEQ ID NO: 39123 - RNA, 18 nt, Artificial Sequence
  Description of Artificial Sequence: Synthetic oligonucleotide
acgaccuucuccugcucc

SEQ ID NO: 39124 - RNA, 18 nt, Artificial Sequence
  Description of Artificial Sequence: Synthetic oligonucleotide
gcgcgacgaccuucuccu

SEQ ID NO: 39125 - RNA, 18 nt, Artificial Sequence
  Description of Artificial Sequence: Synthetic oligonucleotide
cugcugcgcgacgaccuu

SEQ ID NO: 39126 - RNA, 18 nt, Artificial Sequence
  Description of Artificial Sequence: Synthetic oligonucleotide
cggaucugcugcgcgacg

SEQ ID NO: 39127 - RNA, 18 nt, Artificial Sequence
  Description of Artificial Sequence: Synthetic oligonucleotide
gcugccggaucugcugcg

SEQ ID NO: 39128 - RNA, 18 nt, Artificial Sequence
  Description of Artificial Sequence: Synthetic oligonucleotide
gaagagcugccggaucug

SEQ ID NO: 39129 - RNA, 18 nt, Artificial Sequence
  Description of Artificial Sequence: Synthetic oligonucleotide
gggaagagcugccggauc

SEQ ID NO: 39130 - RNA, 18 nt, Artificial Sequence
  Description of Artificial Sequence: Synthetic oligonucleotide
gguguccgcgaacuuggg

SEQ ID NO: 39131 - RNA, 18 nt, Artificial Sequence
  Description of Artificial Sequence: Synthetic oligonucleotide
ggguguccgcgaacuugg

SEQ ID NO: 39132 - RNA, 18 nt, Artificial Sequence
  Description of Artificial Sequence: Synthetic oligonucleotide
cucgucguuguaaauggg

SEQ ID NO: 39133 - RNA, 18 nt, Artificial Sequence
  Description of Artificial Sequence: Synthetic oligonucleotide
uccgccucgucguuguaa

SEQ ID NO: 39134 - RNA, 18 nt, Artificial Sequence
  Description of Artificial Sequence: Synthetic oligonucleotide
gcggguccgccucgucgu

SEQ ID NO: 39135 - RNA, 18 nt, Artificial Sequence
  Description of Artificial Sequence: Synthetic oligonucleotide
caccagcggguccgccuc

SEQ ID NO: 39136 - RNA, 18 nt, Artificial Sequence
  Description of Artificial Sequence: Synthetic oligonucleotide
cagcccaccagcgggucc

SEQ ID NO: 39137 - RNA, 18 nt, Artificial Sequence
  Description of Artificial Sequence: Synthetic oligonucleotide
gggaccagcccaccagcg

SEQ ID NO: 39138 - RNA, 18 nt, Artificial Sequence
  Description of Artificial Sequence: Synthetic oligonucleotide
uggcagggaccagcccac

SEQ ID NO: 39139 - RNA, 18 nt, Artificial Sequence
  Description of Artificial Sequence: Synthetic oligonucleotide
ggcuguggcagggaccag

SEQ ID NO: 39140 - RNA, 18 nt, Artificial Sequence
  Description of Artificial Sequence: Synthetic oligonucleotide
uccacggcuguggcaggg

SEQ ID NO: 39141 - RNA, 18 nt, Artificial Sequence
  Description of Artificial Sequence: Synthetic oligonucleotide
cgcccuccacggcugugg

SEQ ID NO: 39142 - RNA, 18 nt, Artificial Sequence
  Description of Artificial Sequence: Synthetic oligonucleotide
acguccgcccuccacggc

SEQ ID NO: 39143 - RNA, 18 nt, Artificial Sequence
  Description of Artificial Sequence: Synthetic oligonucleotide
aggucacguccgcccucc

SEQ ID NO: 39144 - RNA, 18 nt, Artificial Sequence
  Description of Artificial Sequence: Synthetic oligonucleotide
cgcguaggucacguccgc

SEQ ID NO: 39145 - RNA, 18 nt, Artificial Sequence
  Description of Artificial Sequence: Synthetic oligonucleotide
auggccgcguaggucacg

SEQ ID NO: 39146 - RNA, 18 nt, Artificial Sequence
  Description of Artificial Sequence: Synthetic oligonucleotide
ccaccauggccgcguagg

SEQ ID NO: 39147 - RNA, 18 nt, Artificial Sequence
  Description of Artificial Sequence: Synthetic oligonucleotide
cuucaccaccauggccgc

SEQ ID NO: 39148 - RNA, 18 nt, Artificial Sequence
  Description of Artificial Sequence: Synthetic oligonucleotide
ggagauggagcugcgcgc

SEQ ID NO: 39149 - RNA, 18 nt, Artificial Sequence
  Description of Artificial Sequence: Synthetic oligonucleotide
aggauggagauggagcug

SEQ ID NO: 39150 - RNA, 18 nt, Artificial Sequence
  Description of Artificial Sequence: Synthetic oligonucleotide
gcuccaggauggagaugg

SEQ ID NO: 39151 - RNA, 18 nt, Artificial Sequence
  Description of Artificial Sequence: Synthetic oligonucleotide
cuccugcuccaggaugga

SEQ ID NO: 39152 - RNA, 18 nt, Artificial Sequence
  Description of Artificial Sequence: Synthetic oligonucleotide
accuucuccugcuccagg

SEQ ID NO: 39153 - RNA, 18 nt, Artificial Sequence
  Description of Artificial Sequence: Synthetic oligonucleotide
cgacgaccuucuccugcu

SEQ ID NO: 39154 - RNA, 18 nt, Artificial Sequence
  Description of Artificial Sequence: Synthetic oligonucleotide
cugcgcgacgaccuucuc

SEQ ID NO: 39155 - RNA, 18 nt, Artificial Sequence
  Description of Artificial Sequence: Synthetic oligonucleotide
aucugcugcgcgacgacc

SEQ ID NO: 39156 - RNA, 18 nt, Artificial Sequence
  Description of Artificial Sequence: Synthetic oligonucleotide
gccggaucugcugcgcga

SEQ ID NO: 39157 - RNA, 18 nt, Artificial Sequence
  Description of Artificial Sequence: Synthetic oligonucleotide
gagcugccggaucugcug

SEQ ID NO: 39158 - RNA, 18 nt, Artificial Sequence
  Description of Artificial Sequence: Synthetic oligonucleotide
gggaagagcugccggauc

SEQ ID NO: 39159 - RNA, 18 nt, Artificial Sequence
  Description of Artificial Sequence: Synthetic oligonucleotide
gguguccgcgaacuuggg

SEQ ID NO: 39160 - RNA, 18 nt, Artificial Sequence
  Description of Artificial Sequence: Synthetic oligonucleotide
ggguguccgcgaacuugg

SEQ ID NO: 39161 - RNA, 18 nt, Artificial Sequence
  Description of Artificial Sequence: Synthetic oligonucleotide
cucgucguuguaaauggg

SEQ ID NO: 39162 - RNA, 18 nt, Artificial Sequence
  Description of Artificial Sequence: Synthetic oligonucleotide
gccucgucguuguaaaug

SEQ ID NO: 39163 - RNA, 18 nt, Artificial Sequence
  Description of Artificial Sequence: Synthetic oligonucleotide
gguccgccucgucguugu

SEQ ID NO: 39164 - RNA, 18 nt, Artificial Sequence
  Description of Artificial Sequence: Synthetic oligonucleotide
cagcggguccgccucguc

SEQ ID NO: 39165 - RNA, 18 nt, Artificial Sequence
  Description of Artificial Sequence: Synthetic oligonucleotide
cccaccagcggguccgcc

SEQ ID NO: 39166 - RNA, 18 nt, Artificial Sequence
  Description of Artificial Sequence: Synthetic oligonucleotide
accagcccaccagcgggu

SEQ ID NO: 39167 - RNA, 18 nt, Artificial Sequence
  Description of Artificial Sequence: Synthetic oligonucleotide
cagggaccagcccaccag

SEQ ID NO: 39168 - RNA, 18 nt, Artificial Sequence
  Description of Artificial Sequence: Synthetic oligonucleotide
uguggcagggaccagccc

SEQ ID NO: 39169 - RNA, 18 nt, Artificial Sequence
  Description of Artificial Sequence: Synthetic oligonucleotide
acggcuguggcagggacc

SEQ ID NO: 39170 - RNA, 18 nt, Artificial Sequence
  Description of Artificial Sequence: Synthetic oligonucleotide
ccuccacggcuguggcag

SEQ ID NO: 39171 - RNA, 18 nt, Artificial Sequence
  Description of Artificial Sequence: Synthetic oligonucleotide
uccgcccuccacggcugu

SEQ ID NO: 39172 - RNA, 18 nt, Artificial Sequence
  Description of Artificial Sequence: Synthetic oligonucleotide
ucacguccgcccuccacg

SEQ ID NO: 39173 - RNA, 18 nt, Artificial Sequence
  Description of Artificial Sequence: Synthetic oligonucleotide
guaggucacguccgcccu

SEQ ID NO: 39174 - RNA, 18 nt, Artificial Sequence
  Description of Artificial Sequence: Synthetic oligonucleotide
gccgcguaggucacgucc

SEQ ID NO: 39175 - RNA, 18 nt, Artificial Sequence
  Description of Artificial Sequence: Synthetic oligonucleotide
ccauggccgcguagguca

SEQ ID NO: 39176 - RNA, 18 nt, Artificial Sequence
  Description of Artificial Sequence: Synthetic oligonucleotide
caccaccauggccgcgua

SEQ ID NO: 39177 - RNA, 18 nt, Artificial Sequence
  Description of Artificial Sequence: Synthetic oligonucleotide
cgcagggcguugggccgg

SEQ ID NO: 39178 - RNA, 18 nt, Artificial Sequence
  Description of Artificial Sequence: Synthetic oligonucleotide
gggcgcgcagggcguugg

SEQ ID NO: 39179 - RNA, 18 nt, Artificial Sequence
  Description of Artificial Sequence: Synthetic oligonucleotide
ucgggaggaagguggccg

SEQ ID NO: 39180 - RNA, 18 nt, Artificial Sequence
  Description of Artificial Sequence: Synthetic oligonucleotide
ccgucucgggaggaaggu

SEQ ID NO: 39181 - RNA, 18 nt, Artificial Sequence
  Description of Artificial Sequence: Synthetic oligonucleotide
cugucccgucucgggagg

SEQ ID NO: 39182 - RNA, 18 nt, Artificial Sequence
  Description of Artificial Sequence: Synthetic oligonucleotide
cucgccugucccgucucg

SEQ ID NO: 39183 - RNA, 18 nt, Artificial Sequence
  Description of Artificial Sequence: Synthetic oligonucleotide
caccgcucgccugucccg

SEQ ID NO: 39184 - RNA, 18 nt, Artificial Sequence
  Description of Artificial Sequence: Synthetic oligonucleotide
gcggccaccgcucgccug

SEQ ID NO: 39185 - RNA, 18 nt, Artificial Sequence
  Description of Artificial Sequence: Synthetic oligonucleotide
guggcgcggccaccgcuc

SEQ ID NO: 39186 - RNA, 18 nt, Artificial Sequence
  Description of Artificial Sequence: Synthetic oligonucleotide
accggguggcgcggccac

SEQ ID NO: 39187 - RNA, 18 nt, Artificial Sequence
  Description of Artificial Sequence: Synthetic oligonucleotide
gggaggaagguggccggg

SEQ ID NO: 39188 - RNA, 18 nt, Artificial Sequence
  Description of Artificial Sequence: Synthetic oligonucleotide
cgggaggaagguggccgg

SEQ ID NO: 39189 - RNA, 18 nt, Artificial Sequence
  Description of Artificial Sequence: Synthetic oligonucleotide
cgucucgggaggaaggug

SEQ ID NO: 39190 - RNA, 18 nt, Artificial Sequence
  Description of Artificial Sequence: Synthetic oligonucleotide
ugucccgucucgggagga

SEQ ID NO: 39191 - RNA, 18 nt, Artificial Sequence
  Description of Artificial Sequence: Synthetic oligonucleotide
ucgccugucccgucucgg

SEQ ID NO: 39192 - RNA, 18 nt, Artificial Sequence
  Description of Artificial Sequence: Synthetic oligonucleotide
accgcucgccugucccgu

SEQ ID NO: 39193 - RNA, 18 nt, Artificial Sequence
  Description of Artificial Sequence: Synthetic oligonucleotide
cggccaccgcucgccugu

SEQ ID NO: 39194 - RNA, 18 nt, Artificial Sequence
  Description of Artificial Sequence: Synthetic oligonucleotide
uggcgcggccaccgcucg

SEQ ID NO: 39195 - RNA, 18 nt, Artificial Sequence
  Description of Artificial Sequence: Synthetic oligonucleotide
ccggguggcgcggccacc

SEQ ID NO: 39196 - RNA, 18 nt, Artificial Sequence
  Description of Artificial Sequence: Synthetic oligonucleotide
ugggaccggguggcgcgg

SEQ ID NO: 39197 - RNA, 18 nt, Artificial Sequence
  Description of Artificial Sequence: Synthetic oligonucleotide
gcagcugggaccgggugg

SEQ ID NO: 39198 - RNA, 18 nt, Artificial Sequence
  Description of Artificial Sequence: Synthetic oligonucleotide
ucugaugcugcgcgauga

SEQ ID NO: 39199 - RNA, 18 nt, Artificial Sequence
  Description of Artificial Sequence: Synthetic oligonucleotide
cagguucugaugcugcgc

SEQ ID NO: 39200 - RNA, 18 nt, Artificial Sequence
  Description of Artificial Sequence: Synthetic oligonucleotide
aguagcagguucugaugc

SEQ ID NO: 39201 - RNA, 18 nt, Artificial Sequence
  Description of Artificial Sequence: Synthetic oligonucleotide
uggccaguagcagguucu

SEQ ID NO: 39202 - RNA, 18 nt, Artificial Sequence
  Description of Artificial Sequence: Synthetic oligonucleotide
gguguuggccaguagcag

SEQ ID NO: 39203 - RNA, 18 nt, Artificial Sequence
  Description of Artificial Sequence: Synthetic oligonucleotide
gaggugguguuggccagu

SEQ ID NO: 39204 - RNA, 18 nt, Artificial Sequence
  Description of Artificial Sequence: Synthetic oligonucleotide
aggcggaggugguguugg

SEQ ID NO: 39205 - RNA, 18 nt, Artificial Sequence
  Description of Artificial Sequence: Synthetic oligonucleotide
gggaaggcggagguggug

SEQ ID NO: 39206 - RNA, 18 nt, Artificial Sequence
  Description of Artificial Sequence: Synthetic oligonucleotide
gcucaggagcgcguaggg

SEQ ID NO: 39207 - RNA, 18 nt, Artificial Sequence
  Description of Artificial Sequence: Synthetic oligonucleotide
ucguugcucaggagcgcg

SEQ ID NO: 39208 - RNA, 18 nt, Artificial Sequence
  Description of Artificial Sequence: Synthetic oligonucleotide
cauugucguugcucagga

SEQ ID NO: 39209 - RNA, 18 nt, Artificial Sequence
  Description of Artificial Sequence: Synthetic oligonucleotide
gaaggcauugucguugcu

SEQ ID NO: 39210 - RNA, 18 nt, Artificial Sequence
  Description of Artificial Sequence: Synthetic oligonucleotide
cucaggaaggcauugucg

SEQ ID NO: 39211 - RNA, 18 nt, Artificial Sequence
  Description of Artificial Sequence: Synthetic oligonucleotide
gguagcucaggaaggcau

SEQ ID NO: 39212 - RNA, 18 nt, Artificial Sequence
  Description of Artificial Sequence: Synthetic oligonucleotide
cgggugguagcucaggaa

SEQ ID NO: 39213 - RNA, 18 nt, Artificial Sequence
  Description of Artificial Sequence: Synthetic oligonucleotide
gggugcgggugguagcuc

SEQ ID NO: 39214 - RNA, 18 nt, Artificial Sequence
  Description of Artificial Sequence: Synthetic oligonucleotide
ugagcgugcgcugcgcga

SEQ ID NO: 39215 - RNA, 18 nt, Artificial Sequence
  Description of Artificial Sequence: Synthetic oligonucleotide
cgcggugagcgugcgcug

SEQ ID NO: 39216 - RNA, 18 nt, Artificial Sequence
  Description of Artificial Sequence: Synthetic oligonucleotide
aagcgcgcggugagcgug

SEQ ID NO: 39217 - RNA, 18 nt, Artificial Sequence
  Description of Artificial Sequence: Synthetic oligonucleotide
ccuggaagcgcgcgguga

SEQ ID NO: 39218 - RNA, 18 nt, Artificial Sequence
  Description of Artificial Sequence: Synthetic oligonucleotide
guugaccuggaagcgcgc

SEQ ID NO: 39219 - RNA, 18 nt, Artificial Sequence
  Description of Artificial Sequence: Synthetic oligonucleotide
guguuguugaccuggaag

SEQ ID NO: 39220 - RNA, 18 nt, Artificial Sequence
  Description of Artificial Sequence: Synthetic oligonucleotide
ggcggguguuguugaccu

SEQ ID NO: 39221 - RNA, 18 nt, Artificial Sequence
  Description of Artificial Sequence: Synthetic oligonucleotide
cggcgggcggguguuguu

SEQ ID NO: 39222 - RNA, 18 nt, Artificial Sequence
  Description of Artificial Sequence: Synthetic oligonucleotide
acgugcggcgggcgggug

SEQ ID NO: 39223 - RNA, 18 nt, Artificial Sequence
  Description of Artificial Sequence: Synthetic oligonucleotide
gcugcacgugcggcgggc

SEQ ID NO: 39224 - RNA, 18 nt, Artificial Sequence
  Description of Artificial Sequence: Synthetic oligonucleotide
caacagcugcacgugcgg

SEQ ID NO: 39225 - RNA, 18 nt, Artificial Sequence
  Description of Artificial Sequence: Synthetic oligonucleotide
uugcgcaacagcugcacg

SEQ ID NO: 39226 - RNA, 18 nt, Artificial Sequence
  Description of Artificial Sequence: Synthetic oligonucleotide
ccggcuugcgcaacagcu

SEQ ID NO: 39227 - RNA, 18 nt, Artificial Sequence
  Description of Artificial Sequence: Synthetic oligonucleotide
gagcaccggcuugcgcaa

SEQ ID NO: 39228 - RNA, 18 nt, Artificial Sequence
  Description of Artificial Sequence: Synthetic oligonucleotide
gccgugagcaccggcuug

SEQ ID NO: 39229 - RNA, 18 nt, Artificial Sequence
  Description of Artificial Sequence: Synthetic oligonucleotide
ccauggccgugagcaccg

SEQ ID NO: 39230 - RNA, 18 nt, Artificial Sequence
  Description of Artificial Sequence: Synthetic oligonucleotide
cagccccauggccgugag

SEQ ID NO: 39231 - RNA, 18 nt, Artificial Sequence
  Description of Artificial Sequence: Synthetic oligonucleotide
gccagcagccccauggcc

SEQ ID NO: 39232 - RNA, 18 nt, Artificial Sequence
  Description of Artificial Sequence: Synthetic oligonucleotide
gcagcgccagcagcccca

SEQ ID NO: 39233 - RNA, 18 nt, Artificial Sequence
  Description of Artificial Sequence: Synthetic oligonucleotide
caccaccuccagcauggg

SEQ ID NO: 39234 - RNA, 18 nt, Artificial Sequence
  Description of Artificial Sequence: Synthetic oligonucleotide
aaagacaccaccuccagc

SEQ ID NO: 39235 - RNA, 18 nt, Artificial Sequence
  Description of Artificial Sequence: Synthetic oligonucleotide
guaguaaagacaccaccu

SEQ ID NO: 39236 - RNA, 18 nt, Artificial Sequence
  Description of Artificial Sequence: Synthetic oligonucleotide
cuccaguaguaaagacac

SEQ ID NO: 39237 - RNA, 18 nt, Artificial Sequence
  Description of Artificial Sequence: Synthetic oligonucleotide
agcuucuccaguaguaaa

SEQ ID NO: 39238 - RNA, 18 nt, Artificial Sequence
  Description of Artificial Sequence: Synthetic oligonucleotide
ggagcagcuucuccagua

SEQ ID NO: 39239 - RNA, 18 nt, Artificial Sequence
  Description of Artificial Sequence: Synthetic oligonucleotide
gaugaggagcagcuucuc

SEQ ID NO: 39240 - RNA, 18 nt, Artificial Sequence
  Description of Artificial Sequence: Synthetic oligonucleotide
uuggagaugaggagcagc

SEQ ID NO: 39241 - RNA, 18 nt, Artificial Sequence
  Description of Artificial Sequence: Synthetic oligonucleotide
ugaaguuggagaugagga

SEQ ID NO: 39242 - RNA, 18 nt, Artificial Sequence
  Description of Artificial Sequence: Synthetic oligonucleotide
gagcgugaaguuggagau

SEQ ID NO: 39243 - RNA, 18 nt, Artificial Sequence
  Description of Artificial Sequence: Synthetic oligonucleotide
cuaaagagcgugaaguug

SEQ ID NO: 39244 - RNA, 18 nt, Artificial Sequence
  Description of Artificial Sequence: Synthetic oligonucleotide
ccgaacuaaagagcguga

SEQ ID NO: 39245 - RNA, 18 nt, Artificial Sequence
  Description of Artificial Sequence: Synthetic oligonucleotide
ggcgcccgaacuaaagag

SEQ ID NO: 39246 - RNA, 18 nt, Artificial Sequence
  Description of Artificial Sequence: Synthetic oligonucleotide
cccgcggcgcccgaacua

SEQ ID NO: 39247 - RNA, 18 nt, Artificial Sequence
  Description of Artificial Sequence: Synthetic oligonucleotide
cuucgcccgcggcgcccg

SEQ ID NO: 39248 - RNA, 18 nt, Artificial Sequence
  Description of Artificial Sequence: Synthetic oligonucleotide
uuugucuucgcccgcggc

SEQ ID NO: 39249 - RNA, 18 nt, Artificial Sequence
  Description of Artificial Sequence: Synthetic oligonucleotide
cucccuuugucuucgccc

SEQ ID NO: 39250 - RNA, 18 nt, Artificial Sequence
  Description of Artificial Sequence: Synthetic oligonucleotide
uguuccucccuuugucuu

SEQ ID NO: 39251 - RNA, 18 nt, Artificial Sequence
  Description of Artificial Sequence: Synthetic oligonucleotide
aaaacuguuccucccuuu

SEQ ID NO: 39252 - RNA, 18 nt, Artificial Sequence
  Description of Artificial Sequence: Synthetic oligonucleotide
ucauaaaaacuguuccuc

SEQ ID NO: 39253 - RNA, 18 nt, Artificial Sequence
  Description of Artificial Sequence: Synthetic oligonucleotide
ugguuucauaaaaacugu

SEQ ID NO: 39254 - RNA, 18 nt, Artificial Sequence
  Description of Artificial Sequence: Synthetic oligonucleotide
agagcugguuucauaaaa

SEQ ID NO: 39255 - RNA, 18 nt, Artificial Sequence
  Description of Artificial Sequence: Synthetic oligonucleotide
uggaaagagcugguuuca

SEQ ID NO: 39256 - RNA, 18 nt, Artificial Sequence
  Description of Artificial Sequence: Synthetic oligonucleotide
cucgguggaaagagcugg

SEQ ID NO: 39257 - RNA, 18 nt, Artificial Sequence
  Description of Artificial Sequence: Synthetic oligonucleotide
gucgccucgguggaaaga

SEQ ID NO: 39258 - RNA, 18 nt, Artificial Sequence
  Description of Artificial Sequence: Synthetic oligonucleotide
agcacgucgccucggugg

SEQ ID NO: 39259 - RNA, 18 nt, Artificial Sequence
  Description of Artificial Sequence: Synthetic oligonucleotide
ccuccagcacgucgccuc

SEQ ID NO: 39260 - RNA, 18 nt, Artificial Sequence
  Description of Artificial Sequence: Synthetic oligonucleotide
gggcaccuccagcacguc

SEQ ID NO: 39261 - RNA, 18 nt, Artificial Sequence
  Description of Artificial Sequence: Synthetic oligonucleotide
gggucagguggguccggg

SEQ ID NO: 39262 - RNA, 18 nt, Artificial Sequence
  Description of Artificial Sequence: Synthetic oligonucleotide
uagugggucagguggguc

SEQ ID NO: 39263 - RNA, 18 nt, Artificial Sequence
  Description of Artificial Sequence: Synthetic oligonucleotide
ugccauagugggucaggu

SEQ ID NO: 39264 - RNA, 18 nt, Artificial Sequence
  Description of Artificial Sequence: Synthetic oligonucleotide
guagaugccauagugggu

SEQ ID NO: 39265 - RNA, 18 nt, Artificial Sequence
  Description of Artificial Sequence: Synthetic oligonucleotide
ccuagguagaugccauag

SEQ ID NO: 39266 - RNA, 18 nt, Artificial Sequence
  Description of Artificial Sequence: Synthetic oligonucleotide
ugucuccuagguagaugc

SEQ ID NO: 39267 - RNA, 18 nt, Artificial Sequence
  Description of Artificial Sequence: Synthetic oligonucleotide
acgguugucuccuaggua

SEQ ID NO: 39268 - RNA, 18 nt, Artificial Sequence
  Description of Artificial Sequence: Synthetic oligonucleotide
gcaacacgguugucuccu

SEQ ID NO: 39269 - RNA, 18 nt, Artificial Sequence
  Description of Artificial Sequence: Synthetic oligonucleotide
ugugggcaacacgguugu

SEQ ID NO: 39270 - RNA, 18 nt, Artificial Sequence
  Description of Artificial Sequence: Synthetic oligonucleotide
caucaugugggcaacacg

SEQ ID NO: 39271 - RNA, 18 nt, Artificial Sequence
  Description of Artificial Sequence: Synthetic oligonucleotide
ucgggcaucaugugggca

SEQ ID NO: 39272 - RNA, 18 nt, Artificial Sequence
  Description of Artificial Sequence: Synthetic oligonucleotide
ggaugucgggcaucaugu

SEQ ID NO: 39273 - RNA, 18 nt, Artificial Sequence
  Description of Artificial Sequence: Synthetic oligonucleotide
caacaggaugucgggcau

SEQ ID NO: 39274 - RNA, 18 nt, Artificial Sequence
  Description of Artificial Sequence: Synthetic oligonucleotide
agggccaacaggaugucg

SEQ ID NO: 39275 - RNA, 18 nt, Artificial Sequence
  Description of Artificial Sequence: Synthetic oligonucleotide
cugucagggccaacagga

SEQ ID NO: 39276 - RNA, 18 nt, Artificial Sequence
  Description of Artificial Sequence: Synthetic oligonucleotide
gucgucugucagggccaa

SEQ ID NO: 39277 - RNA, 18 nt, Artificial Sequence
  Description of Artificial Sequence: Synthetic oligonucleotide
cccaugucgucugucagg

SEQ ID NO: 39278 - RNA, 18 nt, Artificial Sequence
  Description of Artificial Sequence: Synthetic oligonucleotide
ugcgccccaugucgucug

SEQ ID NO: 39279 - RNA, 18 nt, Artificial Sequence
  Description of Artificial Sequence: Synthetic oligonucleotide
cugcgugcgccccauguc

SEQ ID NO: 39280 - RNA, 18 nt, Artificial Sequence
  Description of Artificial Sequence: Synthetic oligonucleotide
accuucugcgugcgcccc

SEQ ID NO: 39281 - RNA, 18 nt, Artificial Sequence
  Description of Artificial Sequence: Synthetic oligonucleotide
agaccaccuucugcgugc

SEQ ID NO: 39282 - RNA, 18 nt, Artificial Sequence
  Description of Artificial Sequence: Synthetic oligonucleotide
guuggagaccaccuucug

SEQ ID NO: 39283 - RNA, 18 nt, Artificial Sequence
  Description of Artificial Sequence: Synthetic oligonucleotide
cgcuuguuggagaccacc

SEQ ID NO: 39284 - RNA, 18 nt, Artificial Sequence
  Description of Artificial Sequence: Synthetic oligonucleotide
ugagacgcuuguuggaga

SEQ ID NO: 39285 - RNA, 18 nt, Artificial Sequence
  Description of Artificial Sequence: Synthetic oligonucleotide
caggaugagacgcuuguu

SEQ ID NO: 39286 - RNA, 18 nt, Artificial Sequence
  Description of Artificial Sequence: Synthetic oligonucleotide
acgcccaggaugagacgc

SEQ ID NO: 39287 - RNA, 18 nt, Artificial Sequence
  Description of Artificial Sequence: Synthetic oligonucleotide
caauaacgcccaggauga

SEQ ID NO: 39288 - RNA, 18 nt, Artificial Sequence
  Description of Artificial Sequence: Synthetic oligonucleotide
uuugacaauaacgcccag

SEQ ID NO: 39289 - RNA, 18 nt, Artificial Sequence
  Description of Artificial Sequence: Synthetic oligonucleotide
gccacuuugacaauaacg

SEQ ID NO: 39290 - RNA, 18 nt, Artificial Sequence
  Description of Artificial Sequence: Synthetic oligonucleotide
ugcuggccacuuugacaa

SEQ ID NO: 39291 - RNA, 18 nt, Artificial Sequence
  Description of Artificial Sequence: Synthetic oligonucleotide
gcggaugcuggccacuuu

SEQ ID NO: 39292 - RNA, 18 nt, Artificial Sequence
  Description of Artificial Sequence: Synthetic oligonucleotide
uccacgcggaugcuggcc

SEQ ID NO: 39293 - RNA, 18 nt, Artificial Sequence
  Description of Artificial Sequence: Synthetic oligonucleotide
cuguguccacgcggaugc

SEQ ID NO: 39294 - RNA, 18 nt, Artificial Sequence
  Description of Artificial Sequence: Synthetic oligonucleotide
cuccacuguguccacgcg

SEQ ID NO: 39295 - RNA, 18 nt, Artificial Sequence
  Description of Artificial Sequence: Synthetic oligonucleotide
aaguccuccacugugucc

SEQ ID NO: 39296 - RNA, 18 nt, Artificial Sequence
  Description of Artificial Sequence: Synthetic oligonucleotide
aggcgaaguccuccacug

SEQ ID NO: 39297 - RNA, 18 nt, Artificial Sequence
  Description of Artificial Sequence: Synthetic oligonucleotide
uccguaggcgaaguccuc

SEQ ID NO: 39298 - RNA, 18 nt, Artificial Sequence
  Description of Artificial Sequence: Synthetic oligonucleotide
uuagcuccguaggcgaag

SEQ ID NO: 39299 - RNA, 18 nt, Artificial Sequence
  Description of Artificial Sequence: Synthetic oligonucleotide
ggauguuagcuccguagg

SEQ ID NO: 39300 - RNA, 18 nt, Artificial Sequence
  Description of Artificial Sequence: Synthetic oligonucleotide
gaccaggauguuagcucc

SEQ ID NO: 39301 - RNA, 18 nt, Artificial Sequence
  Description of Artificial Sequence: Synthetic oligonucleotide
ugauugaccaggauguua

SEQ ID NO: 39302 - RNA, 18 nt, Artificial Sequence
  Description of Artificial Sequence: Synthetic oligonucleotide
ccaggugauugaccagga

SEQ ID NO: 39303 - RNA, 18 nt, Artificial Sequence
  Description of Artificial Sequence: Synthetic oligonucleotide
cucguccaggugauugac

SEQ ID NO: 39304 - RNA, 18 nt, Artificial Sequence
  Description of Artificial Sequence: Synthetic oligonucleotide
agggacucguccagguga

SEQ ID NO: 39305 - RNA, 18 nt, Artificial Sequence
  Description of Artificial Sequence: Synthetic oligonucleotide
ucuggagggacucgucca

SEQ ID NO: 39306 - RNA, 18 nt, Artificial Sequence
  Description of Artificial Sequence: Synthetic oligonucleotide
cuuuuucuggagggacuc

SEQ ID NO: 39307 - RNA, 18 nt, Artificial Sequence
  Description of Artificial Sequence: Synthetic oligonucleotide
agugccuuuuucuggagg

SEQ ID NO: 39308 - RNA, 18 nt, Artificial Sequence
  Description of Artificial Sequence: Synthetic oligonucleotide
ugagcagugccuuuuucu

SEQ ID NO: 39309 - RNA, 18 nt, Artificial Sequence
  Description of Artificial Sequence: Synthetic oligonucleotide
cucguugagcagugccuu

SEQ ID NO: 39310 - RNA, 18 nt, Artificial Sequence
  Description of Artificial Sequence: Synthetic oligonucleotide
accuccucguugagcagu

SEQ ID NO: 39311 - RNA, 18 nt, Artificial Sequence
  Description of Artificial Sequence: Synthetic oligonucleotide
gcgccaccuccucguuga

SEQ ID NO: 39312 - RNA, 18 nt, Artificial Sequence
  Description of Artificial Sequence: Synthetic oligonucleotide
ccuccgcgccaccuccuc

SEQ ID NO: 39313 - RNA, 18 nt, Artificial Sequence
  Description of Artificial Sequence: Synthetic oligonucleotide
ucagcccuccgcgccacc

SEQ ID NO: 39314 - RNA, 18 nt, Artificial Sequence
  Description of Artificial Sequence: Synthetic oligonucleotide
gcuuuucagcccuccgcg

SEQ ID NO: 39315 - RNA, 18 nt, Artificial Sequence
  Description of Artificial Sequence: Synthetic oligonucleotide
cagcagcuuuucagcccu

SEQ ID NO: 39316 - RNA, 18 nt, Artificial Sequence
  Description of Artificial Sequence: Synthetic oligonucleotide
aagcccagcagcuuuuca

SEQ ID NO: 39317 - RNA, 18 nt, Artificial Sequence
  Description of Artificial Sequence: Synthetic oligonucleotide
ggguaaagcccagcagcu

SEQ ID NO: 39318 - RNA, 18 nt, Artificial Sequence
  Description of Artificial Sequence: Synthetic oligonucleotide
ccacagcaggcuguaggg

SEQ ID NO: 39319 - RNA, 18 nt, Artificial Sequence
  Description of Artificial Sequence: Synthetic oligonucleotide
guuccacagcaggcugua

SEQ ID NO: 39320 - RNA, 18 nt, Artificial Sequence
  Description of Artificial Sequence: Synthetic oligonucleotide
caguuguuccacagcagg

SEQ ID NO: 39321 - RNA, 18 nt, Artificial Sequence
  Description of Artificial Sequence: Synthetic oligonucleotide
gcucgcaguuguuccaca

SEQ ID NO: 39322 - RNA, 18 nt, Artificial Sequence
  Description of Artificial Sequence: Synthetic oligonucleotide
gaagugcucgcaguuguu

SEQ ID NO: 39323 - RNA, 18 nt, Artificial Sequence
  Description of Artificial Sequence: Synthetic oligonucleotide
gucacgaagugcucgcag

SEQ ID NO: 39324 - RNA, 18 nt, Artificial Sequence
  Description of Artificial Sequence: Synthetic oligonucleotide
aguaggucacgaagugcu

SEQ ID NO: 39325 - RNA, 18 nt, Artificial Sequence
  Description of Artificial Sequence: Synthetic oligonucleotide
ucugcaguaggucacgaa

SEQ ID NO: 39326 - RNA, 18 nt, Artificial Sequence
  Description of Artificial Sequence: Synthetic oligonucleotide
ccauaucugcaguagguc

SEQ ID NO: 39327 - RNA, 18 nt, Artificial Sequence
  Description of Artificial Sequence: Synthetic oligonucleotide
gggugccauaucugcagu

SEQ ID NO: 39328 - RNA, 18 nt, Artificial Sequence
  Description of Artificial Sequence: Synthetic oligonucleotide
ccccugggagucacacau

SEQ ID NO: 39329 - RNA, 18 nt, Artificial Sequence
  Description of Artificial Sequence: Synthetic oligonucleotide
cacuuccccugggaguca

SEQ ID NO: 39330 - RNA, 18 nt, Artificial Sequence
  Description of Artificial Sequence: Synthetic oligonucleotide
gagcccacuuccccuggg

SEQ ID NO: 39331 - RNA, 18 nt, Artificial Sequence
  Description of Artificial Sequence: Synthetic oligonucleotide
ccgcggagcccacuuccc

SEQ ID NO: 39332 - RNA, 18 nt, Artificial Sequence
  Description of Artificial Sequence: Synthetic oligonucleotide
caucuccgcggagcccac

SEQ ID NO: 39333 - RNA, 18 nt, Artificial Sequence
  Description of Artificial Sequence: Synthetic oligonucleotide
gggcaucuccgcggagcc

SEQ ID NO: 39334 - RNA, 18 nt, Artificial Sequence
  Description of Artificial Sequence: Synthetic oligonucleotide
aggucagggaugggaggg

SEQ ID NO: 39335 - RNA, 18 nt, Artificial Sequence
  Description of Artificial Sequence: Synthetic oligonucleotide
agaaaaggucagggaugg

SEQ ID NO: 39336 - RNA, 18 nt, Artificial Sequence
  Description of Artificial Sequence: Synthetic oligonucleotide
ggaagagaaaaggucagg

SEQ ID NO: 39337 - RNA, 18 nt, Artificial Sequence
  Description of Artificial Sequence: Synthetic oligonucleotide
gggaagagaaaaggucag

SEQ ID NO: 39338 - RNA, 18 nt, Artificial Sequence
  Description of Artificial Sequence: Synthetic oligonucleotide
uagaucccuacucgcggg

SEQ ID NO: 39339 - RNA, 18 nt, Artificial Sequence
  Description of Artificial Sequence: Synthetic oligonucleotide
ggaauuagaucccuacuc

SEQ ID NO: 39340 - RNA, 18 nt, Artificial Sequence
  Description of Artificial Sequence: Synthetic oligonucleotide
guccaggaauuagauccc

SEQ ID NO: 39341 - RNA, 18 nt, Artificial Sequence
  Description of Artificial Sequence: Synthetic oligonucleotide
gagguguccaggaauuag

SEQ ID NO: 39342 - RNA, 18 nt, Artificial Sequence
  Description of Artificial Sequence: Synthetic oligonucleotide
gggagguguccaggaauu

SEQ ID NO: 39343 - RNA, 18 nt, Artificial Sequence
  Description of Artificial Sequence: Synthetic oligonucleotide
gguauggaagugguaggg

SEQ ID NO: 39344 - RNA, 18 nt, Artificial Sequence
  Description of Artificial Sequence: Synthetic oligonucleotide
aggaugguauggaagugg

SEQ ID NO: 39345 - RNA, 18 nt, Artificial Sequence
  Description of Artificial Sequence: Synthetic oligonucleotide
gaaaaaggaugguaugga

SEQ ID NO: 39346 - RNA, 18 nt, Artificial Sequence
  Description of Artificial Sequence: Synthetic oligonucleotide
aaaaagaaaaaggauggu

SEQ ID NO: 39347 - RNA, 18 nt, Artificial Sequence
  Description of Artificial Sequence: Synthetic oligonucleotide
aaaggaaaaagaaaaagg

SEQ ID NO: 39348 - RNA, 18 nt, Artificial Sequence
  Description of Artificial Sequence: Synthetic oligonucleotide
aaaaaaaaggaaaaagaa

SEQ ID NO: 39349 - RNA, 18 nt, Artificial Sequence
  Description of Artificial Sequence: Synthetic oligonucleotide
aaaaaaaaaaaaaggaaa

SEQ ID NO: 39350 - RNA, 18 nt, Artificial Sequence
  Description of Artificial Sequence: Synthetic oligonucleotide
aaaaaaaaaaaaaaaaaa

SEQ ID NO: 39351 - RNA, 18 nt, Artificial Sequence
  Description of Artificial Sequence: Synthetic oligonucleotide
aaaaaaaaaaaaaaaaaa

SEQ ID NO: 39352 - RNA, 18 nt, Artificial Sequence
  Description of Artificial Sequence: Synthetic oligonucleotide
aaaaaaaaaaaaaaaaaa

SEQ ID NO: 39353 - RNA, 18 nt, Artificial Sequence
  Description of Artificial Sequence: Synthetic oligonucleotide
cucaaaaaaaaaaaaaaa

SEQ ID NO: 39354 - RNA, 18 nt, Artificial Sequence
  Description of Artificial Sequence: Synthetic oligonucleotide
uccgucucaaaaaaaaaa

SEQ ID NO: 39355 - RNA, 18 nt, Artificial Sequence
  Description of Artificial Sequence: Synthetic oligonucleotide
gagacuccgucucaaaaa

SEQ ID NO: 39356 - RNA, 18 nt, Artificial Sequence
  Description of Artificial Sequence: Synthetic oligonucleotide
agagcgagacuccgucuc

SEQ ID NO: 39357 - RNA, 18 nt, Artificial Sequence
  Description of Artificial Sequence: Synthetic oligonucleotide
gcaacagagcgagacucc

SEQ ID NO: 39358 - RNA, 18 nt, Artificial Sequence
  Description of Artificial Sequence: Synthetic oligonucleotide
ccugagcaacagagcgag

SEQ ID NO: 39359 - RNA, 18 nt, Artificial Sequence
  Description of Artificial Sequence: Synthetic oligonucleotide
uccagccugagcaacaga

SEQ ID NO: 39360 - RNA, 18 nt, Artificial Sequence
  Description of Artificial Sequence: Synthetic oligonucleotide
ugcacuccagccugagca

SEQ ID NO: 39361 - RNA, 18 nt, Artificial Sequence
  Description of Artificial Sequence: Synthetic oligonucleotide
gccacugcacuccagccu

SEQ ID NO: 39362 - RNA, 18 nt, Artificial Sequence
  Description of Artificial Sequence: Synthetic oligonucleotide
aucgcgccacugcacucc

SEQ ID NO: 39363 - RNA, 18 nt, Artificial Sequence
  Description of Artificial Sequence: Synthetic oligonucleotide
uggagaucgcgccacugc

SEQ ID NO: 39364 - RNA, 18 nt, Artificial Sequence
  Description of Artificial Sequence: Synthetic oligonucleotide
gugaguggagaucgcgcc

SEQ ID NO: 39365 - RNA, 18 nt, Artificial Sequence
  Description of Artificial Sequence: Synthetic oligonucleotide
uugcagugaguggagauc

SEQ ID NO: 39366 - RNA, 18 nt, Artificial Sequence
  Description of Artificial Sequence: Synthetic oligonucleotide
ggaguuugcagugagugg

SEQ ID NO: 39367 - RNA, 18 nt, Artificial Sequence
  Description of Artificial Sequence: Synthetic oligonucleotide
gaggcggaguuugcagug

SEQ ID NO: 39368 - RNA, 18 nt, Artificial Sequence
  Description of Artificial Sequence: Synthetic oligonucleotide
cucuggaggcggaguuug

SEQ ID NO: 39369 - RNA, 18 nt, Artificial Sequence
  Description of Artificial Sequence: Synthetic oligonucleotide
gugaacucuggaggcgga

SEQ ID NO: 39370 - RNA, 18 nt, Artificial Sequence
  Description of Artificial Sequence: Synthetic oligonucleotide
auggcgugaacucuggag

SEQ ID NO: 39371 - RNA, 18 nt, Artificial Sequence
  Description of Artificial Sequence: Synthetic oligonucleotide
ggagaauggcgugaacuc

SEQ ID NO: 39372 - RNA, 18 nt, Artificial Sequence
  Description of Artificial Sequence: Synthetic oligonucleotide
aggcaggagaauggcgug

SEQ ID NO: 39373 - RNA, 18 nt, Artificial Sequence
  Description of Artificial Sequence: Synthetic oligonucleotide
ggcugaggcaggagaaug

SEQ ID NO: 39374 - RNA, 18 nt, Artificial Sequence
  Description of Artificial Sequence: Synthetic oligonucleotide
caggaggcugaggcagga

SEQ ID NO: 39375 - RNA, 18 nt, Artificial Sequence
  Description of Artificial Sequence: Synthetic oligonucleotide
cuacucaggaggcugagg

SEQ ID NO: 39376 - RNA, 18 nt, Artificial Sequence
  Description of Artificial Sequence: Synthetic oligonucleotide
cccagcuacucaggaggc

SEQ ID NO: 39377 - RNA, 18 nt, Artificial Sequence
  Description of Artificial Sequence: Synthetic oligonucleotide
guagucccagcuacucag

SEQ ID NO: 39378 - RNA, 18 nt, Artificial Sequence
  Description of Artificial Sequence: Synthetic oligonucleotide
ugccuguagucccagcua

SEQ ID NO: 39379 - RNA, 18 nt, Artificial Sequence
  Description of Artificial Sequence: Synthetic oligonucleotide
gcgggugccuguaguccc

SEQ ID NO: 39380 - RNA, 18 nt, Artificial Sequence
  Description of Artificial Sequence: Synthetic oligonucleotide
ugguggcgggugccugua

SEQ ID NO: 39381 - RNA, 18 nt, Artificial Sequence
  Description of Artificial Sequence: Synthetic oligonucleotide
gggcgugguggcgggugc

SEQ ID NO: 39382 - RNA, 18 nt, Artificial Sequence
  Description of Artificial Sequence: Synthetic oligonucleotide
uagccgggcgugguggcg

SEQ ID NO: 39383 - RNA, 18 nt, Artificial Sequence
  Description of Artificial Sequence: Synthetic oligonucleotide
uaaauuagccgggcgugg

SEQ ID NO: 39384 - RNA, 18 nt, Artificial Sequence
  Description of Artificial Sequence: Synthetic oligonucleotide
aaaaauaaauuagccggg

SEQ ID NO: 39385 - RNA, 18 nt, Artificial Sequence
  Description of Artificial Sequence: Synthetic oligonucleotide
aauacaaaaauaaauuag

SEQ ID NO: 39386 - RNA, 18 nt, Artificial Sequence
  Description of Artificial Sequence: Synthetic oligonucleotide
cuaaaaauacaaaaauaa

SEQ ID NO: 39387 - RNA, 18 nt, Artificial Sequence
  Description of Artificial Sequence: Synthetic oligonucleotide
cucuacuaaaaauacaaa

SEQ ID NO: 39388 - RNA, 18 nt, Artificial Sequence
  Description of Artificial Sequence: Synthetic oligonucleotide
cccaucucuacuaaaaau

SEQ ID NO: 39389 - RNA, 18 nt, Artificial Sequence
  Description of Artificial Sequence: Synthetic oligonucleotide
gaaaccccaucucuacua

SEQ ID NO: 39390 - RNA, 18 nt, Artificial Sequence
  Description of Artificial Sequence: Synthetic oligonucleotide
acggugaaaccccaucuc

SEQ ID NO: 39391 - RNA, 18 nt, Artificial Sequence
  Description of Artificial Sequence: Synthetic oligonucleotide
cuaauacggugaaacccc

SEQ ID NO: 39392 - RNA, 18 nt, Artificial Sequence
  Description of Artificial Sequence: Synthetic oligonucleotide
ccuugcuaauacggugaa

SEQ ID NO: 39393 - RNA, 18 nt, Artificial Sequence
  Description of Artificial Sequence: Synthetic oligonucleotide
accauccuugcuaauacg

SEQ ID NO: 39394 - RNA, 18 nt, Artificial Sequence
  Description of Artificial Sequence: Synthetic oligonucleotide
ucgggaccauccuugcua

SEQ ID NO: 39395 - RNA, 18 nt, Artificial Sequence
  Description of Artificial Sequence: Synthetic oligonucleotide
ggagaucgggaccauccu

SEQ ID NO: 39396 - RNA, 18 nt, Artificial Sequence
  Description of Artificial Sequence: Synthetic oligonucleotide
ggucaggagaucgggacc

SEQ ID NO: 39397 - RNA, 18 nt, Artificial Sequence
  Description of Artificial Sequence: Synthetic oligonucleotide
cacgaggucaggagaucg

SEQ ID NO: 39398 - RNA, 18 nt, Artificial Sequence
  Description of Artificial Sequence: Synthetic oligonucleotide
aggaucacgaggucagga

SEQ ID NO: 39399 - RNA, 18 nt, Artificial Sequence
  Description of Artificial Sequence: Synthetic oligonucleotide
gcgggaggaucacgaggu

SEQ ID NO: 39400 - RNA, 18 nt, Artificial Sequence
  Description of Artificial Sequence: Synthetic oligonucleotide
cugaggcgggaggaucac

SEQ ID NO: 39401 - RNA, 18 nt, Artificial Sequence
  Description of Artificial Sequence: Synthetic oligonucleotide
ggaugcugaggcgggagg

SEQ ID NO: 39402 - RNA, 18 nt, Artificial Sequence
  Description of Artificial Sequence: Synthetic oligonucleotide
cuuugggaugcugaggcg

SEQ ID NO: 39403 - RNA, 18 nt, Artificial Sequence
  Description of Artificial Sequence: Synthetic oligonucleotide
cagcacuuugggaugcug

SEQ ID NO: 39404 - RNA, 18 nt, Artificial Sequence
  Description of Artificial Sequence: Synthetic oligonucleotide
aaucccagcacuuuggga

SEQ ID NO: 39405 - RNA, 18 nt, Artificial Sequence
  Description of Artificial Sequence: Synthetic oligonucleotide
ccuguaaucccagcacuu

SEQ ID NO: 39406 - RNA, 18 nt, Artificial Sequence
  Description of Artificial Sequence: Synthetic oligonucleotide
ucacgccuguaaucccag

SEQ ID NO: 39407 - RNA, 18 nt, Artificial Sequence
  Description of Artificial Sequence: Synthetic oligonucleotide
guggcucacgccuguaau

SEQ ID NO: 39408 - RNA, 18 nt, Artificial Sequence
  Description of Artificial Sequence: Synthetic oligonucleotide
gcacgguggcucacgccu

SEQ ID NO: 39409 - RNA, 18 nt, Artificial Sequence
  Description of Artificial Sequence: Synthetic oligonucleotide
gccgggcacgguggcuca

SEQ ID NO: 39410 - RNA, 18 nt, Artificial Sequence
  Description of Artificial Sequence: Synthetic oligonucleotide
ggaaggccgggcacggug

SEQ ID NO: 39411 - RNA, 18 nt, Artificial Sequence
  Description of Artificial Sequence: Synthetic oligonucleotide
guuauggaaggccgggca

SEQ ID NO: 39412 - RNA, 18 nt, Artificial Sequence
  Description of Artificial Sequence: Synthetic oligonucleotide
agaauguuauggaaggcc

SEQ ID NO: 39413 - RNA, 18 nt, Artificial Sequence
  Description of Artificial Sequence: Synthetic oligonucleotide
cuuuaagaauguuaugga

SEQ ID NO: 39414 - RNA, 18 nt, Artificial Sequence
  Description of Artificial Sequence: Synthetic oligonucleotide
uagaacuuuaagaauguu

SEQ ID NO: 39415 - RNA, 18 nt, Artificial Sequence
  Description of Artificial Sequence: Synthetic oligonucleotide
uaaucuagaacuuuaaga

SEQ ID NO: 39416 - RNA, 18 nt, Artificial Sequence
  Description of Artificial Sequence: Synthetic oligonucleotide
uuacuuaaucuagaacuu

SEQ ID NO: 39417 - RNA, 18 nt, Artificial Sequence
  Description of Artificial Sequence: Synthetic oligonucleotide
uuuccuuacuuaaucuag

SEQ ID NO: 39418 - RNA, 18 nt, Artificial Sequence
  Description of Artificial Sequence: Synthetic oligonucleotide
agaacuuuccuuacuuaa

SEQ ID NO: 39419 - RNA, 18 nt, Artificial Sequence
  Description of Artificial Sequence: Synthetic oligonucleotide
acaccagaacuuuccuua

SEQ ID NO: 39420 - RNA, 18 nt, Artificial Sequence
  Description of Artificial Sequence: Synthetic oligonucleotide
uaggaacaccagaacuuu

SEQ ID NO: 39421 - RNA, 18 nt, Artificial Sequence
  Description of Artificial Sequence: Synthetic oligonucleotide
uaccuuaggaacaccaga

SEQ ID NO: 39422 - RNA, 18 nt, Artificial Sequence
  Description of Artificial Sequence: Synthetic oligonucleotide
uuauugucaaaucccauu

SEQ ID NO: 39423 - RNA, 18 nt, Artificial Sequence
  Description of Artificial Sequence: Synthetic oligonucleotide
uaauuuuauugucaaauc

SEQ ID NO: 39424 - RNA, 18 nt, Artificial Sequence
  Description of Artificial Sequence: Synthetic oligonucleotide
aagucuaauuuuauuguc

SEQ ID NO: 39425 - RNA, 18 nt, Artificial Sequence
  Description of Artificial Sequence: Synthetic oligonucleotide
auagaaagucuaauuuua

SEQ ID NO: 39426 - RNA, 18 nt, Artificial Sequence
  Description of Artificial Sequence: Synthetic oligonucleotide
caggcauagaaagucuaa

SEQ ID NO: 39427 - RNA, 18 nt, Artificial Sequence
  Description of Artificial Sequence: Synthetic oligonucleotide
aucuacaggcauagaaag

SEQ ID NO: 39428 - RNA, 18 nt, Artificial Sequence
  Description of Artificial Sequence: Synthetic oligonucleotide
ucaaaaucuacaggcaua

SEQ ID NO: 39429 - RNA, 18 nt, Artificial Sequence
  Description of Artificial Sequence: Synthetic oligonucleotide
aagucucaaaaucuacag

SEQ ID NO: 39430 - RNA, 18 nt, Artificial Sequence
  Description of Artificial Sequence: Synthetic oligonucleotide
uuuauaagucucaaaauc

SEQ ID NO: 39431 - RNA, 18 nt, Artificial Sequence
  Description of Artificial Sequence: Synthetic oligonucleotide
acuuuuuuauaagucuca

SEQ ID NO: 39432 - RNA, 18 nt, Artificial Sequence
  Description of Artificial Sequence: Synthetic oligonucleotide
ugauaacuuuuuuauaag

SEQ ID NO: 39433 - RNA, 18 nt, Artificial Sequence
  Description of Artificial Sequence: Synthetic oligonucleotide
accaaugauaacuuuuuu

SEQ ID NO: 39434 - RNA, 18 nt, Artificial Sequence
  Description of Artificial Sequence: Synthetic oligonucleotide
augauaccaaugauaacu

SEQ ID NO: 39435 - RNA, 18 nt, Artificial Sequence
  Description of Artificial Sequence: Synthetic oligonucleotide
aucuaaugauaccaauga

SEQ ID NO: 39436 - RNA, 18 nt, Artificial Sequence
  Description of Artificial Sequence: Synthetic oligonucleotide
cuaaaaucuaaugauacc

SEQ ID NO: 39437 - RNA, 18 nt, Artificial Sequence
  Description of Artificial Sequence: Synthetic oligonucleotide
ccauucuaaaaucuaaug

SEQ ID NO: 39438 - RNA, 18 nt, Artificial Sequence
  Description of Artificial Sequence: Synthetic oligonucleotide
aucugccauucuaaaauc

SEQ ID NO: 39439 - RNA, 18 nt, Artificial Sequence
  Description of Artificial Sequence: Synthetic oligonucleotide
cuccaaucugccauucua

SEQ ID NO: 39440 - RNA, 18 nt, Artificial Sequence
  Description of Artificial Sequence: Synthetic oligonucleotide
aauuccuccaaucugcca

SEQ ID NO: 39441 - RNA, 18 nt, Artificial Sequence
  Description of Artificial Sequence: Synthetic oligonucleotide
gauucaauuccuccaauc

SEQ ID NO: 39442 - RNA, 18 nt, Artificial Sequence
  Description of Artificial Sequence: Synthetic oligonucleotide
aaguagauucaauuccuc

SEQ ID NO: 39443 - RNA, 18 nt, Artificial Sequence
  Description of Artificial Sequence: Synthetic oligonucleotide
auuaaaaguagauucaau

SEQ ID NO: 39444 - RNA, 18 nt, Artificial Sequence
  Description of Artificial Sequence: Synthetic oligonucleotide
ggccaauuaaaaguagau

SEQ ID NO: 39445 - RNA, 18 nt, Artificial Sequence
  Description of Artificial Sequence: Synthetic oligonucleotide
aauuuggccaauuaaaag

SEQ ID NO: 39446 - RNA, 18 nt, Artificial Sequence
  Description of Artificial Sequence: Synthetic oligonucleotide
aauagaauuuggccaauu

SEQ ID NO: 39447 - RNA, 18 nt, Artificial Sequence
  Description of Artificial Sequence: Synthetic oligonucleotide
aaaauaauagaauuuggc

SEQ ID NO: 39448 - RNA, 18 nt, Artificial Sequence
  Description of Artificial Sequence: Synthetic oligonucleotide
gaguaaaaauaauagaau

SEQ ID NO: 39449 - RNA, 18 nt, Artificial Sequence
  Description of Artificial Sequence: Synthetic oligonucleotide
aucuugaguaaaaauaau

SEQ ID NO: 39450 - RNA, 18 nt, Artificial Sequence
  Description of Artificial Sequence: Synthetic oligonucleotide
cucuaaucuugaguaaaa

SEQ ID NO: 39451 - RNA, 18 nt, Artificial Sequence
  Description of Artificial Sequence: Synthetic oligonucleotide
ggugucucuaaucuugag

SEQ ID NO: 39452 - RNA, 18 nt, Artificial Sequence
  Description of Artificial Sequence: Synthetic oligonucleotide
aaagaggugucucuaauc

SEQ ID NO: 39453 - RNA, 18 nt, Artificial Sequence
  Description of Artificial Sequence: Synthetic oligonucleotide
ugagcaaagaggugucuc

SEQ ID NO: 39454 - RNA, 18 nt, Artificial Sequence
  Description of Artificial Sequence: Synthetic oligonucleotide
uuagaugagcaaagaggu

SEQ ID NO: 39455 - RNA, 18 nt, Artificial Sequence
  Description of Artificial Sequence: Synthetic oligonucleotide
uaaaauuagaugagcaaa

SEQ ID NO: 39456 - RNA, 18 nt, Artificial Sequence
  Description of Artificial Sequence: Synthetic oligonucleotide
uauuuuaaaauuagauga

SEQ ID NO: 39457 - RNA, 18 nt, Artificial Sequence
  Description of Artificial Sequence: Synthetic oligonucleotide
uagcauauuuuaaaauua

SEQ ID NO: 39458 - RNA, 18 nt, Artificial Sequence
  Description of Artificial Sequence: Synthetic oligonucleotide
aacaauagcauauuuuaa

SEQ ID NO: 39459 - RNA, 18 nt, Artificial Sequence
  Description of Artificial Sequence: Synthetic oligonucleotide
ucaauaacaauagcauau

SEQ ID NO: 39460 - RNA, 18 nt, Artificial Sequence
  Description of Artificial Sequence: Synthetic oligonucleotide
gcuuaucaauaacaauag

SEQ ID NO: 39461 - RNA, 18 nt, Artificial Sequence
  Description of Artificial Sequence: Synthetic oligonucleotide
aaacugcuuaucaauaac

SEQ ID NO: 39462 - RNA, 18 nt, Artificial Sequence
  Description of Artificial Sequence: Synthetic oligonucleotide
acaucaaacugcuuauca

SEQ ID NO: 39463 - RNA, 18 nt, Artificial Sequence
  Description of Artificial Sequence: Synthetic oligonucleotide
uuaaaacaucaaacugcu

SEQ ID NO: 39464 - RNA, 18 nt, Artificial Sequence
  Description of Artificial Sequence: Synthetic oligonucleotide
aagguuuaaaacaucaaa

SEQ ID NO: 39465 - RNA, 18 nt, Artificial Sequence
  Description of Artificial Sequence: Synthetic oligonucleotide
gacuaaagguuuaaaaca

SEQ ID NO: 39466 - RNA, 18 nt, Artificial Sequence
  Description of Artificial Sequence: Synthetic oligonucleotide
uucaggacuaaagguuua

SEQ ID NO: 39467 - RNA, 18 nt, Artificial Sequence
  Description of Artificial Sequence: Synthetic oligonucleotide
gguuauucaggacuaaag

SEQ ID NO: 39468 - RNA, 18 nt, Artificial Sequence
  Description of Artificial Sequence: Synthetic oligonucleotide
cacaugguuauucaggac

SEQ ID NO: 39469 - RNA, 18 nt, Artificial Sequence
  Description of Artificial Sequence: Synthetic oligonucleotide
auaaccacaugguuauuc

SEQ ID NO: 39470 - RNA, 18 nt, Artificial Sequence
  Description of Artificial Sequence: Synthetic oligonucleotide
aaaguauaaccacauggu

SEQ ID NO: 39471 - RNA, 18 nt, Artificial Sequence
  Description of Artificial Sequence: Synthetic oligonucleotide
uauagaaaguauaaccac

SEQ ID NO: 39472 - RNA, 18 nt, Artificial Sequence
  Description of Artificial Sequence: Synthetic oligonucleotide
aaaacuauagaaaguaua

SEQ ID NO: 39473 - RNA, 18 nt, Artificial Sequence
  Description of Artificial Sequence: Synthetic oligonucleotide
uauagaaaacuauagaaa

SEQ ID NO: 39474 - RNA, 18 nt, Artificial Sequence
  Description of Artificial Sequence: Synthetic oligonucleotide
gcauuuauagaaaacuau

SEQ ID NO: 39475 - RNA, 18 nt, Artificial Sequence
  Description of Artificial Sequence: Synthetic oligonucleotide
auacagcauuuauagaaa

SEQ ID NO: 39476 - RNA, 18 nt, Artificial Sequence
  Description of Artificial Sequence: Synthetic oligonucleotide
uguaaauacagcauuuau

SEQ ID NO: 39477 - RNA, 18 nt, Artificial Sequence
  Description of Artificial Sequence: Synthetic oligonucleotide
gccuauguaaauacagca

SEQ ID NO: 39478 - RNA, 18 nt, Artificial Sequence
  Description of Artificial Sequence: Synthetic oligonucleotide
caguugccuauguaaaua

SEQ ID NO: 39479 - RNA, 18 nt, Artificial Sequence
  Description of Artificial Sequence: Synthetic oligonucleotide
aauggcaguugccuaugu

SEQ ID NO: 39480 - RNA, 18 nt, Artificial Sequence
  Description of Artificial Sequence: Synthetic oligonucleotide
cuaauaauggcaguugcc

SEQ ID NO: 39481 - RNA, 18 nt, Artificial Sequence
  Description of Artificial Sequence: Synthetic oligonucleotide
ggcaacuaauaauggcag

SEQ ID NO: 39482 - RNA, 18 nt, Artificial Sequence
  Description of Artificial Sequence: Synthetic oligonucleotide
ccuuaggcaacuaauaau

SEQ ID NO: 39483 - RNA, 18 nt, Artificial Sequence
  Description of Artificial Sequence: Synthetic oligonucleotide
ugaucccuuaggcaacua

SEQ ID NO: 39484 - RNA, 18 nt, Artificial Sequence
  Description of Artificial Sequence: Synthetic oligonucleotide
agaaaugaucccuuaggc

SEQ ID NO: 39485 - RNA, 18 nt, Artificial Sequence
  Description of Artificial Sequence: Synthetic oligonucleotide
guagcagaaaugaucccu

SEQ ID NO: 39486 - RNA, 18 nt, Artificial Sequence
  Description of Artificial Sequence: Synthetic oligonucleotide
guauaguagcagaaauga

SEQ ID NO: 39487 - RNA, 18 nt, Artificial Sequence
  Description of Artificial Sequence: Synthetic oligonucleotide
auaccguauaguagcaga

SEQ ID NO: 39488 - RNA, 18 nt, Artificial Sequence
  Description of Artificial Sequence: Synthetic oligonucleotide
auucuauaccguauagua

SEQ ID NO: 39489 - RNA, 18 nt, Artificial Sequence
  Description of Artificial Sequence: Synthetic oligonucleotide
uucugauucuauaccgua

SEQ ID NO: 39490 - RNA, 18 nt, Artificial Sequence
  Description of Artificial Sequence: Synthetic oligonucleotide
uccaguucugauucuaua

SEQ ID NO: 39491 - RNA, 18 nt, Artificial Sequence
  Description of Artificial Sequence: Synthetic oligonucleotide
aagaguccaguucugauu

SEQ ID NO: 39492 - RNA, 18 nt, Artificial Sequence
  Description of Artificial Sequence: Synthetic oligonucleotide
auguuaagaguccaguuc

SEQ ID NO: 39493 - RNA, 18 nt, Artificial Sequence
  Description of Artificial Sequence: Synthetic oligonucleotide
uuacaauguuaagagucc

SEQ ID NO: 39494 - RNA, 18 nt, Artificial Sequence
  Description of Artificial Sequence: Synthetic oligonucleotide
aaaauuuacaauguuaag

SEQ ID NO: 39495 - RNA, 18 nt, Artificial Sequence
  Description of Artificial Sequence: Synthetic oligonucleotide
acaaaaaaauuuacaaug

SEQ ID NO: 39496 - RNA, 18 nt, Artificial Sequence
  Description of Artificial Sequence: Synthetic oligonucleotide
gacuuacaaaaaaauuua

SEQ ID NO: 39497 - RNA, 18 nt, Artificial Sequence
  Description of Artificial Sequence: Synthetic oligonucleotide
cuuaugacuuacaaaaaa

SEQ ID NO: 39498 - RNA, 18 nt, Artificial Sequence
  Description of Artificial Sequence: Synthetic oligonucleotide
uuuuucuuaugacuuaca

SEQ ID NO: 39499 - RNA, 18 nt, Artificial Sequence
  Description of Artificial Sequence: Synthetic oligonucleotide
uagacuuuuucuuaugac

SEQ ID NO: 39500 - RNA, 18 nt, Artificial Sequence
  Description of Artificial Sequence: Synthetic oligonucleotide
agaacuagacuuuuucuu

SEQ ID NO: 39501 - RNA, 18 nt, Artificial Sequence
  Description of Artificial Sequence: Synthetic oligonucleotide
ccagaagaacuagacuuu

SEQ ID NO: 39502 - RNA, 18 nt, Artificial Sequence
  Description of Artificial Sequence: Synthetic oligonucleotide
gucuaccagaagaacuag

SEQ ID NO: 39503 - RNA, 18 nt, Artificial Sequence
  Description of Artificial Sequence: Synthetic oligonucleotide
uuucugucuaccagaaga

SEQ ID NO: 39504 - RNA, 18 nt, Artificial Sequence
  Description of Artificial Sequence: Synthetic oligonucleotide
gcuauuuucugucuacca

SEQ ID NO: 39505 - RNA, 18 nt, Artificial Sequence
  Description of Artificial Sequence: Synthetic oligonucleotide
ucccagcuauuuucuguc

SEQ ID NO: 39506 - RNA, 18 nt, Artificial Sequence
  Description of Artificial Sequence: Synthetic oligonucleotide
aguuuucccagcuauuuu

SEQ ID NO: 39507 - RNA, 18 nt, Artificial Sequence
  Description of Artificial Sequence: Synthetic oligonucleotide
aaaucaguuuucccagcu

SEQ ID NO: 39508 - RNA, 18 nt, Artificial Sequence
  Description of Artificial Sequence: Synthetic oligonucleotide
acaguaaaucaguuuucc

SEQ ID NO: 39509 - RNA, 18 nt, Artificial Sequence
  Description of Artificial Sequence: Synthetic oligonucleotide
aucaaacaguaaaucagu

SEQ ID NO: 39510 - RNA, 18 nt, Artificial Sequence
  Description of Artificial Sequence: Synthetic oligonucleotide
cauauaucaaacaguaaa

SEQ ID NO: 39511 - RNA, 18 nt, Artificial Sequence
  Description of Artificial Sequence: Synthetic oligonucleotide
aaucacauauaucaaaca

SEQ ID NO: 39512 - RNA, 18 nt, Artificial Sequence
  Description of Artificial Sequence: Synthetic oligonucleotide
agaagaaucacauauauc

SEQ ID NO: 39513 - RNA, 18 nt, Artificial Sequence
  Description of Artificial Sequence: Synthetic oligonucleotide
acccaagaagaaucacau

SEQ ID NO: 39514 - RNA, 18 nt, Artificial Sequence
  Description of Artificial Sequence: Synthetic oligonucleotide
gcuaaacccaagaagaau

SEQ ID NO: 39515 - RNA, 18 nt, Artificial Sequence
  Description of Artificial Sequence: Synthetic oligonucleotide
agguggcuaaacccaaga

SEQ ID NO: 39516 - RNA, 18 nt, Artificial Sequence
  Description of Artificial Sequence: Synthetic oligonucleotide
aggaaagguggcuaaacc

SEQ ID NO: 39517 - RNA, 18 nt, Artificial Sequence
  Description of Artificial Sequence: Synthetic oligonucleotide
aaauuaggaaagguggcu

SEQ ID NO: 39518 - RNA, 18 nt, Artificial Sequence
  Description of Artificial Sequence: Synthetic oligonucleotide
uuggaaaauuaggaaagg

SEQ ID NO: 39519 - RNA, 18 nt, Artificial Sequence
  Description of Artificial Sequence: Synthetic oligonucleotide
ucuucacagucucacaaa

SEQ ID NO: 39520 - RNA, 18 nt, Artificial Sequence
  Description of Artificial Sequence: Synthetic oligonucleotide
aauuaucuucacagucuc

SEQ ID NO: 39521 - RNA, 18 nt, Artificial Sequence
  Description of Artificial Sequence: Synthetic oligonucleotide
cgaauaauuaucuucaca

SEQ ID NO: 39522 - RNA, 18 nt, Artificial Sequence
  Description of Artificial Sequence: Synthetic oligonucleotide
gaucacgaauaauuaucu

SEQ ID NO: 39523 - RNA, 18 nt, Artificial Sequence
  Description of Artificial Sequence: Synthetic oligonucleotide
ucucugaucacgaauaau

SEQ ID NO: 39524 - RNA, 18 nt, Artificial Sequence
  Description of Artificial Sequence: Synthetic oligonucleotide
acacuucucugaucacga

SEQ ID NO: 39525 - RNA, 18 nt, Artificial Sequence
  Description of Artificial Sequence: Synthetic oligonucleotide
caagaacacuucucugau

SEQ ID NO: 39526 - RNA, 18 nt, Artificial Sequence
  Description of Artificial Sequence: Synthetic oligonucleotide
ugaagcaagaacacuucu

SEQ ID NO: 39527 - RNA, 18 nt, Artificial Sequence
  Description of Artificial Sequence: Synthetic oligonucleotide
acugcugaagcaagaaca

SEQ ID NO: 39528 - RNA, 18 nt, Artificial Sequence
  Description of Artificial Sequence: Synthetic oligonucleotide
ccaagacugcugaagcaa

SEQ ID NO: 39529 - RNA, 18 nt, Artificial Sequence
  Description of Artificial Sequence: Synthetic oligonucleotide
caaucccaagacugcuga

SEQ ID NO: 39530 - RNA, 18 nt, Artificial Sequence
  Description of Artificial Sequence: Synthetic oligonucleotide
gacgccaaucccaagacu

SEQ ID NO: 39531 - RNA, 18 nt, Artificial Sequence
  Description of Artificial Sequence: Synthetic oligonucleotide
cuauagacgccaauccca

SEQ ID NO: 39532 - RNA, 18 nt, Artificial Sequence
  Description of Artificial Sequence: Synthetic oligonucleotide
acagacuauagacgccaa

SEQ ID NO: 39533 - RNA, 18 nt, Artificial Sequence
  Description of Artificial Sequence: Synthetic oligonucleotide
cccguacagacuauagac

SEQ ID NO: 39534 - RNA, 18 nt, Artificial Sequence
  Description of Artificial Sequence: Synthetic oligonucleotide
ccaagcccguacagacua

SEQ ID NO: 39535 - RNA, 18 nt, Artificial Sequence
  Description of Artificial Sequence: Synthetic oligonucleotide
ugauaccaagcccguaca

SEQ ID NO: 39536 - RNA, 18 nt, Artificial Sequence
  Description of Artificial Sequence: Synthetic oligonucleotide
guguaugauaccaagccc

SEQ ID NO: 39537 - RNA, 18 nt, Artificial Sequence
  Description of Artificial Sequence: Synthetic oligonucleotide
ggguaguguaugauacca

SEQ ID NO: 39538 - RNA, 18 nt, Artificial Sequence
  Description of Artificial Sequence: Synthetic oligonucleotide
aggaaggguaguguauga

SEQ ID NO: 39539 - RNA, 18 nt, Artificial Sequence
  Description of Artificial Sequence: Synthetic oligonucleotide
auugcaggaaggguagug

SEQ ID NO: 39540 - RNA, 18 nt, Artificial Sequence
  Description of Artificial Sequence: Synthetic oligonucleotide
uaaaaauugcaggaaggg

SEQ ID NO: 39541 - RNA, 18 nt, Artificial Sequence
  Description of Artificial Sequence: Synthetic oligonucleotide
uggaauaaaaauugcagg

SEQ ID NO: 39542 - RNA, 18 nt, Artificial Sequence
  Description of Artificial Sequence: Synthetic oligonucleotide
aagaauggaauaaaaauu

SEQ ID NO: 39543 - RNA, 18 nt, Artificial Sequence
  Description of Artificial Sequence: Synthetic oligonucleotide
auaggaagaauggaauaa

SEQ ID NO: 39544 - RNA, 18 nt, Artificial Sequence
  Description of Artificial Sequence: Synthetic oligonucleotide
cauccauaggaagaaugg

SEQ ID NO: 39545 - RNA, 18 nt, Artificial Sequence
  Description of Artificial Sequence: Synthetic oligonucleotide
ccagccauccauaggaag

SEQ ID NO: 39546 - RNA, 18 nt, Artificial Sequence
  Description of Artificial Sequence: Synthetic oligonucleotide
guuagccagccauccaua

SEQ ID NO: 39547 - RNA, 18 nt, Artificial Sequence
  Description of Artificial Sequence: Synthetic oligonucleotide
augaaguuagccagccau

SEQ ID NO: 39548 - RNA, 18 nt, Artificial Sequence
  Description of Artificial Sequence: Synthetic oligonucleotide
ggguaugaaguuagccag

SEQ ID NO: 39549 - RNA, 18 nt, Artificial Sequence
  Description of Artificial Sequence: Synthetic oligonucleotide
uacacacacugacauggg

SEQ ID NO: 39550 - RNA, 18 nt, Artificial Sequence
  Description of Artificial Sequence: Synthetic oligonucleotide
cagaauacacacacugac

SEQ ID NO: 39551 - RNA, 18 nt, Artificial Sequence
  Description of Artificial Sequence: Synthetic oligonucleotide
acauacagaauacacaca

SEQ ID NO: 39552 - RNA, 18 nt, Artificial Sequence
  Description of Artificial Sequence: Synthetic oligonucleotide
uauuuacauacagaauac

SEQ ID NO: 39553 - RNA, 18 nt, Artificial Sequence
  Description of Artificial Sequence: Synthetic oligonucleotide
aaacauauuuacauacag

SEQ ID NO: 39554 - RNA, 18 nt, Artificial Sequence
  Description of Artificial Sequence: Synthetic oligonucleotide
aauauaaacauauuuaca

SEQ ID NO: 39555 - RNA, 18 nt, Artificial Sequence
  Description of Artificial Sequence: Synthetic oligonucleotide
cuauaaauauaaacauau

SEQ ID NO: 39556 - RNA, 18 nt, Artificial Sequence
  Description of Artificial Sequence: Synthetic oligonucleotide
augcucuauaaauauaaa

SEQ ID NO: 39557 - RNA, 18 nt, Artificial Sequence
  Description of Artificial Sequence: Synthetic oligonucleotide
gauugaugcucuauaaau

SEQ ID NO: 39558 - RNA, 18 nt, Artificial Sequence
  Description of Artificial Sequence: Synthetic oligonucleotide
auauugauugaugcucua

SEQ ID NO: 39559 - RNA, 18 nt, Artificial Sequence
  Description of Artificial Sequence: Synthetic oligonucleotide
ugcuuauauugauugaug

SEQ ID NO: 39560 - RNA, 18 nt, Artificial Sequence
  Description of Artificial Sequence: Synthetic oligonucleotide
aauaaugcuuauauugau

SEQ ID NO: 39561 - RNA, 18 nt, Artificial Sequence
  Description of Artificial Sequence: Synthetic oligonucleotide
uucucaauaaugcuuaua

SEQ ID NO: 39562 - RNA, 18 nt, Artificial Sequence
  Description of Artificial Sequence: Synthetic oligonucleotide
cauuuuucucaauaaugc

SEQ ID NO: 39563 - RNA, 18 nt, Artificial Sequence
  Description of Artificial Sequence: Synthetic oligonucleotide
ggucacauuuuucucaau

SEQ ID NO: 39564 - RNA, 18 nt, Artificial Sequence
  Description of Artificial Sequence: Synthetic oligonucleotide
uuacgggucacauuuuuc

SEQ ID NO: 39565 - RNA, 18 nt, Artificial Sequence
  Description of Artificial Sequence: Synthetic oligonucleotide
caguguuacgggucacau

SEQ ID NO: 39566 - RNA, 18 nt, Artificial Sequence
  Description of Artificial Sequence: Synthetic oligonucleotide
gaacacaguguuacgggu

SEQ ID NO: 39567 - RNA, 18 nt, Artificial Sequence
  Description of Artificial Sequence: Synthetic oligonucleotide
auccagaacacaguguua

SEQ ID NO: 39568 - RNA, 18 nt, Artificial Sequence
  Description of Artificial Sequence: Synthetic oligonucleotide
uuuuuauccagaacacag

SEQ ID NO: 39569 - RNA, 18 nt, Artificial Sequence
  Description of Artificial Sequence: Synthetic oligonucleotide
ucacauuuuuauccagaa

SEQ ID NO: 39570 - RNA, 18 nt, Artificial Sequence
  Description of Artificial Sequence: Synthetic oligonucleotide
ccuaaucacauuuuuauc

SEQ ID NO: 39571 - RNA, 18 nt, Artificial Sequence
  Description of Artificial Sequence: Synthetic oligonucleotide
ugauuccuaaucacauuu

SEQ ID NO: 39572 - RNA, 18 nt, Artificial Sequence
  Description of Artificial Sequence: Synthetic oligonucleotide
uugcgugauuccuaauca

SEQ ID NO: 39573 - RNA, 18 nt, Artificial Sequence
  Description of Artificial Sequence: Synthetic oligonucleotide
gcacuuugcgugauuccu

SEQ ID NO: 39574 - RNA, 18 nt, Artificial Sequence
  Description of Artificial Sequence: Synthetic oligonucleotide
aguaagcacuuugcguga

SEQ ID NO: 39575 - RNA, 18 nt, Artificial Sequence
  Description of Artificial Sequence: Synthetic oligonucleotide
uacacaguaagcacuuug

SEQ ID NO: 39576 - RNA, 18 nt, Artificial Sequence
  Description of Artificial Sequence: Synthetic oligonucleotide
gggcuuacacaguaagca

SEQ ID NO: 39577 - RNA, 18 nt, Artificial Sequence
  Description of Artificial Sequence: Synthetic oligonucleotide
uucuugggcuuacacagu

SEQ ID NO: 39578 - RNA, 18 nt, Artificial Sequence
  Description of Artificial Sequence: Synthetic oligonucleotide
cuuuguucuugggcuuac

SEQ ID NO: 39579 - RNA, 18 nt, Artificial Sequence
  Description of Artificial Sequence: Synthetic oligonucleotide
aaagccuuuguucuuggg

SEQ ID NO: 39580 - RNA, 18 nt, Artificial Sequence
  Description of Artificial Sequence: Synthetic oligonucleotide
uucagaaagccuuuguuc

SEQ ID NO: 39581 - RNA, 18 nt, Artificial Sequence
  Description of Artificial Sequence: Synthetic oligonucleotide
gaagauucagaaagccuu

SEQ ID NO: 39582 - RNA, 18 nt, Artificial Sequence
  Description of Artificial Sequence: Synthetic oligonucleotide
ccugagaagauucagaaa

SEQ ID NO: 39583 - RNA, 18 nt, Artificial Sequence
  Description of Artificial Sequence: Synthetic oligonucleotide
aacugccugagaagauuc

SEQ ID NO: 39584 - RNA, 18 nt, Artificial Sequence
  Description of Artificial Sequence: Synthetic oligonucleotide
aucugaacugccugagaa

SEQ ID NO: 39585 - RNA, 18 nt, Artificial Sequence
  Description of Artificial Sequence: Synthetic oligonucleotide
uuuaaaucugaacugccu

SEQ ID NO: 39586 - RNA, 18 nt, Artificial Sequence
  Description of Artificial Sequence: Synthetic oligonucleotide
ggugcuuuaaaucugaac

SEQ ID NO: 39587 - RNA, 18 nt, Artificial Sequence
  Description of Artificial Sequence: Synthetic oligonucleotide
uggauggugcuuuaaauc

SEQ ID NO: 39588 - RNA, 18 nt, Artificial Sequence
  Description of Artificial Sequence: Synthetic oligonucleotide
agguuuggauggugcuuu

SEQ ID NO: 39589 - RNA, 18 nt, Artificial Sequence
  Description of Artificial Sequence: Synthetic oligonucleotide
uuccaagguuuggauggu

SEQ ID NO: 39590 - RNA, 18 nt, Artificial Sequence
  Description of Artificial Sequence: Synthetic oligonucleotide
cguauuuccaagguuugg

SEQ ID NO: 39591 - RNA, 18 nt, Artificial Sequence
  Description of Artificial Sequence: Synthetic oligonucleotide
ccugucguauuuccaagg

SEQ ID NO: 39592 - RNA, 18 nt, Artificial Sequence
  Description of Artificial Sequence: Synthetic oligonucleotide
cacacccugucguauuuc

SEQ ID NO: 39593 - RNA, 18 nt, Artificial Sequence
  Description of Artificial Sequence: Synthetic oligonucleotide
ucuaccacacccugucgu

SEQ ID NO: 39594 - RNA, 18 nt, Artificial Sequence
  Description of Artificial Sequence: Synthetic oligonucleotide
ugaauucuaccacacccu

SEQ ID NO: 39595 - RNA, 18 nt, Artificial Sequence
  Description of Artificial Sequence: Synthetic oligonucleotide
auugcugaauucuaccac

SEQ ID NO: 39596 - RNA, 18 nt, Artificial Sequence
  Description of Artificial Sequence: Synthetic oligonucleotide
cucauauugcugaauucu

SEQ ID NO: 39597 - RNA, 18 nt, Artificial Sequence
  Description of Artificial Sequence: Synthetic oligonucleotide
guuuucucauauugcuga

SEQ ID NO: 39598 - RNA, 18 nt, Artificial Sequence
  Description of Artificial Sequence: Synthetic oligonucleotide
ggcugguuuucucauauu

SEQ ID NO: 39599 - RNA, 18 nt, Artificial Sequence
  Description of Artificial Sequence: Synthetic oligonucleotide
gggcugguuuucucauau

SEQ ID NO: 39600 - RNA, 18 nt, Artificial Sequence
  Description of Artificial Sequence: Synthetic oligonucleotide
guggcuaucauuuuaggg

SEQ ID NO: 39601 - RNA, 18 nt, Artificial Sequence
  Description of Artificial Sequence: Synthetic oligonucleotide
cucuuguggcuaucauuu

SEQ ID NO: 39602 - RNA, 18 nt, Artificial Sequence
  Description of Artificial Sequence: Synthetic oligonucleotide
uuaaucucuuguggcuau

SEQ ID NO: 39603 - RNA, 18 nt, Artificial Sequence
  Description of Artificial Sequence: Synthetic oligonucleotide
cacaauuaaucucuugug

SEQ ID NO: 39604 - RNA, 18 nt, Artificial Sequence
  Description of Artificial Sequence: Synthetic oligonucleotide
aaaaacacaauuaaucuc

SEQ ID NO: 39605 - RNA, 18 nt, Artificial Sequence
  Description of Artificial Sequence: Synthetic oligonucleotide
gaaaaaaaaacacaauua

SEQ ID NO: 39606 - RNA, 18 nt, Artificial Sequence
  Description of Artificial Sequence: Synthetic oligonucleotide
caggagaaaaaaaaacac

SEQ ID NO: 39607 - RNA, 18 nt, Artificial Sequence
  Description of Artificial Sequence: Synthetic oligonucleotide
gauuacaggagaaaaaaa

SEQ ID NO: 39608 - RNA, 18 nt, Artificial Sequence
  Description of Artificial Sequence: Synthetic oligonucleotide
acaaggauuacaggagaa

SEQ ID NO: 39609 - RNA, 18 nt, Artificial Sequence
  Description of Artificial Sequence: Synthetic oligonucleotide
acaguacaaggauuacag

SEQ ID NO: 39610 - RNA, 18 nt, Artificial Sequence
  Description of Artificial Sequence: Synthetic oligonucleotide
gccgaacaguacaaggau

SEQ ID NO: 39611 - RNA, 18 nt, Artificial Sequence
  Description of Artificial Sequence: Synthetic oligonucleotide
auucagccgaacaguaca

SEQ ID NO: 39612 - RNA, 18 nt, Artificial Sequence
  Description of Artificial Sequence: Synthetic oligonucleotide
uucaaauucagccgaaca

SEQ ID NO: 39613 - RNA, 18 nt, Artificial Sequence
  Description of Artificial Sequence: Synthetic oligonucleotide
caaucuucaaauucagcc

SEQ ID NO: 39614 - RNA, 18 nt, Artificial Sequence
  Description of Artificial Sequence: Synthetic oligonucleotide
ucuuccaaucuucaaauu

SEQ ID NO: 39615 - RNA, 18 nt, Artificial Sequence
  Description of Artificial Sequence: Synthetic oligonucleotide
auaagucuuccaaucuuc

SEQ ID NO: 39616 - RNA, 18 nt, Artificial Sequence
  Description of Artificial Sequence: Synthetic oligonucleotide
ucaauauaagucuuccaa

SEQ ID NO: 39617 - RNA, 18 nt, Artificial Sequence
  Description of Artificial Sequence: Synthetic oligonucleotide
uggucucaauauaagucu

SEQ ID NO: 39618 - RNA, 18 nt, Artificial Sequence
  Description of Artificial Sequence: Synthetic oligonucleotide
guuacuggucucaauaua

SEQ ID NO: 39619 - RNA, 18 nt, Artificial Sequence
  Description of Artificial Sequence: Synthetic oligonucleotide
guaaaguuacuggucuca

SEQ ID NO: 39620 - RNA, 18 nt, Artificial Sequence
  Description of Artificial Sequence: Synthetic oligonucleotide
uuacaguaaaguuacugg

SEQ ID NO: 39621 - RNA, 18 nt, Artificial Sequence
  Description of Artificial Sequence: Synthetic oligonucleotide
uaaauuuacaguaaaguu

SEQ ID NO: 39622 - RNA, 18 nt, Artificial Sequence
  Description of Artificial Sequence: Synthetic oligonucleotide
caaaguaaauuuacagua

SEQ ID NO: 39623 - RNA, 18 nt, Artificial Sequence
  Description of Artificial Sequence: Synthetic oligonucleotide
ugaaacaaaguaaauuua

SEQ ID NO: 39624 - RNA, 18 nt, Artificial Sequence
  Description of Artificial Sequence: Synthetic oligonucleotide
uucaaugaaacaaaguaa

SEQ ID NO: 39625 - RNA, 18 nt, Artificial Sequence
  Description of Artificial Sequence: Synthetic oligonucleotide
guuuuuucaaugaaacaa

SEQ ID NO: 39626 - RNA, 18 nt, Artificial Sequence
  Description of Artificial Sequence: Synthetic oligonucleotide
aauuuguuuuuucaauga

SEQ ID NO: 39627 - RNA, 18 nt, Artificial Sequence
  Description of Artificial Sequence: Synthetic oligonucleotide
uuaucaauuuguuuuuuc

SEQ ID NO: 39628 - RNA, 18 nt, Artificial Sequence
  Description of Artificial Sequence: Synthetic oligonucleotide
uauguuuaucaauuuguu

SEQ ID NO: 39629 - RNA, 18 nt, Artificial Sequence
  Description of Artificial Sequence: Synthetic oligonucleotide
uuuaauauguuuaucaau

SEQ ID NO: 39630 - RNA, 18 nt, Artificial Sequence
  Description of Artificial Sequence: Synthetic oligonucleotide
uccaguuuaauauguuua

SEQ ID NO: 39631 - RNA, 18 nt, Artificial Sequence
  Description of Artificial Sequence: Synthetic oligonucleotide
auucuuccaguuuaauau

SEQ ID NO: 39632 - RNA, 18 nt, Artificial Sequence
  Description of Artificial Sequence: Synthetic oligonucleotide
agaaaauucuuccaguuu

SEQ ID NO: 39633 - RNA, 18 nt, Artificial Sequence
  Description of Artificial Sequence: Synthetic oligonucleotide
aauaaagaaaauucuucc

SEQ ID NO: 39634 - RNA, 18 nt, Artificial Sequence
  Description of Artificial Sequence: Synthetic oligonucleotide
auuugaauaaagaaaauu

SEQ ID NO: 39635 - RNA, 18 nt, Artificial Sequence
  Description of Artificial Sequence: Synthetic oligonucleotide
uuuucauuugaauaaaga

SEQ ID NO: 39636 - RNA, 18 nt, Artificial Sequence
  Description of Artificial Sequence: Synthetic oligonucleotide
acauguuuucauuugaau

SEQ ID NO: 39637 - RNA, 18 nt, Artificial Sequence
  Description of Artificial Sequence: Synthetic oligonucleotide
aucaaacauguuuucauu

SEQ ID NO: 39638 - RNA, 18 nt, Artificial Sequence
  Description of Artificial Sequence: Synthetic oligonucleotide
cagucaucaaacauguuu

SEQ ID NO: 39639 - RNA, 18 nt, Artificial Sequence
  Description of Artificial Sequence: Synthetic oligonucleotide
uugaccagucaucaaaca

SEQ ID NO: 39640 - RNA, 18 nt, Artificial Sequence
  Description of Artificial Sequence: Synthetic oligonucleotide
auuuuuugaccagucauc

SEQ ID NO: 39641 - RNA, 18 nt, Artificial Sequence
  Description of Artificial Sequence: Synthetic oligonucleotide
agcuuauuuuuugaccag

SEQ ID NO: 39642 - RNA, 18 nt, Artificial Sequence
  Description of Artificial Sequence: Synthetic oligonucleotide
uuaugagcuuauuuuuug

SEQ ID NO: 39643 - RNA, 18 nt, Artificial Sequence
  Description of Artificial Sequence: Synthetic oligonucleotide
auagauuaugagcuuauu

SEQ ID NO: 39644 - RNA, 18 nt, Artificial Sequence
  Description of Artificial Sequence: Synthetic oligonucleotide
aaaaaauagauuaugagc

SEQ ID NO: 39645 - RNA, 18 nt, Artificial Sequence
  Description of Artificial Sequence: Synthetic oligonucleotide
caugaaaaaaauagauua

SEQ ID NO: 39646 - RNA, 18 nt, Artificial Sequence
  Description of Artificial Sequence: Synthetic oligonucleotide
uacuacaugaaaaaaaua

SEQ ID NO: 39647 - RNA, 18 nt, Artificial Sequence
  Description of Artificial Sequence: Synthetic oligonucleotide
uuauauacuacaugaaaa

SEQ ID NO: 39648 - RNA, 18 nt, Artificial Sequence
  Description of Artificial Sequence: Synthetic oligonucleotide
uugacuuauauacuacau

SEQ ID NO: 39649 - RNA, 18 nt, Artificial Sequence
  Description of Artificial Sequence: Synthetic oligonucleotide
cauucuugacuuauauac

SEQ ID NO: 39650 - RNA, 18 nt, Artificial Sequence
  Description of Artificial Sequence: Synthetic oligonucleotide
uaaaacauucuugacuua

SEQ ID NO: 39651 - RNA, 18 nt, Artificial Sequence
  Description of Artificial Sequence: Synthetic oligonucleotide
gacaauaaaacauucuug

SEQ ID NO: 39652 - RNA, 18 nt, Artificial Sequence
  Description of Artificial Sequence: Synthetic oligonucleotide
auaaugacaauaaaacau

SEQ ID NO: 39653 - RNA, 18 nt, Artificial Sequence
  Description of Artificial Sequence: Synthetic oligonucleotide
uucacauaaugacaauaa

SEQ ID NO: 39654 - RNA, 18 nt, Artificial Sequence
  Description of Artificial Sequence: Synthetic oligonucleotide
uugguuucacauaaugac

SEQ ID NO: 39655 - RNA, 18 nt, Artificial Sequence
  Description of Artificial Sequence: Synthetic oligonucleotide
caauauugguuucacaua

SEQ ID NO: 39656 - RNA, 18 nt, Artificial Sequence
  Description of Artificial Sequence: Synthetic oligonucleotide
uuugccaauauugguuuc

SEQ ID NO: 39657 - RNA, 18 nt, Artificial Sequence
  Description of Artificial Sequence: Synthetic oligonucleotide
uacuauuugccaauauug

SEQ ID NO: 39658 - RNA, 18 nt, Artificial Sequence
  Description of Artificial Sequence: Synthetic oligonucleotide
uaaaguacuauuugccaa

SEQ ID NO: 39659 - RNA, 18 nt, Artificial Sequence
  Description of Artificial Sequence: Synthetic oligonucleotide
aucauuaaaguacuauuu

SEQ ID NO: 39660 - RNA, 18 nt, Artificial Sequence
  Description of Artificial Sequence: Synthetic oligonucleotide
acuucaucauuaaaguac

SEQ ID NO: 39661 - RNA, 18 nt, Artificial Sequence
  Description of Artificial Sequence: Synthetic oligonucleotide
cauuuacuucaucauuaa

SEQ ID NO: 39662 - RNA, 18 nt, Artificial Sequence
  Description of Artificial Sequence: Synthetic oligonucleotide
cuggucauuuacuucauc

SEQ ID NO: 39663 - RNA, 18 nt, Artificial Sequence
  Description of Artificial Sequence: Synthetic oligonucleotide
aauuucuggucauuuacu

SEQ ID NO: 39664 - RNA, 18 nt, Artificial Sequence
  Description of Artificial Sequence: Synthetic oligonucleotide
ucuauaauuucuggucau

SEQ ID NO: 39665 - RNA, 18 nt, Artificial Sequence
  Description of Artificial Sequence: Synthetic oligonucleotide
agauuucuauaauuucug

SEQ ID NO: 39666 - RNA, 18 nt, Artificial Sequence
  Description of Artificial Sequence: Synthetic oligonucleotide
aacacagauuucuauaau

SEQ ID NO: 39667 - RNA, 18 nt, Artificial Sequence
  Description of Artificial Sequence: Synthetic oligonucleotide
aggaaaacacagauuucu

SEQ ID NO: 39668 - RNA, 18 nt, Artificial Sequence
  Description of Artificial Sequence: Synthetic oligonucleotide
uuuacaggaaaacacaga

SEQ ID NO: 39669 - RNA, 18 nt, Artificial Sequence
  Description of Artificial Sequence: Synthetic oligonucleotide
cuauuuuuacaggaaaac

SEQ ID NO: 39670 - RNA, 18 nt, Artificial Sequence
  Description of Artificial Sequence: Synthetic oligonucleotide
uagugcuauuuuuacagg

SEQ ID NO: 39671 - RNA, 18 nt, Artificial Sequence
  Description of Artificial Sequence: Synthetic oligonucleotide
uacuauagugcuauuuuu

SEQ ID NO: 39672 - RNA, 18 nt, Artificial Sequence
  Description of Artificial Sequence: Synthetic oligonucleotide
agugauacuauagugcua

SEQ ID NO: 39673 - RNA, 18 nt, Artificial Sequence
  Description of Artificial Sequence: Synthetic oligonucleotide
guucaagugauacuauag

SEQ ID NO: 39674 - RNA, 18 nt, Artificial Sequence
  Description of Artificial Sequence: Synthetic oligonucleotide
aaauuguucaagugauac

SEQ ID NO: 39675 - RNA, 18 nt, Artificial Sequence
  Description of Artificial Sequence: Synthetic oligonucleotide
aaaucaaauuguucaagu

SEQ ID NO: 39676 - RNA, 18 nt, Artificial Sequence
  Description of Artificial Sequence: Synthetic oligonucleotide
aagccaaaucaaauuguu

SEQ ID NO: 39677 - RNA, 18 nt, Artificial Sequence
  Description of Artificial Sequence: Synthetic oligonucleotide
aaguaaagccaaaucaaa

SEQ ID NO: 39678 - RNA, 18 nt, Artificial Sequence
  Description of Artificial Sequence: Synthetic oligonucleotide
cuaguaaguaaagccaaa

SEQ ID NO: 39679 - RNA, 18 nt, Artificial Sequence
  Description of Artificial Sequence: Synthetic oligonucleotide
gcuuccuaguaaguaaag

SEQ ID NO: 39680 - RNA, 18 nt, Artificial Sequence
  Description of Artificial Sequence: Synthetic oligonucleotide
uccaggcuuccuaguaag

SEQ ID NO: 39681 - RNA, 18 nt, Artificial Sequence
  Description of Artificial Sequence: Synthetic oligonucleotide
ugaauuccaggcuuccua

SEQ ID NO: 39682 - RNA, 18 nt, Artificial Sequence
  Description of Artificial Sequence: Synthetic oligonucleotide
aauaaugaauuccaggcu

SEQ ID NO: 39683 - RNA, 18 nt, Artificial Sequence
  Description of Artificial Sequence: Synthetic oligonucleotide
aaaaaaauaaugaauucc

SEQ ID NO: 39684 - RNA, 18 nt, Artificial Sequence
  Description of Artificial Sequence: Synthetic oligonucleotide
aaaggaaaaaaauaauga

SEQ ID NO: 39685 - RNA, 18 nt, Artificial Sequence
  Description of Artificial Sequence: Synthetic oligonucleotide
acauaaaaggaaaaaaau

SEQ ID NO: 39686 - RNA, 18 nt, Artificial Sequence
  Description of Artificial Sequence: Synthetic oligonucleotide
guggcacauaaaaggaaa

SEQ ID NO: 39687 - RNA, 18 nt, Artificial Sequence
  Description of Artificial Sequence: Synthetic oligonucleotide
ccacaguggcacauaaaa

SEQ ID NO: 39688 - RNA, 18 nt, Artificial Sequence
  Description of Artificial Sequence: Synthetic oligonucleotide
aguagccacaguggcaca

SEQ ID NO: 39689 - RNA, 18 nt, Artificial Sequence
  Description of Artificial Sequence: Synthetic oligonucleotide
uuuaaaguagccacagug

SEQ ID NO: 39690 - RNA, 18 nt, Artificial Sequence
  Description of Artificial Sequence: Synthetic oligonucleotide
agugauuuaaaguagcca

SEQ ID NO: 39691 - RNA, 18 nt, Artificial Sequence
  Description of Artificial Sequence: Synthetic oligonucleotide
cucagagugauuuaaagu

SEQ ID NO: 39692 - RNA, 18 nt, Artificial Sequence
  Description of Artificial Sequence: Synthetic oligonucleotide
uaccucucagagugauuu

SEQ ID NO: 39693 - RNA, 18 nt, Artificial Sequence
  Description of Artificial Sequence: Synthetic oligonucleotide
ccauuuaccucucagagu

SEQ ID NO: 39694 - RNA, 18 nt, Artificial Sequence
  Description of Artificial Sequence: Synthetic oligonucleotide
uauauccauuuaccucuc

SEQ ID NO: 39695 - RNA, 18 nt, Artificial Sequence
  Description of Artificial Sequence: Synthetic oligonucleotide
aauccuauauccauuuac

SEQ ID NO: 39696 - RNA, 18 nt, Artificial Sequence
  Description of Artificial Sequence: Synthetic oligonucleotide
acuucaauccuauaucca

SEQ ID NO: 39697 - RNA, 18 nt, Artificial Sequence
  Description of Artificial Sequence: Synthetic oligonucleotide
acauaacuucaauccuau

SEQ ID NO: 39698 - RNA, 18 nt, Artificial Sequence
  Description of Artificial Sequence: Synthetic oligonucleotide
uacccacauaacuucaau

SEQ ID NO: 39699 - RNA, 18 nt, Artificial Sequence
  Description of Artificial Sequence: Synthetic oligonucleotide
ccaaauacccacauaacu

SEQ ID NO: 39700 - RNA, 18 nt, Artificial Sequence
  Description of Artificial Sequence: Synthetic oligonucleotide
acaugccaaauacccaca

SEQ ID NO: 39701 - RNA, 18 nt, Artificial Sequence
  Description of Artificial Sequence: Synthetic oligonucleotide
cacacacaugccaaauac

SEQ ID NO: 39702 - RNA, 18 nt, Artificial Sequence
  Description of Artificial Sequence: Synthetic oligonucleotide
uuucacacacacaugcca

SEQ ID NO: 39703 - RNA, 18 nt, Artificial Sequence
  Description of Artificial Sequence: Synthetic oligonucleotide
auuuauuucacacacaca

SEQ ID NO: 39704 - RNA, 18 nt, Artificial Sequence
  Description of Artificial Sequence: Synthetic oligonucleotide
uacauauuuauuucacac

SEQ ID NO: 39705 - RNA, 18 nt, Artificial Sequence
  Description of Artificial Sequence: Synthetic oligonucleotide
cuaucuacauauuuauuu

SEQ ID NO: 39706 - RNA, 18 nt, Artificial Sequence
  Description of Artificial Sequence: Synthetic oligonucleotide
ugugacuaucuacauauu

SEQ ID NO: 39707 - RNA, 18 nt, Artificial Sequence
  Description of Artificial Sequence: Synthetic oligonucleotide
guauaugugacuaucuac

SEQ ID NO: 39708 - RNA, 18 nt, Artificial Sequence
  Description of Artificial Sequence: Synthetic oligonucleotide
ucuguguauaugugacua

SEQ ID NO: 39709 - RNA, 18 nt, Artificial Sequence
  Description of Artificial Sequence: Synthetic oligonucleotide
cucagucuguguauaugu

SEQ ID NO: 39710 - RNA, 18 nt, Artificial Sequence
  Description of Artificial Sequence: Synthetic oligonucleotide
uaucucucagucugugua

SEQ ID NO: 39711 - RNA, 18 nt, Artificial Sequence
  Description of Artificial Sequence: Synthetic oligonucleotide
caauuuaucucucagucu

SEQ ID NO: 39712 - RNA, 18 nt, Artificial Sequence
  Description of Artificial Sequence: Synthetic oligonucleotide
aagaacaauuuaucucuc

SEQ ID NO: 39713 - RNA, 18 nt, Artificial Sequence
  Description of Artificial Sequence: Synthetic oligonucleotide
caaucaagaacaauuuau

SEQ ID NO: 39714 - RNA, 18 nt, Artificial Sequence
  Description of Artificial Sequence: Synthetic oligonucleotide
uaaagcaaucaagaacaa

SEQ ID NO: 39715 - RNA, 18 nt, Artificial Sequence
  Description of Artificial Sequence: Synthetic oligonucleotide
gauaauaaagcaaucaag

SEQ ID NO: 39716 - RNA, 18 nt, Artificial Sequence
  Description of Artificial Sequence: Synthetic oligonucleotide
augaugauaauaaagcaa

SEQ ID NO: 39717 - RNA, 18 nt, Artificial Sequence
  Description of Artificial Sequence: Synthetic oligonucleotide
cuaguaugaugauaauaa

SEQ ID NO: 39718 - RNA, 18 nt, Artificial Sequence
  Description of Artificial Sequence: Synthetic oligonucleotide
acacacuaguaugaugau

SEQ ID NO: 39719 - RNA, 18 nt, Artificial Sequence
  Description of Artificial Sequence: Synthetic oligonucleotide
aaugaacacacuaguaug

SEQ ID NO: 39720 - RNA, 18 nt, Artificial Sequence
  Description of Artificial Sequence: Synthetic oligonucleotide
ucuauaaugaacacacua

SEQ ID NO: 39721 - RNA, 18 nt, Artificial Sequence
  Description of Artificial Sequence: Synthetic oligonucleotide
gauacucuauaaugaaca

SEQ ID NO: 39722 - RNA, 18 nt, Artificial Sequence
  Description of Artificial Sequence: Synthetic oligonucleotide
cuacagauacucuauaau

SEQ ID NO: 39723 - RNA, 18 nt, Artificial Sequence
  Description of Artificial Sequence: Synthetic oligonucleotide
caccucuacagauacucu

SEQ ID NO: 39724 - RNA, 18 nt, Artificial Sequence
  Description of Artificial Sequence: Synthetic oligonucleotide
acauucaccucuacagau

SEQ ID NO: 39725 - RNA, 18 nt, Artificial Sequence
  Description of Artificial Sequence: Synthetic oligonucleotide
cuuuuacauucaccucua

SEQ ID NO: 39726 - RNA, 18 nt, Artificial Sequence
  Description of Artificial Sequence: Synthetic oligonucleotide
acuuacuuuuacauucac

SEQ ID NO: 39727 - RNA, 18 nt, Artificial Sequence
  Description of Artificial Sequence: Synthetic oligonucleotide
auuggacuuacuuuuaca

SEQ ID NO: 39728 - RNA, 18 nt, Artificial Sequence
  Description of Artificial Sequence: Synthetic oligonucleotide
aauagauuggacuuacuu

SEQ ID NO: 39729 - RNA, 18 nt, Artificial Sequence
  Description of Artificial Sequence: Synthetic oligonucleotide
aagaaaauagauuggacu

SEQ ID NO: 39730 - RNA, 18 nt, Artificial Sequence
  Description of Artificial Sequence: Synthetic oligonucleotide
gacauaagaaaauagauu

SEQ ID NO: 39731 - RNA, 18 nt, Artificial Sequence
  Description of Artificial Sequence: Synthetic oligonucleotide
ucaaugacauaagaaaau

SEQ ID NO: 39732 - RNA, 18 nt, Artificial Sequence
  Description of Artificial Sequence: Synthetic oligonucleotide
caaauucaaugacauaag

SEQ ID NO: 39733 - RNA, 18 nt, Artificial Sequence
  Description of Artificial Sequence: Synthetic oligonucleotide
cacuacaaauucaaugac

SEQ ID NO: 39734 - RNA, 18 nt, Artificial Sequence
  Description of Artificial Sequence: Synthetic oligonucleotide
guuaacacuacaaauuca

SEQ ID NO: 39735 - RNA, 18 nt, Artificial Sequence
  Description of Artificial Sequence: Synthetic oligonucleotide
ugcaaguuaacacuacaa

SEQ ID NO: 39736 - RNA, 18 nt, Artificial Sequence
  Description of Artificial Sequence: Synthetic oligonucleotide
auauaugcaaguuaacac

SEQ ID NO: 39737 - RNA, 18 nt, Artificial Sequence
  Description of Artificial Sequence: Synthetic oligonucleotide
auaacauauaugcaaguu

SEQ ID NO: 39738 - RNA, 18 nt, Artificial Sequence
  Description of Artificial Sequence: Synthetic oligonucleotide
auccaauaacauauaugc

SEQ ID NO: 39739 - RNA, 18 nt, Artificial Sequence
  Description of Artificial Sequence: Synthetic oligonucleotide
aacccauccaauaacaua

SEQ ID NO: 39740 - RNA, 18 nt, Artificial Sequence
  Description of Artificial Sequence: Synthetic oligonucleotide
aagacaacccauccaaua

SEQ ID NO: 39741 - RNA, 18 nt, Artificial Sequence
  Description of Artificial Sequence: Synthetic oligonucleotide
uuuaaaagacaacccauc

SEQ ID NO: 39742 - RNA, 18 nt, Artificial Sequence
  Description of Artificial Sequence: Synthetic oligonucleotide
aaugcuuuaaaagacaac

SEQ ID NO: 39743 - RNA, 18 nt, Artificial Sequence
  Description of Artificial Sequence: Synthetic oligonucleotide
uaguaaaugcuuuaaaag

SEQ ID NO: 39744 - RNA, 18 nt, Artificial Sequence
  Description of Artificial Sequence: Synthetic oligonucleotide
uacauuaguaaaugcuuu

SEQ ID NO: 39745 - RNA, 18 nt, Artificial Sequence
  Description of Artificial Sequence: Synthetic oligonucleotide
cagaguacauuaguaaau

SEQ ID NO: 39746 - RNA, 18 nt, Artificial Sequence
  Description of Artificial Sequence: Synthetic oligonucleotide
aauuucagaguacauuag

SEQ ID NO: 39747 - RNA, 18 nt, Artificial Sequence
  Description of Artificial Sequence: Synthetic oligonucleotide
uuaaaaauuucagaguac

SEQ ID NO: 39748 - RNA, 18 nt, Artificial Sequence
  Description of Artificial Sequence: Synthetic oligonucleotide
ggcuuuuaaaaauuucag

SEQ ID NO: 39749 - RNA, 18 nt, Artificial Sequence
  Description of Artificial Sequence: Synthetic oligonucleotide
cugaaggcuuuuaaaaau

SEQ ID NO: 39750 - RNA, 18 nt, Artificial Sequence
  Description of Artificial Sequence: Synthetic oligonucleotide
caaaucugaaggcuuuua

SEQ ID NO: 39751 - RNA, 18 nt, Artificial Sequence
  Description of Artificial Sequence: Synthetic oligonucleotide
gaaaacaaaucugaaggc

SEQ ID NO: 39752 - RNA, 18 nt, Artificial Sequence
  Description of Artificial Sequence: Synthetic oligonucleotide
gacuagaaaacaaaucug

SEQ ID NO: 39753 - RNA, 18 nt, Artificial Sequence
  Description of Artificial Sequence: Synthetic oligonucleotide
aaagugacuagaaaacaa

SEQ ID NO: 39754 - RNA, 18 nt, Artificial Sequence
  Description of Artificial Sequence: Synthetic oligonucleotide
ggaaaaaagugacuagaa

SEQ ID NO: 39755 - RNA, 18 nt, Artificial Sequence
  Description of Artificial Sequence: Synthetic oligonucleotide
gauauggaaaaaagugac

SEQ ID NO: 39756 - RNA, 18 nt, Artificial Sequence
  Description of Artificial Sequence: Synthetic oligonucleotide
gaaaugauauggaaaaaa

SEQ ID NO: 39757 - RNA, 18 nt, Artificial Sequence
  Description of Artificial Sequence: Synthetic oligonucleotide
aauuagaaaugauaugga

SEQ ID NO: 39758 - RNA, 18 nt, Artificial Sequence
  Description of Artificial Sequence: Synthetic oligonucleotide
acuauaauuagaaaugau

SEQ ID NO: 39759 - RNA, 18 nt, Artificial Sequence
  Description of Artificial Sequence: Synthetic oligonucleotide
uauaaacuauaauuagaa

SEQ ID NO: 39760 - RNA, 18 nt, Artificial Sequence
  Description of Artificial Sequence: Synthetic oligonucleotide
aaggauauaaacuauaau

SEQ ID NO: 39761 - RNA, 18 nt, Artificial Sequence
  Description of Artificial Sequence: Synthetic oligonucleotide
cuuuuaaggauauaaacu

SEQ ID NO: 39762 - RNA, 18 nt, Artificial Sequence
  Description of Artificial Sequence: Synthetic oligonucleotide
uccuucuuuuaaggauau

SEQ ID NO: 39763 - RNA, 18 nt, Artificial Sequence
  Description of Artificial Sequence: Synthetic oligonucleotide
uggcauccuucuuuuaag

SEQ ID NO: 39764 - RNA, 18 nt, Artificial Sequence
  Description of Artificial Sequence: Synthetic oligonucleotide
uacuguggcauccuucuu

SEQ ID NO: 39765 - RNA, 18 nt, Artificial Sequence
  Description of Artificial Sequence: Synthetic oligonucleotide
cauacuacuguggcaucc

SEQ ID NO: 39766 - RNA, 18 nt, Artificial Sequence
  Description of Artificial Sequence: Synthetic oligonucleotide
uuuuacauacuacugugg

SEQ ID NO: 39767 - RNA, 18 nt, Artificial Sequence
  Description of Artificial Sequence: Synthetic oligonucleotide
uuggguuuuacauacuac

SEQ ID NO: 39768 - RNA, 18 nt, Artificial Sequence
  Description of Artificial Sequence: Synthetic oligonucleotide
cuuguuuggguuuuacau

SEQ ID NO: 39769 - RNA, 18 nt, Artificial Sequence
  Description of Artificial Sequence: Synthetic oligonucleotide
uucuacuuguuuggguuu

SEQ ID NO: 39770 - RNA, 18 nt, Artificial Sequence
  Description of Artificial Sequence: Synthetic oligonucleotide
uuggguucuacuuguuug

SEQ ID NO: 39771 - RNA, 18 nt, Artificial Sequence
  Description of Artificial Sequence: Synthetic oligonucleotide
uuugcuuggguucuacuu

SEQ ID NO: 39772 - RNA, 18 nt, Artificial Sequence
  Description of Artificial Sequence: Synthetic oligonucleotide
uuuuauuugcuuggguuc

SEQ ID NO: 39773 - RNA, 18 nt, Artificial Sequence
  Description of Artificial Sequence: Synthetic oligonucleotide
aauaauuuuauuugcuug

SEQ ID NO: 39774 - RNA, 18 nt, Artificial Sequence
  Description of Artificial Sequence: Synthetic oligonucleotide
uuuuaaauaauuuuauuu

SEQ ID NO: 39775 - RNA, 18 nt, Artificial Sequence
  Description of Artificial Sequence: Synthetic oligonucleotide
aauuauuuuaaauaauuu

SEQ ID NO: 39776 - RNA, 18 nt, Artificial Sequence
  Description of Artificial Sequence: Synthetic oligonucleotide
uuuaaaauuauuuuaaau

SEQ ID NO: 39777 - RNA, 18 nt, Artificial Sequence
  Description of Artificial Sequence: Synthetic oligonucleotide
gccacuuuaaaauuauuu

SEQ ID NO: 39778 - RNA, 18 nt, Artificial Sequence
  Description of Artificial Sequence: Synthetic oligonucleotide
acuaagccacuuuaaaau

SEQ ID NO: 39779 - RNA, 18 nt, Artificial Sequence
  Description of Artificial Sequence: Synthetic oligonucleotide
gcaguacuaagccacuuu

SEQ ID NO: 39780 - RNA, 18 nt, Artificial Sequence
  Description of Artificial Sequence: Synthetic oligonucleotide
gacuggcaguacuaagcc

SEQ ID NO: 39781 - RNA, 18 nt, Artificial Sequence
  Description of Artificial Sequence: Synthetic oligonucleotide
uacaugacuggcaguacu

SEQ ID NO: 39782 - RNA, 18 nt, Artificial Sequence
  Description of Artificial Sequence: Synthetic oligonucleotide
caauuuacaugacuggca

SEQ ID NO: 39783 - RNA, 18 nt, Artificial Sequence
  Description of Artificial Sequence: Synthetic oligonucleotide
agaaucaauuuacaugac

SEQ ID NO: 39784 - RNA, 18 nt, Artificial Sequence
  Description of Artificial Sequence: Synthetic oligonucleotide
ucagcagaaucaauuuac

SEQ ID NO: 39785 - RNA, 18 nt, Artificial Sequence
  Description of Artificial Sequence: Synthetic oligonucleotide
gacccucagcagaaucaa

SEQ ID NO: 39786 - RNA, 18 nt, Artificial Sequence
  Description of Artificial Sequence: Synthetic oligonucleotide
uauaagacccucagcaga

SEQ ID NO: 39787 - RNA, 18 nt, Artificial Sequence
  Description of Artificial Sequence: Synthetic oligonucleotide
auucuuauaagacccuca

SEQ ID NO: 39788 - RNA, 18 nt, Artificial Sequence
  Description of Artificial Sequence: Synthetic oligonucleotide
ucucaauucuuauaagac

SEQ ID NO: 39789 - RNA, 18 nt, Artificial Sequence
  Description of Artificial Sequence: Synthetic oligonucleotide
uuauaucucaauucuuau

SEQ ID NO: 39790 - RNA, 18 nt, Artificial Sequence
  Description of Artificial Sequence: Synthetic oligonucleotide
cauuguuauaucucaauu

SEQ ID NO: 39791 - RNA, 18 nt, Artificial Sequence
  Description of Artificial Sequence: Synthetic oligonucleotide
uuuaccauuguuauaucu

SEQ ID NO: 39792 - RNA, 18 nt, Artificial Sequence
  Description of Artificial Sequence: Synthetic oligonucleotide
cuuguuuuaccauuguua

SEQ ID NO: 39793 - RNA, 18 nt, Artificial Sequence
  Description of Artificial Sequence: Synthetic oligonucleotide
gaaugcuuguuuuaccau

SEQ ID NO: 39794 - RNA, 18 nt, Artificial Sequence
  Description of Artificial Sequence: Synthetic oligonucleotide
ugcuugaaugcuuguuuu

SEQ ID NO: 39795 - RNA, 18 nt, Artificial Sequence
  Description of Artificial Sequence: Synthetic oligonucleotide
aaaagugcuugaaugcuu

SEQ ID NO: 39796 - RNA, 18 nt, Artificial Sequence
  Description of Artificial Sequence: Synthetic oligonucleotide
uuuguaaaagugcuugaa

SEQ ID NO: 39797 - RNA, 18 nt, Artificial Sequence
  Description of Artificial Sequence: Synthetic oligonucleotide
guaauuuuguaaaagugc

SEQ ID NO: 39798 - RNA, 18 nt, Artificial Sequence
  Description of Artificial Sequence: Synthetic oligonucleotide
auuugguaauuuuguaaa

SEQ ID NO: 39799 - RNA, 18 nt, Artificial Sequence
  Description of Artificial Sequence: Synthetic oligonucleotide
uaagaauuugguaauuuu

SEQ ID NO: 39800 - RNA, 18 nt, Artificial Sequence
  Description of Artificial Sequence: Synthetic oligonucleotide
cauuuuaagaauuuggua

SEQ ID NO: 39801 - RNA, 18 nt, Artificial Sequence
  Description of Artificial Sequence: Synthetic oligonucleotide
ggcuucauuuuaagaauu

SEQ ID NO: 39802 - RNA, 18 nt, Artificial Sequence
  Description of Artificial Sequence: Synthetic oligonucleotide
gcuguggcuucauuuuaa

SEQ ID NO: 39803 - RNA, 18 nt, Artificial Sequence
  Description of Artificial Sequence: Synthetic oligonucleotide
gucuagcuguggcuucau

SEQ ID NO: 39804 - RNA, 18 nt, Artificial Sequence
  Description of Artificial Sequence: Synthetic oligonucleotide
ugcaagucuagcuguggc

SEQ ID NO: 39805 - RNA, 18 nt, Artificial Sequence
  Description of Artificial Sequence: Synthetic oligonucleotide
ugaaaugcaagucuagcu

SEQ ID NO: 39806 - RNA, 18 nt, Artificial Sequence
  Description of Artificial Sequence: Synthetic oligonucleotide
auaccugaaaugcaaguc

SEQ ID NO: 39807 - RNA, 18 nt, Artificial Sequence
  Description of Artificial Sequence: Synthetic oligonucleotide
uuuuaauaccugaaaugc

SEQ ID NO: 39808 - RNA, 18 nt, Artificial Sequence
  Description of Artificial Sequence: Synthetic oligonucleotide
agcaauuuuaauaccuga

SEQ ID NO: 39809 - RNA, 18 nt, Artificial Sequence
  Description of Artificial Sequence: Synthetic oligonucleotide
aagaaagcaauuuuaaua

SEQ ID NO: 39810 - RNA, 18 nt, Artificial Sequence
  Description of Artificial Sequence: Synthetic oligonucleotide
caguuaagaaagcaauuu

SEQ ID NO: 39811 - RNA, 18 nt, Artificial Sequence
  Description of Artificial Sequence: Synthetic oligonucleotide
cuugacaguuaagaaagc

SEQ ID NO: 39812 - RNA, 18 nt, Artificial Sequence
  Description of Artificial Sequence: Synthetic oligonucleotide
ugauucuugacaguuaag

SEQ ID NO: 39813 - RNA, 18 nt, Artificial Sequence
  Description of Artificial Sequence: Synthetic oligonucleotide
uuuugugauucuugacag

SEQ ID NO: 39814 - RNA, 18 nt, Artificial Sequence
  Description of Artificial Sequence: Synthetic oligonucleotide
uguuauuuugugauucuu

SEQ ID NO: 39815 - RNA, 18 nt, Artificial Sequence
  Description of Artificial Sequence: Synthetic oligonucleotide
ugauuuguuauuuuguga

SEQ ID NO: 39816 - RNA, 18 nt, Artificial Sequence
  Description of Artificial Sequence: Synthetic oligonucleotide
uaauaugauuuguuauuu

SEQ ID NO: 39817 - RNA, 18 nt, Artificial Sequence
  Description of Artificial Sequence: Synthetic oligonucleotide
acucauaauaugauuugu

SEQ ID NO: 39818 - RNA, 18 nt, Artificial Sequence
  Description of Artificial Sequence: Synthetic oligonucleotide
uauucacucauaauauga

SEQ ID NO: 39819 - RNA, 18 nt, Artificial Sequence
  Description of Artificial Sequence: Synthetic oligonucleotide
ccccauauucacucauaa

SEQ ID NO: 39820 - RNA, 18 nt, Artificial Sequence
  Description of Artificial Sequence: Synthetic oligonucleotide
gcccuccccauauucacu

SEQ ID NO: 39821 - RNA, 18 nt, Artificial Sequence
  Description of Artificial Sequence: Synthetic oligonucleotide
gccccgcccuccccauau

SEQ ID NO: 39822 - RNA, 18 nt, Artificial Sequence
  Description of Artificial Sequence: Synthetic oligonucleotide
gauuggccccgcccuccc

SEQ ID NO: 39823 - RNA, 18 nt, Artificial Sequence
  Description of Artificial Sequence: Synthetic oligonucleotide
ugacugauuggccccgcc

SEQ ID NO: 39824 - RNA, 18 nt, Artificial Sequence
  Description of Artificial Sequence: Synthetic oligonucleotide
aucauugacugauuggcc

SEQ ID NO: 39825 - RNA, 18 nt, Artificial Sequence
  Description of Artificial Sequence: Synthetic oligonucleotide
agauuaucauugacugau

SEQ ID NO: 39826 - RNA, 18 nt, Artificial Sequence
  Description of Artificial Sequence: Synthetic oligonucleotide
uguucagauuaucauuga

SEQ ID NO: 39827 - RNA, 18 nt, Artificial Sequence
  Description of Artificial Sequence: Synthetic oligonucleotide
aaauuuguucagauuauc

SEQ ID NO: 39828 - RNA, 18 nt, Artificial Sequence
  Description of Artificial Sequence: Synthetic oligonucleotide
ucuuaaaauuuguucaga

SEQ ID NO: 39829 - RNA, 18 nt, Artificial Sequence
  Description of Artificial Sequence: Synthetic oligonucleotide
ucugcucuuaaaauuugu

SEQ ID NO: 39830 - RNA, 18 nt, Artificial Sequence
  Description of Artificial Sequence: Synthetic oligonucleotide
uaaaaucugcucuuaaaa

SEQ ID NO: 39831 - RNA, 18 nt, Artificial Sequence
  Description of Artificial Sequence: Synthetic oligonucleotide
uaaucuaaaaucugcucu

SEQ ID NO: 39832 - RNA, 18 nt, Artificial Sequence
  Description of Artificial Sequence: Synthetic oligonucleotide
auuauuaaucuaaaaucu

SEQ ID NO: 39833 - RNA, 18 nt, Artificial Sequence
  Description of Artificial Sequence: Synthetic oligonucleotide
aaaacauuauuaaucuaa

SEQ ID NO: 39834 - RNA, 18 nt, Artificial Sequence
  Description of Artificial Sequence: Synthetic oligonucleotide
gugauaaaacauuauuaa

SEQ ID NO: 39835 - RNA, 18 nt, Artificial Sequence
  Description of Artificial Sequence: Synthetic oligonucleotide
uaguggugauaaaacauu

SEQ ID NO: 39836 - RNA, 18 nt, Artificial Sequence
  Description of Artificial Sequence: Synthetic oligonucleotide
caaauuaguggugauaaa

SEQ ID NO: 39837 - RNA, 18 nt, Artificial Sequence
  Description of Artificial Sequence: Synthetic oligonucleotide
gugggcaaauuaguggug

SEQ ID NO: 39838 - RNA, 18 nt, Artificial Sequence
  Description of Artificial Sequence: Synthetic oligonucleotide
uuguugugggcaaauuag

SEQ ID NO: 39839 - RNA, 18 nt, Artificial Sequence
  Description of Artificial Sequence: Synthetic oligonucleotide
ugaguuuguugugggcaa

SEQ ID NO: 39840 - RNA, 18 nt, Artificial Sequence
  Description of Artificial Sequence: Synthetic oligonucleotide
aauacugaguuuguugug

SEQ ID NO: 39841 - RNA, 18 nt, Artificial Sequence
  Description of Artificial Sequence: Synthetic oligonucleotide
aauuaaauacugaguuug

SEQ ID NO: 39842 - RNA, 18 nt, Artificial Sequence
  Description of Artificial Sequence: Synthetic oligonucleotide
ugaaaaauuaaauacuga

SEQ ID NO: 39843 - RNA, 18 nt, Artificial Sequence
  Description of Artificial Sequence: Synthetic oligonucleotide
uaauuugaaaaauuaaau

SEQ ID NO: 39844 - RNA, 18 nt, Artificial Sequence
  Description of Artificial Sequence: Synthetic oligonucleotide
auauuuaauuugaaaaau

SEQ ID NO: 39845 - RNA, 18 nt, Artificial Sequence
  Description of Artificial Sequence: Synthetic oligonucleotide
auuuaauauuuaauuuga

SEQ ID NO: 39846 - RNA, 18 nt, Artificial Sequence
  Description of Artificial Sequence: Synthetic oligonucleotide
aaauaauuuaauauuuaa

SEQ ID NO: 39847 - RNA, 18 nt, Artificial Sequence
  Description of Artificial Sequence: Synthetic oligonucleotide
uacuuaaauaauuuaaua

SEQ ID NO: 39848 - RNA, 18 nt, Artificial Sequence
  Description of Artificial Sequence: Synthetic oligonucleotide
uaaaauacuuaaauaauu

SEQ ID NO: 39849 - RNA, 18 nt, Artificial Sequence
  Description of Artificial Sequence: Synthetic oligonucleotide
uuauuuaaaauacuuaaa

SEQ ID NO: 39850 - RNA, 18 nt, Artificial Sequence
  Description of Artificial Sequence: Synthetic oligonucleotide
uuuaauuauuuaaaauac

SEQ ID NO: 39851 - RNA, 18 nt, Artificial Sequence
  Description of Artificial Sequence: Synthetic oligonucleotide
aauguuuuaauuauuuaa

SEQ ID NO: 39852 - RNA, 18 nt, Artificial Sequence
  Description of Artificial Sequence: Synthetic oligonucleotide
cauuuaauguuuuaauua

SEQ ID NO: 39853 - RNA, 18 nt, Artificial Sequence
  Description of Artificial Sequence: Synthetic oligonucleotide
guugccauuuaauguuuu

SEQ ID NO: 39854 - RNA, 18 nt, Artificial Sequence
  Description of Artificial Sequence: Synthetic oligonucleotide
augguguugccauuuaau

SEQ ID NO: 39855 - RNA, 18 nt, Artificial Sequence
  Description of Artificial Sequence: Synthetic oligonucleotide
auucuaugguguugccau

SEQ ID NO: 39856 - RNA, 18 nt, Artificial Sequence
  Description of Artificial Sequence: Synthetic oligonucleotide
ccuauauucuaugguguu

SEQ ID NO: 39857 - RNA, 18 nt, Artificial Sequence
  Description of Artificial Sequence: Synthetic oligonucleotide
gaacaccuauauucuaug

SEQ ID NO: 39858 - RNA, 18 nt, Artificial Sequence
  Description of Artificial Sequence: Synthetic oligonucleotide
ccagagaacaccuauauu

SEQ ID NO: 39859 - RNA, 18 nt, Artificial Sequence
  Description of Artificial Sequence: Synthetic oligonucleotide
uagguccagagaacaccu

SEQ ID NO: 39860 - RNA, 18 nt, Artificial Sequence
  Description of Artificial Sequence: Synthetic oligonucleotide
uagaauagguccagagaa

SEQ ID NO: 39861 - RNA, 18 nt, Artificial Sequence
  Description of Artificial Sequence: Synthetic oligonucleotide
gugguuagaauaggucca

SEQ ID NO: 39862 - RNA, 18 nt, Artificial Sequence
  Description of Artificial Sequence: Synthetic oligonucleotide
uuuaagugguuagaauag

SEQ ID NO: 39863 - RNA, 18 nt, Artificial Sequence
  Description of Artificial Sequence: Synthetic oligonucleotide
auaauuuuaagugguuag

SEQ ID NO: 39864 - RNA, 18 nt, Artificial Sequence
  Description of Artificial Sequence: Synthetic oligonucleotide
uuaagauaauuuuaagug

SEQ ID NO: 39865 - RNA, 18 nt, Artificial Sequence
  Description of Artificial Sequence: Synthetic oligonucleotide
cauacuuaagauaauuuu

SEQ ID NO: 39866 - RNA, 18 nt, Artificial Sequence
  Description of Artificial Sequence: Synthetic oligonucleotide
guaugcauacuuaagaua

SEQ ID NO: 39867 - RNA, 18 nt, Artificial Sequence
  Description of Artificial Sequence: Synthetic oligonucleotide
uuuauguaugcauacuua

SEQ ID NO: 39868 - RNA, 18 nt, Artificial Sequence
  Description of Artificial Sequence: Synthetic oligonucleotide
uugcuuuuauguaugcau

SEQ ID NO: 39869 - RNA, 18 nt, Artificial Sequence
  Description of Artificial Sequence: Synthetic oligonucleotide
agugguugcuuuuaugua

SEQ ID NO: 39870 - RNA, 18 nt, Artificial Sequence
  Description of Artificial Sequence: Synthetic oligonucleotide
cucauagugguugcuuuu

SEQ ID NO: 39871 - RNA, 18 nt, Artificial Sequence
  Description of Artificial Sequence: Synthetic oligonucleotide
uaguucucauagugguug

SEQ ID NO: 39872 - RNA, 18 nt, Artificial Sequence
  Description of Artificial Sequence: Synthetic oligonucleotide
cacgguaguucucauagu

SEQ ID NO: 39873 - RNA, 18 nt, Artificial Sequence
  Description of Artificial Sequence: Synthetic oligonucleotide
acuaacacgguaguucuc

SEQ ID NO: 39874 - RNA, 18 nt, Artificial Sequence
  Description of Artificial Sequence: Synthetic oligonucleotide
aaaccacuaacacgguag

SEQ ID NO: 39875 - RNA, 18 nt, Artificial Sequence
  Description of Artificial Sequence: Synthetic oligonucleotide
gugaaaaaccacuaacac

SEQ ID NO: 39876 - RNA, 18 nt, Artificial Sequence
  Description of Artificial Sequence: Synthetic oligonucleotide
aguaagugaaaaaccacu

SEQ ID NO: 39877 - RNA, 18 nt, Artificial Sequence
  Description of Artificial Sequence: Synthetic oligonucleotide
uauacaguaagugaaaaa

SEQ ID NO: 39878 - RNA, 18 nt, Artificial Sequence
  Description of Artificial Sequence: Synthetic oligonucleotide
gguaauauacaguaagug

SEQ ID NO: 39879 - RNA, 18 nt, Artificial Sequence
  Description of Artificial Sequence: Synthetic oligonucleotide
acaaggguaauauacagu

SEQ ID NO: 39880 - RNA, 18 nt, Artificial Sequence
  Description of Artificial Sequence: Synthetic oligonucleotide
uuccuacaaggguaauau

SEQ ID NO: 39881 - RNA, 18 nt, Artificial Sequence
  Description of Artificial Sequence: Synthetic oligonucleotide
aacuauuccuacaagggu

SEQ ID NO: 39882 - RNA, 18 nt, Artificial Sequence
  Description of Artificial Sequence: Synthetic oligonucleotide
ccuuaaacuauuccuaca

SEQ ID NO: 39883 - RNA, 18 nt, Artificial Sequence
  Description of Artificial Sequence: Synthetic oligonucleotide
aauuuccuuaaacuauuc

SEQ ID NO: 39884 - RNA, 18 nt, Artificial Sequence
  Description of Artificial Sequence: Synthetic oligonucleotide
aaaugaauuuccuuaaac

SEQ ID NO: 39885 - RNA, 18 nt, Artificial Sequence
  Description of Artificial Sequence: Synthetic oligonucleotide
uuaagaaaugaauuuccu

SEQ ID NO: 39886 - RNA, 18 nt, Artificial Sequence
  Description of Artificial Sequence: Synthetic oligonucleotide
uauuuuuaagaaaugaau

SEQ ID NO: 39887 - RNA, 18 nt, Artificial Sequence
  Description of Artificial Sequence: Synthetic oligonucleotide
cacuauauuuuuaagaaa

SEQ ID NO: 39888 - RNA, 18 nt, Artificial Sequence
  Description of Artificial Sequence: Synthetic oligonucleotide
gaggacacuauauuuuua

SEQ ID NO: 39889 - RNA, 18 nt, Artificial Sequence
  Description of Artificial Sequence: Synthetic oligonucleotide
uauuugaggacacuauau

SEQ ID NO: 39890 - RNA, 18 nt, Artificial Sequence
  Description of Artificial Sequence: Synthetic oligonucleotide
uuaauuauuugaggacac

SEQ ID NO: 39891 - RNA, 18 nt, Artificial Sequence
  Description of Artificial Sequence: Synthetic oligonucleotide
aaaaauuaauuauuugag

SEQ ID NO: 39892 - RNA, 18 nt, Artificial Sequence
  Description of Artificial Sequence: Synthetic oligonucleotide
ugcaaaaaaauuaauuau

SEQ ID NO: 39893 - RNA, 18 nt, Artificial Sequence
  Description of Artificial Sequence: Synthetic oligonucleotide
aaguuugcaaaaaaauua

SEQ ID NO: 39894 - RNA, 18 nt, Artificial Sequence
  Description of Artificial Sequence: Synthetic oligonucleotide
aacuaaaguuugcaaaaa

SEQ ID NO: 39895 - RNA, 18 nt, Artificial Sequence
  Description of Artificial Sequence: Synthetic oligonucleotide
guaauaacuaaaguuugc

SEQ ID NO: 39896 - RNA, 18 nt, Artificial Sequence
  Description of Artificial Sequence: Synthetic oligonucleotide
ugccuguaauaacuaaag

SEQ ID NO: 39897 - RNA, 18 nt, Artificial Sequence
  Description of Artificial Sequence: Synthetic oligonucleotide
uuugcugccuguaauaac

SEQ ID NO: 39898 - RNA, 18 nt, Artificial Sequence
  Description of Artificial Sequence: Synthetic oligonucleotide
ugguuuuugcugccugua

SEQ ID NO: 39899 - RNA, 18 nt, Artificial Sequence
  Description of Artificial Sequence: Synthetic oligonucleotide
gacagugguuuuugcugc

SEQ ID NO: 39900 - RNA, 18 nt, Artificial Sequence
  Description of Artificial Sequence: Synthetic oligonucleotide
uuucagacagugguuuuu

SEQ ID NO: 39901 - RNA, 18 nt, Artificial Sequence
  Description of Artificial Sequence: Synthetic oligonucleotide
uuuaguuucagacagugg

SEQ ID NO: 39902 - RNA, 18 nt, Artificial Sequence
  Description of Artificial Sequence: Synthetic oligonucleotide
acagauuuaguuucagac

SEQ ID NO: 39903 - RNA, 18 nt, Artificial Sequence
  Description of Artificial Sequence: Synthetic oligonucleotide
ugaacacagauuuaguuu

SEQ ID NO: 39904 - RNA, 18 nt, Artificial Sequence
  Description of Artificial Sequence: Synthetic oligonucleotide
aucuuugaacacagauuu

SEQ ID NO: 39905 - RNA, 18 nt, Artificial Sequence
  Description of Artificial Sequence: Synthetic oligonucleotide
ucuucaucuuugaacaca

SEQ ID NO: 39906 - RNA, 18 nt, Artificial Sequence
  Description of Artificial Sequence: Synthetic oligonucleotide
gggucuucaucuuugaac

SEQ ID NO: 39907 - RNA, 18 nt, Artificial Sequence
  Description of Artificial Sequence: Synthetic oligonucleotide
cuuggcuuuuaaugaggg

SEQ ID NO: 39908 - RNA, 18 nt, Artificial Sequence
  Description of Artificial Sequence: Synthetic oligonucleotide
acguccuuggcuuuuaau

SEQ ID NO: 39909 - RNA, 18 nt, Artificial Sequence
  Description of Artificial Sequence: Synthetic oligonucleotide
uaagaacguccuuggcuu

SEQ ID NO: 39910 - RNA, 18 nt, Artificial Sequence
  Description of Artificial Sequence: Synthetic oligonucleotide
aaucuuaagaacguccuu

SEQ ID NO: 39911 - RNA, 18 nt, Artificial Sequence
  Description of Artificial Sequence: Synthetic oligonucleotide
guuccaaucuuaagaacg

SEQ ID NO: 39912 - RNA, 18 nt, Artificial Sequence
  Description of Artificial Sequence: Synthetic oligonucleotide
ugucaguuccaaucuuaa

SEQ ID NO: 39913 - RNA, 18 nt, Artificial Sequence
  Description of Artificial Sequence: Synthetic oligonucleotide
aauuaugucaguuccaau

SEQ ID NO: 39914 - RNA, 18 nt, Artificial Sequence
  Description of Artificial Sequence: Synthetic oligonucleotide
agacuaauuaugucaguu

SEQ ID NO: 39915 - RNA, 18 nt, Artificial Sequence
  Description of Artificial Sequence: Synthetic oligonucleotide
agucaagacuaauuaugu

SEQ ID NO: 39916 - RNA, 18 nt, Artificial Sequence
  Description of Artificial Sequence: Synthetic oligonucleotide
aaguaagucaagacuaau

SEQ ID NO: 39917 - RNA, 18 nt, Artificial Sequence
  Description of Artificial Sequence: Synthetic oligonucleotide
uaaugaaguaagucaaga

SEQ ID NO: 39918 - RNA, 18 nt, Artificial Sequence
  Description of Artificial Sequence: Synthetic oligonucleotide
ugcuuuaaugaaguaagu

SEQ ID NO: 39919 - RNA, 18 nt, Artificial Sequence
  Description of Artificial Sequence: Synthetic oligonucleotide
aaucuugcuuuaaugaag

SEQ ID NO: 39920 - RNA, 18 nt, Artificial Sequence
  Description of Artificial Sequence: Synthetic oligonucleotide
aauugaaucuugcuuuaa

SEQ ID NO: 39921 - RNA, 18 nt, Artificial Sequence
  Description of Artificial Sequence: Synthetic oligonucleotide
caaggaauugaaucuugc

SEQ ID NO: 39922 - RNA, 18 nt, Artificial Sequence
  Description of Artificial Sequence: Synthetic oligonucleotide
augaacaaggaauugaau

SEQ ID NO: 39923 - RNA, 18 nt, Artificial Sequence
  Description of Artificial Sequence: Synthetic oligonucleotide
cucaaaugaacaaggaau

SEQ ID NO: 39924 - RNA, 18 nt, Artificial Sequence
  Description of Artificial Sequence: Synthetic oligonucleotide
gaacacucaaaugaacaa

SEQ ID NO: 39925 - RNA, 18 nt, Artificial Sequence
  Description of Artificial Sequence: Synthetic oligonucleotide
auaaugaacacucaaaug

SEQ ID NO: 39926 - RNA, 18 nt, Artificial Sequence
  Description of Artificial Sequence: Synthetic oligonucleotide
ggcauauaaugaacacuc

SEQ ID NO: 39927 - RNA, 18 nt, Artificial Sequence
  Description of Artificial Sequence: Synthetic oligonucleotide
ugccuggcauauaaugaa

SEQ ID NO: 39928 - RNA, 18 nt, Artificial Sequence
  Description of Artificial Sequence: Synthetic oligonucleotide
gucaaugccuggcauaua

SEQ ID NO: 39929 - RNA, 18 nt, Artificial Sequence
  Description of Artificial Sequence: Synthetic oligonucleotide
aacuggucaaugccuggc

SEQ ID NO: 39930 - RNA, 18 nt, Artificial Sequence
  Description of Artificial Sequence: Synthetic oligonucleotide
auugcaacuggucaaugc

SEQ ID NO: 39931 - RNA, 18 nt, Artificial Sequence
  Description of Artificial Sequence: Synthetic oligonucleotide
auaaaauugcaacugguc

SEQ ID NO: 39932 - RNA, 18 nt, Artificial Sequence
  Description of Artificial Sequence: Synthetic oligonucleotide
ggaccauaaaauugcaac

SEQ ID NO: 39933 - RNA, 18 nt, Artificial Sequence
  Description of Artificial Sequence: Synthetic oligonucleotide
auucuggaccauaaaauu

SEQ ID NO: 39934 - RNA, 18 nt, Artificial Sequence
  Description of Artificial Sequence: Synthetic oligonucleotide
uauuaauucuggaccaua

SEQ ID NO: 39935 - RNA, 18 nt, Artificial Sequence
  Description of Artificial Sequence: Synthetic oligonucleotide
aauaauauuaauucugga

SEQ ID NO: 39936 - RNA, 18 nt, Artificial Sequence
  Description of Artificial Sequence: Synthetic oligonucleotide
cgaauaauaauauuaauu

SEQ ID NO: 39937 - RNA, 18 nt, Artificial Sequence
  Description of Artificial Sequence: Synthetic oligonucleotide
guuuacgaauaauaauau

SEQ ID NO: 39938 - RNA, 18 nt, Artificial Sequence
  Description of Artificial Sequence: Synthetic oligonucleotide
agcuaguuuacgaauaau

SEQ ID NO: 39939 - RNA, 18 nt, Artificial Sequence
  Description of Artificial Sequence: Synthetic oligonucleotide
auuauagcuaguuuacga

SEQ ID NO: 39940 - RNA, 18 nt, Artificial Sequence
  Description of Artificial Sequence: Synthetic oligonucleotide
acucuauuauagcuaguu

SEQ ID NO: 39941 - RNA, 18 nt, Artificial Sequence
  Description of Artificial Sequence: Synthetic oligonucleotide
uauauacucuauuauagc

SEQ ID NO: 39942 - RNA, 18 nt, Artificial Sequence
  Description of Artificial Sequence: Synthetic oligonucleotide
cacuguauauacucuauu

SEQ ID NO: 39943 - RNA, 18 nt, Artificial Sequence
  Description of Artificial Sequence: Synthetic oligonucleotide
cacagcacuguauauacu

SEQ ID NO: 39944 - RNA, 18 nt, Artificial Sequence
  Description of Artificial Sequence: Synthetic oligonucleotide
auucccacagcacuguau

SEQ ID NO: 39945 - RNA, 18 nt, Artificial Sequence
  Description of Artificial Sequence: Synthetic oligonucleotide
ccuguauucccacagcac

SEQ ID NO: 39946 - RNA, 18 nt, Artificial Sequence
  Description of Artificial Sequence: Synthetic oligonucleotide
cuuccccuguauucccac

SEQ ID NO: 39947 - RNA, 18 nt, Artificial Sequence
  Description of Artificial Sequence: Synthetic oligonucleotide
ugcuucuuccccuguauu

SEQ ID NO: 39948 - RNA, 18 nt, Artificial Sequence
  Description of Artificial Sequence: Synthetic oligonucleotide
uuaauugcuucuuccccu

SEQ ID NO: 39949 - RNA, 18 nt, Artificial Sequence
  Description of Artificial Sequence: Synthetic oligonucleotide
cagauuuaauugcuucuu

SEQ ID NO: 39950 - RNA, 18 nt, Artificial Sequence
  Description of Artificial Sequence: Synthetic oligonucleotide
ucuagcagauuuaauugc

SEQ ID NO: 39951 - RNA, 18 nt, Artificial Sequence
  Description of Artificial Sequence: Synthetic oligonucleotide
acccuucuagcagauuua

SEQ ID NO: 39952 - RNA, 18 nt, Artificial Sequence
  Description of Artificial Sequence: Synthetic oligonucleotide
cucuuacccuucuagcag

SEQ ID NO: 39953 - RNA, 18 nt, Artificial Sequence
  Description of Artificial Sequence: Synthetic oligonucleotide
gauuucucuuacccuucu

SEQ ID NO: 39954 - RNA, 18 nt, Artificial Sequence
  Description of Artificial Sequence: Synthetic oligonucleotide
auacagauuucucuuacc

SEQ ID NO: 39955 - RNA, 18 nt, Artificial Sequence
  Description of Artificial Sequence: Synthetic oligonucleotide
ccugcauacagauuucuc

SEQ ID NO: 39956 - RNA, 18 nt, Artificial Sequence
  Description of Artificial Sequence: Synthetic oligonucleotide
ugccuccugcauacagau

SEQ ID NO: 39957 - RNA, 18 nt, Artificial Sequence
  Description of Artificial Sequence: Synthetic oligonucleotide
agcauugccuccugcaua

SEQ ID NO: 39958 - RNA, 18 nt, Artificial Sequence
  Description of Artificial Sequence: Synthetic oligonucleotide
augcuagcauugccuccu

SEQ ID NO: 39959 - RNA, 18 nt, Artificial Sequence
  Description of Artificial Sequence: Synthetic oligonucleotide
gcuuaaugcuagcauugc

SEQ ID NO: 39960 - RNA, 18 nt, Artificial Sequence
  Description of Artificial Sequence: Synthetic oligonucleotide
ucuuggcuuaaugcuagc

SEQ ID NO: 39961 - RNA, 18 nt, Artificial Sequence
  Description of Artificial Sequence: Synthetic oligonucleotide
cuauuucuuggcuuaaug

SEQ ID NO: 39962 - RNA, 18 nt, Artificial Sequence
  Description of Artificial Sequence: Synthetic oligonucleotide
ucacacuauuucuuggcu

SEQ ID NO: 39963 - RNA, 18 nt, Artificial Sequence
  Description of Artificial Sequence: Synthetic oligonucleotide
ucaccucacacuauuucu

SEQ ID NO: 39964 - RNA, 18 nt, Artificial Sequence
  Description of Artificial Sequence: Synthetic oligonucleotide
uaagaucaccucacacua

SEQ ID NO: 39965 - RNA, 18 nt, Artificial Sequence
  Description of Artificial Sequence: Synthetic oligonucleotide
ugugauaagaucaccuca

SEQ ID NO: 39966 - RNA, 18 nt, Artificial Sequence
  Description of Artificial Sequence: Synthetic oligonucleotide
aucagugugauaagauca

SEQ ID NO: 39967 - RNA, 18 nt, Artificial Sequence
  Description of Artificial Sequence: Synthetic oligonucleotide
aacacaucagugugauaa

SEQ ID NO: 39968 - RNA, 18 nt, Artificial Sequence
  Description of Artificial Sequence: Synthetic oligonucleotide
aguugaacacaucagugu

SEQ ID NO: 39969 - RNA, 18 nt, Artificial Sequence
  Description of Artificial Sequence: Synthetic oligonucleotide
uaaacaguugaacacauc

SEQ ID NO: 39970 - RNA, 18 nt, Artificial Sequence
  Description of Artificial Sequence: Synthetic oligonucleotide
ucccauaaacaguugaac

SEQ ID NO: 39971 - RNA, 18 nt, Artificial Sequence
  Description of Artificial Sequence: Synthetic oligonucleotide
ccuuuucccauaaacagu

SEQ ID NO: 39972 - RNA, 18 nt, Artificial Sequence
  Description of Artificial Sequence: Synthetic oligonucleotide
aguuuccuuuucccauaa

SEQ ID NO: 39973 - RNA, 18 nt, Artificial Sequence
  Description of Artificial Sequence: Synthetic oligonucleotide
auccuaguuuccuuuucc

SEQ ID NO: 39974 - RNA, 18 nt, Artificial Sequence
  Description of Artificial Sequence: Synthetic oligonucleotide
aaaccauccuaguuuccu

SEQ ID NO: 39975 - RNA, 18 nt, Artificial Sequence
  Description of Artificial Sequence: Synthetic oligonucleotide
aaauaaaaccauccuagu

SEQ ID NO: 39976 - RNA, 18 nt, Artificial Sequence
  Description of Artificial Sequence: Synthetic oligonucleotide
uucacaaauaaaaccauc

SEQ ID NO: 39977 - RNA, 18 nt, Artificial Sequence
  Description of Artificial Sequence: Synthetic oligonucleotide
aacauuucacaaauaaaa

SEQ ID NO: 39978 - RNA, 18 nt, Artificial Sequence
  Description of Artificial Sequence: Synthetic oligonucleotide
uguagaacauuucacaaa

SEQ ID NO: 39979 - RNA, 18 nt, Artificial Sequence
  Description of Artificial Sequence: Synthetic oligonucleotide
agcguuguagaacauuuc

SEQ ID NO: 39980 - RNA, 18 nt, Artificial Sequence
  Description of Artificial Sequence: Synthetic oligonucleotide
guucuagcguuguagaac

SEQ ID NO: 39981 - RNA, 18 nt, Artificial Sequence
  Description of Artificial Sequence: Synthetic oligonucleotide
caacaguucuagcguugu

SEQ ID NO: 39982 - RNA, 18 nt, Artificial Sequence
  Description of Artificial Sequence: Synthetic oligonucleotide
aaguucaacaguucuagc

SEQ ID NO: 39983 - RNA, 18 nt, Artificial Sequence
  Description of Artificial Sequence: Synthetic oligonucleotide
ccaagaaguucaacaguu

SEQ ID NO: 39984 - RNA, 18 nt, Artificial Sequence
  Description of Artificial Sequence: Synthetic oligonucleotide
uucucccaagaaguucaa

SEQ ID NO: 39985 - RNA, 18 nt, Artificial Sequence
  Description of Artificial Sequence: Synthetic oligonucleotide
uccuuuucucccaagaag

SEQ ID NO: 39986 - RNA, 18 nt, Artificial Sequence
  Description of Artificial Sequence: Synthetic oligonucleotide
gauucuccuuuucuccca

SEQ ID NO: 39987 - RNA, 18 nt, Artificial Sequence
  Description of Artificial Sequence: Synthetic oligonucleotide
acaaagauucuccuuuuc

SEQ ID NO: 39988 - RNA, 18 nt, Artificial Sequence
  Description of Artificial Sequence: Synthetic oligonucleotide
acaaaacaaagauucucc

SEQ ID NO: 39989 - RNA, 18 nt, Artificial Sequence
  Description of Artificial Sequence: Synthetic oligonucleotide
gcacaacaaaacaaagau

SEQ ID NO: 39990 - RNA, 18 nt, Artificial Sequence
  Description of Artificial Sequence: Synthetic oligonucleotide
acucagcacaacaaaaca

SEQ ID NO: 39991 - RNA, 18 nt, Artificial Sequence
  Description of Artificial Sequence: Synthetic oligonucleotide
aucaaacucagcacaaca

SEQ ID NO: 39992 - RNA, 18 nt, Artificial Sequence
  Description of Artificial Sequence: Synthetic oligonucleotide
aacuaaucaaacucagca

SEQ ID NO: 39993 - RNA, 18 nt, Artificial Sequence
  Description of Artificial Sequence: Synthetic oligonucleotide
uaagcaacuaaucaaacu

SEQ ID NO: 39994 - RNA, 18 nt, Artificial Sequence
  Description of Artificial Sequence: Synthetic oligonucleotide
uugguuaagcaacuaauc

SEQ ID NO: 39995 - RNA, 18 nt, Artificial Sequence
  Description of Artificial Sequence: Synthetic oligonucleotide
ucuacuugguuaagcaac

SEQ ID NO: 39996 - RNA, 18 nt, Artificial Sequence
  Description of Artificial Sequence: Synthetic oligonucleotide
uucuuucuacuugguuaa

SEQ ID NO: 39997 - RNA, 18 nt, Artificial Sequence
  Description of Artificial Sequence: Synthetic oligonucleotide
ugcuuuucuuucuacuug

SEQ ID NO: 39998 - RNA, 18 nt, Artificial Sequence
  Description of Artificial Sequence: Synthetic oligonucleotide
agaugugcuuuucuuucu

SEQ ID NO: 39999 - RNA, 18 nt, Artificial Sequence
  Description of Artificial Sequence: Synthetic oligonucleotide
caggaagaugugcuuuuc

SEQ ID NO: 40000 - RNA, 18 nt, Artificial Sequence
  Description of Artificial Sequence: Synthetic oligonucleotide
gugaucaggaagaugugc

SEQ ID NO: 40001 - RNA, 18 nt, Artificial Sequence
  Description of Artificial Sequence: Synthetic oligonucleotide
uaacugugaucaggaaga

SEQ ID NO: 40002 - RNA, 18 nt, Artificial Sequence
  Description of Artificial Sequence: Synthetic oligonucleotide
uuuuauaacugugaucag

SEQ ID NO: 40003 - RNA, 18 nt, Artificial Sequence
  Description of Artificial Sequence: Synthetic oligonucleotide
guuucuuuuauaacugug

SEQ ID NO: 40004 - RNA, 18 nt, Artificial Sequence
  Description of Artificial Sequence: Synthetic oligonucleotide
ucaggguuucuuuuauaa

SEQ ID NO: 40005 - RNA, 18 nt, Artificial Sequence
  Description of Artificial Sequence: Synthetic oligonucleotide
cggccucaggguuucuuu

SEQ ID NO: 40006 - RNA, 18 nt, Artificial Sequence
  Description of Artificial Sequence: Synthetic oligonucleotide
gcgcccggccucaggguu

SEQ ID NO: 40007 - RNA, 18 nt, Artificial Sequence
  Description of Artificial Sequence: Synthetic oligonucleotide
ccaccgcgcccggccuca

SEQ ID NO: 40008 - RNA, 18 nt, Artificial Sequence
  Description of Artificial Sequence: Synthetic oligonucleotide
uugagccaccgcgcccgg

SEQ ID NO: 40009 - RNA, 18 nt, Artificial Sequence
  Description of Artificial Sequence: Synthetic oligonucleotide
caggcuugagccaccgcg

SEQ ID NO: 40010 - RNA, 18 nt, Artificial Sequence
  Description of Artificial Sequence: Synthetic oligonucleotide
gguuacaggcuugagcca

SEQ ID NO: 40011 - RNA, 18 nt, Artificial Sequence
  Description of Artificial Sequence: Synthetic oligonucleotide
ggguuacaggcuugagcc

SEQ ID NO: 40012 - RNA, 18 nt, Artificial Sequence
  Description of Artificial Sequence: Synthetic oligonucleotide
gccucccaaagugcuggg

SEQ ID NO: 40013 - RNA, 18 nt, Artificial Sequence
  Description of Artificial Sequence: Synthetic oligonucleotide
ccuuggccucccaaagug

SEQ ID NO: 40014 - RNA, 18 nt, Artificial Sequence
  Description of Artificial Sequence: Synthetic oligonucleotide
ucccuccuuggccuccca

SEQ ID NO: 40015 - RNA, 18 nt, Artificial Sequence
  Description of Artificial Sequence: Synthetic oligonucleotide
gauccucccuccuuggcc

SEQ ID NO: 40016 - RNA, 18 nt, Artificial Sequence
  Description of Artificial Sequence: Synthetic oligonucleotide
cuugugauccucccuccu

SEQ ID NO: 40017 - RNA, 18 nt, Artificial Sequence
  Description of Artificial Sequence: Synthetic oligonucleotide
cugaccuugugauccucc

SEQ ID NO: 40018 - RNA, 18 nt, Artificial Sequence
  Description of Artificial Sequence: Synthetic oligonucleotide
aucuccugaccuugugau

SEQ ID NO: 40019 - RNA, 18 nt, Artificial Sequence
  Description of Artificial Sequence: Synthetic oligonucleotide
ucucgaucuccugaccuu

SEQ ID NO: 40020 - RNA, 18 nt, Artificial Sequence
  Description of Artificial Sequence: Synthetic oligonucleotide
gauggucucgaucuccug

SEQ ID NO: 40021 - RNA, 18 nt, Artificial Sequence
  Description of Artificial Sequence: Synthetic oligonucleotide
gccaggauggucucgauc

SEQ ID NO: 40022 - RNA, 18 nt, Artificial Sequence
  Description of Artificial Sequence: Synthetic oligonucleotide
uguuagccaggauggucu

SEQ ID NO: 40023 - RNA, 18 nt, Artificial Sequence
  Description of Artificial Sequence: Synthetic oligonucleotide
caccguguuagccaggau

SEQ ID NO: 40024 - RNA, 18 nt, Artificial Sequence
  Description of Artificial Sequence: Synthetic oligonucleotide
gguuucaccguguuagcc

SEQ ID NO: 40025 - RNA, 18 nt, Artificial Sequence
  Description of Artificial Sequence: Synthetic oligonucleotide
ggguuucaccguguuagc

SEQ ID NO: 40026 - RNA, 18 nt, Artificial Sequence
  Description of Artificial Sequence: Synthetic oligonucleotide
auuuuuaguagagauggg

SEQ ID NO: 40027 - RNA, 18 nt, Artificial Sequence
  Description of Artificial Sequence: Synthetic oligonucleotide
uuuguauuuuuaguagag

SEQ ID NO: 40028 - RNA, 18 nt, Artificial Sequence
  Description of Artificial Sequence: Synthetic oligonucleotide
cuaauuuuguauuuuuag

SEQ ID NO: 40029 - RNA, 18 nt, Artificial Sequence
  Description of Artificial Sequence: Synthetic oligonucleotide
cccagcuaauuuuguauu

SEQ ID NO: 40030 - RNA, 18 nt, Artificial Sequence
  Description of Artificial Sequence: Synthetic oligonucleotide
ccacgcccagcuaauuuu

SEQ ID NO: 40031 - RNA, 18 nt, Artificial Sequence
  Description of Artificial Sequence: Synthetic oligonucleotide
ggccaccacgcccagcua

SEQ ID NO: 40032 - RNA, 18 nt, Artificial Sequence
  Description of Artificial Sequence: Synthetic oligonucleotide
gcgccggccaccacgccc

SEQ ID NO: 40033 - RNA, 18 nt, Artificial Sequence
  Description of Artificial Sequence: Synthetic oligonucleotide
uacaggcgccggccacca

SEQ ID NO: 40034 - RNA, 18 nt, Artificial Sequence
  Description of Artificial Sequence: Synthetic oligonucleotide
gggacuacaggcgccggc

SEQ ID NO: 40035 - RNA, 18 nt, Artificial Sequence
  Description of Artificial Sequence: Synthetic oligonucleotide
uagcugggacuacaggcg

SEQ ID NO: 40036 - RNA, 18 nt, Artificial Sequence
  Description of Artificial Sequence: Synthetic oligonucleotide
augaguagcugggacuac

SEQ ID NO: 40037 - RNA, 18 nt, Artificial Sequence
  Description of Artificial Sequence: Synthetic oligonucleotide
accucaugaguagcuggg

SEQ ID NO: 40038 - RNA, 18 nt, Artificial Sequence
  Description of Artificial Sequence: Synthetic oligonucleotide
ccucaaccucaugaguag

SEQ ID NO: 40039 - RNA, 18 nt, Artificial Sequence
  Description of Artificial Sequence: Synthetic oligonucleotide
uccugccucaaccucaug

SEQ ID NO: 40040 - RNA, 18 nt, Artificial Sequence
  Description of Artificial Sequence: Synthetic oligonucleotide
cauucuccugccucaacc

SEQ ID NO: 40041 - RNA, 18 nt, Artificial Sequence
  Description of Artificial Sequence: Synthetic oligonucleotide
cacgccauucuccugccu

SEQ ID NO: 40042 - RNA, 18 nt, Artificial Sequence
  Description of Artificial Sequence: Synthetic oligonucleotide
cgguucacgccauucucc

SEQ ID NO: 40043 - RNA, 18 nt, Artificial Sequence
  Description of Artificial Sequence: Synthetic oligonucleotide
cuccucgguucacgccau

SEQ ID NO: 40044 - RNA, 18 nt, Artificial Sequence
  Description of Artificial Sequence: Synthetic oligonucleotide
uccgccuccucgguucac

SEQ ID NO: 40045 - RNA, 18 nt, Artificial Sequence
  Description of Artificial Sequence: Synthetic oligonucleotide
caagcuccgccuccucgg

SEQ ID NO: 40046 - RNA, 18 nt, Artificial Sequence
  Description of Artificial Sequence: Synthetic oligonucleotide
cacugcaagcuccgccuc

SEQ ID NO: 40047 - RNA, 18 nt, Artificial Sequence
  Description of Artificial Sequence: Synthetic oligonucleotide
ccacucacugcaagcucc

SEQ ID NO: 40048 - RNA, 18 nt, Artificial Sequence
  Description of Artificial Sequence: Synthetic oligonucleotide
aauuuccacucacugcaa

SEQ ID NO: 40049 - RNA, 18 nt, Artificial Sequence
  Description of Artificial Sequence: Synthetic oligonucleotide
ggcgcaauuuccacucac

SEQ ID NO: 40050 - RNA, 18 nt, Artificial Sequence
  Description of Artificial Sequence: Synthetic oligonucleotide
gcaguggcgcaauuucca

SEQ ID NO: 40051 - RNA, 18 nt, Artificial Sequence
  Description of Artificial Sequence: Synthetic oligonucleotide
ggagugcaguggcgcaau

SEQ ID NO: 40052 - RNA, 18 nt, Artificial Sequence
  Description of Artificial Sequence: Synthetic oligonucleotide
aggcuggagugcaguggc

SEQ ID NO: 40053 - RNA, 18 nt, Artificial Sequence
  Description of Artificial Sequence: Synthetic oligonucleotide
ugcccaggcuggagugca

SEQ ID NO: 40054 - RNA, 18 nt, Artificial Sequence
  Description of Artificial Sequence: Synthetic oligonucleotide
uuuguugcccaggcugga

SEQ ID NO: 40055 - RNA, 18 nt, Artificial Sequence
  Description of Artificial Sequence: Synthetic oligonucleotide
cucacuuuguugcccagg

SEQ ID NO: 40056 - RNA, 18 nt, Artificial Sequence
  Description of Artificial Sequence: Synthetic oligonucleotide
ggagucucacuuuguugc

SEQ ID NO: 40057 - RNA, 18 nt, Artificial Sequence
  Description of Artificial Sequence: Synthetic oligonucleotide
gagauggagucucacuuu

SEQ ID NO: 40058 - RNA, 18 nt, Artificial Sequence
  Description of Artificial Sequence: Synthetic oligonucleotide
uuuuugagauggagucuc

SEQ ID NO: 40059 - RNA, 18 nt, Artificial Sequence
  Description of Artificial Sequence: Synthetic oligonucleotide
uuuuuuuuuugagaugga

SEQ ID NO: 40060 - RNA, 18 nt, Artificial Sequence
  Description of Artificial Sequence: Synthetic oligonucleotide
uuuuuuuuuuuuuuugag

SEQ ID NO: 40061 - RNA, 18 nt, Artificial Sequence
  Description of Artificial Sequence: Synthetic oligonucleotide
uuuuuuuuuuuuuuuuuu

SEQ ID NO: 40062 - RNA, 18 nt, Artificial Sequence
  Description of Artificial Sequence: Synthetic oligonucleotide
uuuuuuuuuuuuuuuuuu

SEQ ID NO: 40063 - RNA, 18 nt, Artificial Sequence
  Description of Artificial Sequence: Synthetic oligonucleotide
uuuuuuuuuuuuuuuuuu

SEQ ID NO: 40064 - RNA, 18 nt, Artificial Sequence
  Description of Artificial Sequence: Synthetic oligonucleotide
cuucuuuuuuuuuuuuuu

SEQ ID NO: 40065 - RNA, 18 nt, Artificial Sequence
  Description of Artificial Sequence: Synthetic oligonucleotide
uucuucuucuuuuuuuuu

SEQ ID NO: 40066 - RNA, 18 nt, Artificial Sequence
  Description of Artificial Sequence: Synthetic oligonucleotide
aggguuucuucuucuuuu

SEQ ID NO: 40067 - RNA, 18 nt, Artificial Sequence
  Description of Artificial Sequence: Synthetic oligonucleotide
ggcucaggguuucuucuu

SEQ ID NO: 40068 - RNA, 18 nt, Artificial Sequence
  Description of Artificial Sequence: Synthetic oligonucleotide
uuaauggcucaggguuuc

SEQ ID NO: 40069 - RNA, 18 nt, Artificial Sequence
  Description of Artificial Sequence: Synthetic oligonucleotide
acacauuaauggcucagg

SEQ ID NO: 40070 - RNA, 18 nt, Artificial Sequence
  Description of Artificial Sequence: Synthetic oligonucleotide
acgagacacauuaauggc

SEQ ID NO: 40071 - RNA, 18 nt, Artificial Sequence
  Description of Artificial Sequence: Synthetic oligonucleotide
aaguuacgagacacauua

SEQ ID NO: 40072 - RNA, 18 nt, Artificial Sequence
  Description of Artificial Sequence: Synthetic oligonucleotide
uccucaaguuacgagaca

SEQ ID NO: 40073 - RNA, 18 nt, Artificial Sequence
  Description of Artificial Sequence: Synthetic oligonucleotide
gaacuuccucaaguuacg

SEQ ID NO: 40074 - RNA, 18 nt, Artificial Sequence
  Description of Artificial Sequence: Synthetic oligonucleotide
uucaugaacuuccucaag

SEQ ID NO: 40075 - RNA, 18 nt, Artificial Sequence
  Description of Artificial Sequence: Synthetic oligonucleotide
gagaauucaugaacuucc

SEQ ID NO: 40076 - RNA, 18 nt, Artificial Sequence
  Description of Artificial Sequence: Synthetic oligonucleotide
gcccagagaauucaugaa

SEQ ID NO: 40077 - RNA, 18 nt, Artificial Sequence
  Description of Artificial Sequence: Synthetic oligonucleotide
augaagcccagagaauuc

SEQ ID NO: 40078 - RNA, 18 nt, Artificial Sequence
  Description of Artificial Sequence: Synthetic oligonucleotide
aauggaugaagcccagag

SEQ ID NO: 40079 - RNA, 18 nt, Artificial Sequence
  Description of Artificial Sequence: Synthetic oligonucleotide
aucuuaauggaugaagcc

SEQ ID NO: 40080 - RNA, 18 nt, Artificial Sequence
  Description of Artificial Sequence: Synthetic oligonucleotide
gaugaaucuuaauggaug

SEQ ID NO: 40081 - RNA, 18 nt, Artificial Sequence
  Description of Artificial Sequence: Synthetic oligonucleotide
auaaggaugaaucuuaau

SEQ ID NO: 40082 - RNA, 18 nt, Artificial Sequence
  Description of Artificial Sequence: Synthetic oligonucleotide
ggagcauaaggaugaauc

SEQ ID NO: 40083 - RNA, 18 nt, Artificial Sequence
  Description of Artificial Sequence: Synthetic oligonucleotide
uugcaggagcauaaggau

SEQ ID NO: 40084 - RNA, 18 nt, Artificial Sequence
  Description of Artificial Sequence: Synthetic oligonucleotide
gaaacuugcaggagcaua

SEQ ID NO: 40085 - RNA, 18 nt, Artificial Sequence
  Description of Artificial Sequence: Synthetic oligonucleotide
uauaagaaacuugcagga

SEQ ID NO: 40086 - RNA, 18 nt, Artificial Sequence
  Description of Artificial Sequence: Synthetic oligonucleotide
auaaauauaagaaacuug

SEQ ID NO: 40087 - RNA, 18 nt, Artificial Sequence
  Description of Artificial Sequence: Synthetic oligonucleotide
aauacauaaauauaagaa

SEQ ID NO: 40088 - RNA, 18 nt, Artificial Sequence
  Description of Artificial Sequence: Synthetic oligonucleotide
auagaaauacauaaauau

SEQ ID NO: 40089 - RNA, 18 nt, Artificial Sequence
  Description of Artificial Sequence: Synthetic oligonucleotide
ucagaauagaaauacaua

SEQ ID NO: 40090 - RNA, 18 nt, Artificial Sequence
  Description of Artificial Sequence: Synthetic oligonucleotide
agaaaucagaauagaaau

SEQ ID NO: 40091 - RNA, 18 nt, Artificial Sequence
  Description of Artificial Sequence: Synthetic oligonucleotide
auuucagaaaucagaaua

SEQ ID NO: 40092 - RNA, 18 nt, Artificial Sequence
  Description of Artificial Sequence: Synthetic oligonucleotide
uuaucauuucagaaauca

SEQ ID NO: 40093 - RNA, 18 nt, Artificial Sequence
  Description of Artificial Sequence: Synthetic oligonucleotide
cuagguuaucauuucaga

SEQ ID NO: 40094 - RNA, 18 nt, Artificial Sequence
  Description of Artificial Sequence: Synthetic oligonucleotide
cacuacuagguuaucauu

SEQ ID NO: 40095 - RNA, 18 nt, Artificial Sequence
  Description of Artificial Sequence: Synthetic oligonucleotide
ucagacacuacuagguua

SEQ ID NO: 40096 - RNA, 18 nt, Artificial Sequence
  Description of Artificial Sequence: Synthetic oligonucleotide
cuucaucagacacuacua

SEQ ID NO: 40097 - RNA, 18 nt, Artificial Sequence
  Description of Artificial Sequence: Synthetic oligonucleotide
aaaaacuucaucagacac

SEQ ID NO: 40098 - RNA, 18 nt, Artificial Sequence
  Description of Artificial Sequence: Synthetic oligonucleotide
caugaaaaaacuucauca

SEQ ID NO: 40099 - RNA, 18 nt, Artificial Sequence
  Description of Artificial Sequence: Synthetic oligonucleotide
auaagcaugaaaaaacuu

SEQ ID NO: 40100 - RNA, 18 nt, Artificial Sequence
  Description of Artificial Sequence: Synthetic oligonucleotide
auaaaauaagcaugaaaa

SEQ ID NO: 40101 - RNA, 18 nt, Artificial Sequence
  Description of Artificial Sequence: Synthetic oligonucleotide
aaagaauaaaauaagcau

SEQ ID NO: 40102 - RNA, 18 nt, Artificial Sequence
  Description of Artificial Sequence: Synthetic oligonucleotide
gugacaaagaauaaaaua

SEQ ID NO: 40103 - RNA, 18 nt, Artificial Sequence
  Description of Artificial Sequence: Synthetic oligonucleotide
caucugugacaaagaaua

SEQ ID NO: 40104 - RNA, 18 nt, Artificial Sequence
  Description of Artificial Sequence: Synthetic oligonucleotide
ucuuucaucugugacaaa

SEQ ID NO: 40105 - RNA, 18 nt, Artificial Sequence
  Description of Artificial Sequence: Synthetic oligonucleotide
auucuucuuucaucugug

SEQ ID NO: 40106 - RNA, 18 nt, Artificial Sequence
  Description of Artificial Sequence: Synthetic oligonucleotide
guccuauucuucuuucau

SEQ ID NO: 40107 - RNA, 18 nt, Artificial Sequence
  Description of Artificial Sequence: Synthetic oligonucleotide
aauuaguccuauucuucu

SEQ ID NO: 40108 - RNA, 18 nt, Artificial Sequence
  Description of Artificial Sequence: Synthetic oligonucleotide
gccccaauuaguccuauu

SEQ ID NO: 40109 - RNA, 18 nt, Artificial Sequence
  Description of Artificial Sequence: Synthetic oligonucleotide
ucuuagccccaauuaguc

SEQ ID NO: 40110 - RNA, 18 nt, Artificial Sequence
  Description of Artificial Sequence: Synthetic oligonucleotide
auucaucuuagccccaau

SEQ ID NO: 40111 - RNA, 18 nt, Artificial Sequence
  Description of Artificial Sequence: Synthetic oligonucleotide
cauuaauucaucuuagcc

SEQ ID NO: 40112 - RNA, 18 nt, Artificial Sequence
  Description of Artificial Sequence: Synthetic oligonucleotide
acuuacauuaauucaucu

SEQ ID NO: 40113 - RNA, 18 nt, Artificial Sequence
  Description of Artificial Sequence: Synthetic oligonucleotide
cugacacuuacauuaauu

SEQ ID NO: 40114 - RNA, 18 nt, Artificial Sequence
  Description of Artificial Sequence: Synthetic oligonucleotide
aguaucugacacuuacau

SEQ ID NO: 40115 - RNA, 18 nt, Artificial Sequence
  Description of Artificial Sequence: Synthetic oligonucleotide
ugccuaguaucugacacu

SEQ ID NO: 40116 - RNA, 18 nt, Artificial Sequence
  Description of Artificial Sequence: Synthetic oligonucleotide
acaccugccuaguaucug

SEQ ID NO: 40117 - RNA, 18 nt, Artificial Sequence
  Description of Artificial Sequence: Synthetic oligonucleotide
cccuaacaccugccuagu

SEQ ID NO: 40118 - RNA, 18 nt, Artificial Sequence
  Description of Artificial Sequence: Synthetic oligonucleotide
uucaucccuaacaccugc

SEQ ID NO: 40119 - RNA, 18 nt, Artificial Sequence
  Description of Artificial Sequence: Synthetic oligonucleotide
aucauuucaucccuaaca

SEQ ID NO: 40120 - RNA, 18 nt, Artificial Sequence
  Description of Artificial Sequence: Synthetic oligonucleotide
cauucaucauuucauccc

SEQ ID NO: 40121 - RNA, 18 nt, Artificial Sequence
  Description of Artificial Sequence: Synthetic oligonucleotide
ugccucauucaucauuuc

SEQ ID NO: 40122 - RNA, 18 nt, Artificial Sequence
  Description of Artificial Sequence: Synthetic oligonucleotide
guccaugccucauucauc

SEQ ID NO: 40123 - RNA, 18 nt, Artificial Sequence
  Description of Artificial Sequence: Synthetic oligonucleotide
aacagguccaugccucau

SEQ ID NO: 40124 - RNA, 18 nt, Artificial Sequence
  Description of Artificial Sequence: Synthetic oligonucleotide
ugaggaacagguccaugc

SEQ ID NO: 40125 - RNA, 18 nt, Artificial Sequence
  Description of Artificial Sequence: Synthetic oligonucleotide
aacucugaggaacagguc

SEQ ID NO: 40126 - RNA, 18 nt, Artificial Sequence
  Description of Artificial Sequence: Synthetic oligonucleotide
ccauaaacucugaggaac

SEQ ID NO: 40127 - RNA, 18 nt, Artificial Sequence
  Description of Artificial Sequence: Synthetic oligonucleotide
cugggccauaaacucuga

SEQ ID NO: 40128 - RNA, 18 nt, Artificial Sequence
  Description of Artificial Sequence: Synthetic oligonucleotide
gucuacugggccauaaac

SEQ ID NO: 40129 - RNA, 18 nt, Artificial Sequence
  Description of Artificial Sequence: Synthetic oligonucleotide
auuaugucuacugggcca

SEQ ID NO: 40130 - RNA, 18 nt, Artificial Sequence
  Description of Artificial Sequence: Synthetic oligonucleotide
auacaauuaugucuacug

SEQ ID NO: 40131 - RNA, 18 nt, Artificial Sequence
  Description of Artificial Sequence: Synthetic oligonucleotide
uccuaauacaauuauguc

SEQ ID NO: 40132 - RNA, 18 nt, Artificial Sequence
  Description of Artificial Sequence: Synthetic oligonucleotide
gaaaguccuaauacaauu

SEQ ID NO: 40133 - RNA, 18 nt, Artificial Sequence
  Description of Artificial Sequence: Synthetic oligonucleotide
cugcagaaaguccuaaua

SEQ ID NO: 40134 - RNA, 18 nt, Artificial Sequence
  Description of Artificial Sequence: Synthetic oligonucleotide
gucaacugcagaaagucc

SEQ ID NO: 40135 - RNA, 18 nt, Artificial Sequence
  Description of Artificial Sequence: Synthetic oligonucleotide
caaaugucaacugcagaa

SEQ ID NO: 40136 - RNA, 18 nt, Artificial Sequence
  Description of Artificial Sequence: Synthetic oligonucleotide
uuaugcaaaugucaacug

SEQ ID NO: 40137 - RNA, 18 nt, Artificial Sequence
  Description of Artificial Sequence: Synthetic oligonucleotide
cagcuuuaugcaaauguc

SEQ ID NO: 40138 - RNA, 18 nt, Artificial Sequence
  Description of Artificial Sequence: Synthetic oligonucleotide
ucagucagcuuuaugcaa

SEQ ID NO: 40139 - RNA, 18 nt, Artificial Sequence
  Description of Artificial Sequence: Synthetic oligonucleotide
uucagucagucagcuuua

SEQ ID NO: 40140 - RNA, 18 nt, Artificial Sequence
  Description of Artificial Sequence: Synthetic oligonucleotide
guuccuucagucagucag

SEQ ID NO: 40141 - RNA, 18 nt, Artificial Sequence
  Description of Artificial Sequence: Synthetic oligonucleotide
uuucuguuccuucaguca

SEQ ID NO: 40142 - RNA, 18 nt, Artificial Sequence
  Description of Artificial Sequence: Synthetic oligonucleotide
cucacuuucuguuccuuc

SEQ ID NO: 40143 - RNA, 18 nt, Artificial Sequence
  Description of Artificial Sequence: Synthetic oligonucleotide
ucugucucacuuucuguu

SEQ ID NO: 40144 - RNA, 18 nt, Artificial Sequence
  Description of Artificial Sequence: Synthetic oligonucleotide
aucugucugucucacuuu

SEQ ID NO: 40145 - RNA, 18 nt, Artificial Sequence
  Description of Artificial Sequence: Synthetic oligonucleotide
gucauaucugucugucuc

SEQ ID NO: 40146 - RNA, 18 nt, Artificial Sequence
  Description of Artificial Sequence: Synthetic oligonucleotide
auuuggucauaucugucu

SEQ ID NO: 40147 - RNA, 18 nt, Artificial Sequence
  Description of Artificial Sequence: Synthetic oligonucleotide
uauaaauuuggucauauc

SEQ ID NO: 40148 - RNA, 18 nt, Artificial Sequence
  Description of Artificial Sequence: Synthetic oligonucleotide
guuuguauaaauuugguc

SEQ ID NO: 40149 - RNA, 18 nt, Artificial Sequence
  Description of Artificial Sequence: Synthetic oligonucleotide
acaugguuuguauaaauu

SEQ ID NO: 40150 - RNA, 18 nt, Artificial Sequence
  Description of Artificial Sequence: Synthetic oligonucleotide
uugguacaugguuuguau

SEQ ID NO: 40151 - RNA, 18 nt, Artificial Sequence
  Description of Artificial Sequence: Synthetic oligonucleotide
aaguguugguacaugguu

SEQ ID NO: 40152 - RNA, 18 nt, Artificial Sequence
  Description of Artificial Sequence: Synthetic oligonucleotide
cuuucaaguguugguaca

SEQ ID NO: 40153 - RNA, 18 nt, Artificial Sequence
  Description of Artificial Sequence: Synthetic oligonucleotide
cccaucuuucaaguguug

SEQ ID NO: 40154 - RNA, 18 nt, Artificial Sequence
  Description of Artificial Sequence: Synthetic oligonucleotide
auccacccaucuuucaag

SEQ ID NO: 40155 - RNA, 18 nt, Artificial Sequence
  Description of Artificial Sequence: Synthetic oligonucleotide
aaaauauccacccaucuu

SEQ ID NO: 40156 - RNA, 18 nt, Artificial Sequence
  Description of Artificial Sequence: Synthetic oligonucleotide
ccuggaaaauauccaccc

SEQ ID NO: 40157 - RNA, 18 nt, Artificial Sequence
  Description of Artificial Sequence: Synthetic oligonucleotide
uguuuccuggaaaauauc

SEQ ID NO: 40158 - RNA, 18 nt, Artificial Sequence
  Description of Artificial Sequence: Synthetic oligonucleotide
aaaucuguuuccuggaaa

SEQ ID NO: 40159 - RNA, 18 nt, Artificial Sequence
  Description of Artificial Sequence: Synthetic oligonucleotide
gcccaaaaucuguuuccu

SEQ ID NO: 40160 - RNA, 18 nt, Artificial Sequence
  Description of Artificial Sequence: Synthetic oligonucleotide
guccugcccaaaaucugu

SEQ ID NO: 40161 - RNA, 18 nt, Artificial Sequence
  Description of Artificial Sequence: Synthetic oligonucleotide
ggaauguccugcccaaaa

SEQ ID NO: 40162 - RNA, 18 nt, Artificial Sequence
  Description of Artificial Sequence: Synthetic oligonucleotide
ugcauggaauguccugcc

SEQ ID NO: 40163 - RNA, 18 nt, Artificial Sequence
  Description of Artificial Sequence: Synthetic oligonucleotide
uccagugcauggaauguc

SEQ ID NO: 40164 - RNA, 18 nt, Artificial Sequence
  Description of Artificial Sequence: Synthetic oligonucleotide
cuauuuccagugcaugga

SEQ ID NO: 40165 - RNA, 18 nt, Artificial Sequence
  Description of Artificial Sequence: Synthetic oligonucleotide
ucaugcuauuuccagugc

SEQ ID NO: 40166 - RNA, 18 nt, Artificial Sequence
  Description of Artificial Sequence: Synthetic oligonucleotide
uuuguucaugcuauuucc

SEQ ID NO: 40167 - RNA, 18 nt, Artificial Sequence
  Description of Artificial Sequence: Synthetic oligonucleotide
augcauuuguucaugcua

SEQ ID NO: 40168 - RNA, 18 nt, Artificial Sequence
  Description of Artificial Sequence: Synthetic oligonucleotide
uuuucaugcauuuguuca

SEQ ID NO: 40169 - RNA, 18 nt, Artificial Sequence
  Description of Artificial Sequence: Synthetic oligonucleotide
ggcaauuuucaugcauuu

SEQ ID NO: 40170 - RNA, 18 nt, Artificial Sequence
  Description of Artificial Sequence: Synthetic oligonucleotide
uuguaggcaauuuucaug

SEQ ID NO: 40171 - RNA, 18 nt, Artificial Sequence
  Description of Artificial Sequence: Synthetic oligonucleotide
gcauguuguaggcaauuu

SEQ ID NO: 40172 - RNA, 18 nt, Artificial Sequence
  Description of Artificial Sequence: Synthetic oligonucleotide
gccaggcauguuguaggc

SEQ ID NO: 40173 - RNA, 18 nt, Artificial Sequence
  Description of Artificial Sequence: Synthetic oligonucleotide
uaugugccaggcauguug

SEQ ID NO: 40174 - RNA, 18 nt, Artificial Sequence
  Description of Artificial Sequence: Synthetic oligonucleotide
acagcuaugugccaggca

SEQ ID NO: 40175 - RNA, 18 nt, Artificial Sequence
  Description of Artificial Sequence: Synthetic oligonucleotide
accucacagcuaugugcc

SEQ ID NO: 40176 - RNA, 18 nt, Artificial Sequence
  Description of Artificial Sequence: Synthetic oligonucleotide
aggguaccucacagcuau

SEQ ID NO: 40177 - RNA, 18 nt, Artificial Sequence
  Description of Artificial Sequence: Synthetic oligonucleotide
cucauaggguaccucaca

SEQ ID NO: 40178 - RNA, 18 nt, Artificial Sequence
  Description of Artificial Sequence: Synthetic oligonucleotide
aacaacucauaggguacc

SEQ ID NO: 40179 - RNA, 18 nt, Artificial Sequence
  Description of Artificial Sequence: Synthetic oligonucleotide
aagucaacaacucauagg

SEQ ID NO: 40180 - RNA, 18 nt, Artificial Sequence
  Description of Artificial Sequence: Synthetic oligonucleotide
uuuucaagucaacaacuc

SEQ ID NO: 40181 - RNA, 18 nt, Artificial Sequence
  Description of Artificial Sequence: Synthetic oligonucleotide
ccauguuuucaagucaac

SEQ ID NO: 40182 - RNA, 18 nt, Artificial Sequence
  Description of Artificial Sequence: Synthetic oligonucleotide
caguuccauguuuucaag

SEQ ID NO: 40183 - RNA, 18 nt, Artificial Sequence
  Description of Artificial Sequence: Synthetic oligonucleotide
cugugcaguuccauguuu

SEQ ID NO: 40184 - RNA, 18 nt, Artificial Sequence
  Description of Artificial Sequence: Synthetic oligonucleotide
augcccugugcaguucca

SEQ ID NO: 40185 - RNA, 18 nt, Artificial Sequence
  Description of Artificial Sequence: Synthetic oligonucleotide
ccugaaugcccugugcag

SEQ ID NO: 40186 - RNA, 18 nt, Artificial Sequence
  Description of Artificial Sequence: Synthetic oligonucleotide
acuugccugaaugcccug

SEQ ID NO: 40187 - RNA, 18 nt, Artificial Sequence
  Description of Artificial Sequence: Synthetic oligonucleotide
cuugcacuugccugaaug

SEQ ID NO: 40188 - RNA, 18 nt, Artificial Sequence
  Description of Artificial Sequence: Synthetic oligonucleotide
aaccacuugcacuugccu

SEQ ID NO: 40189 - RNA, 18 nt, Artificial Sequence
  Description of Artificial Sequence: Synthetic oligonucleotide
cccugaaccacuugcacu

SEQ ID NO: 40190 - RNA, 18 nt, Artificial Sequence
  Description of Artificial Sequence: Synthetic oligonucleotide
cuggccccugaaccacuu

SEQ ID NO: 40191 - RNA, 18 nt, Artificial Sequence
  Description of Artificial Sequence: Synthetic oligonucleotide
cugcgcuggccccugaac

SEQ ID NO: 40192 - RNA, 18 nt, Artificial Sequence
  Description of Artificial Sequence: Synthetic oligonucleotide
cugcucugcgcuggcccc

SEQ ID NO: 40193 - RNA, 18 nt, Artificial Sequence
  Description of Artificial Sequence: Synthetic oligonucleotide
gcacucugcucugcgcug

SEQ ID NO: 40194 - RNA, 18 nt, Artificial Sequence
  Description of Artificial Sequence: Synthetic oligonucleotide
acucagcacucugcucug

SEQ ID NO: 40195 - RNA, 18 nt, Artificial Sequence
  Description of Artificial Sequence: Synthetic oligonucleotide
ucuuuacucagcacucug

SEQ ID NO: 40196 - RNA, 18 nt, Artificial Sequence
  Description of Artificial Sequence: Synthetic oligonucleotide
ugacaucuuuacucagca

SEQ ID NO: 40197 - RNA, 18 nt, Artificial Sequence
  Description of Artificial Sequence: Synthetic oligonucleotide
uuuucugacaucuuuacu

SEQ ID NO: 40198 - RNA, 18 nt, Artificial Sequence
  Description of Artificial Sequence: Synthetic oligonucleotide
uuuccuuuucugacaucu

SEQ ID NO: 40199 - RNA, 18 nt, Artificial Sequence
  Description of Artificial Sequence: Synthetic oligonucleotide
auugcuuuccuuuucuga

SEQ ID NO: 40200 - RNA, 18 nt, Artificial Sequence
  Description of Artificial Sequence: Synthetic oligonucleotide
agaccauugcuuuccuuu

SEQ ID NO: 40201 - RNA, 18 nt, Artificial Sequence
  Description of Artificial Sequence: Synthetic oligonucleotide
guaccagaccauugcuuu

SEQ ID NO: 40202 - RNA, 18 nt, Artificial Sequence
  Description of Artificial Sequence: Synthetic oligonucleotide
gacuuguaccagaccauu

SEQ ID NO: 40203 - RNA, 18 nt, Artificial Sequence
  Description of Artificial Sequence: Synthetic oligonucleotide
uacaagacuuguaccaga

SEQ ID NO: 40204 - RNA, 18 nt, Artificial Sequence
  Description of Artificial Sequence: Synthetic oligonucleotide
uucuauacaagacuugua

SEQ ID NO: 40205 - RNA, 18 nt, Artificial Sequence
  Description of Artificial Sequence: Synthetic oligonucleotide
ucuuguucuauacaagac

SEQ ID NO: 40206 - RNA, 18 nt, Artificial Sequence
  Description of Artificial Sequence: Synthetic oligonucleotide
aaacuucuuguucuauac

SEQ ID NO: 40207 - RNA, 18 nt, Artificial Sequence
  Description of Artificial Sequence: Synthetic oligonucleotide
agucuaaacuucuuguuc

SEQ ID NO: 40208 - RNA, 18 nt, Artificial Sequence
  Description of Artificial Sequence: Synthetic oligonucleotide
ucaaaagucuaaacuucu

SEQ ID NO: 40209 - RNA, 18 nt, Artificial Sequence
  Description of Artificial Sequence: Synthetic oligonucleotide
ccuguucaaaagucuaaa

SEQ ID NO: 40210 - RNA, 18 nt, Artificial Sequence
  Description of Artificial Sequence: Synthetic oligonucleotide
gauugccuguucaaaagu

SEQ ID NO: 40211 - RNA, 18 nt, Artificial Sequence
  Description of Artificial Sequence: Synthetic oligonucleotide
aucucgauugccuguuca

SEQ ID NO: 40212 - RNA, 18 nt, Artificial Sequence
  Description of Artificial Sequence: Synthetic oligonucleotide
cccaaaucucgauugccu

SEQ ID NO: 40213 - RNA, 18 nt, Artificial Sequence
  Description of Artificial Sequence: Synthetic oligonucleotide
ugaaccccaaaucucgau

SEQ ID NO: 40214 - RNA, 18 nt, Artificial Sequence
  Description of Artificial Sequence: Synthetic oligonucleotide
cuuucugaaccccaaauc

SEQ ID NO: 40215 - RNA, 18 nt, Artificial Sequence
  Description of Artificial Sequence: Synthetic oligonucleotide
uuuaucuuucugaacccc

SEQ ID NO: 40216 - RNA, 18 nt, Artificial Sequence
  Description of Artificial Sequence: Synthetic oligonucleotide
ugggauuuaucuuucuga

SEQ ID NO: 40217 - RNA, 18 nt, Artificial Sequence
  Description of Artificial Sequence: Synthetic oligonucleotide
acuuuugggauuuaucuu

SEQ ID NO: 40218 - RNA, 18 nt, Artificial Sequence
  Description of Artificial Sequence: Synthetic oligonucleotide
uccauacuuuugggauuu

SEQ ID NO: 40219 - RNA, 18 nt, Artificial Sequence
  Description of Artificial Sequence: Synthetic oligonucleotide
uguucuccauacuuuugg

SEQ ID NO: 40220 - RNA, 18 nt, Artificial Sequence
  Description of Artificial Sequence: Synthetic oligonucleotide
uccuuuguucuccauacu

SEQ ID NO: 40221 - RNA, 18 nt, Artificial Sequence
  Description of Artificial Sequence: Synthetic oligonucleotide
ugaguuccuuuguucucc

SEQ ID NO: 40222 - RNA, 18 nt, Artificial Sequence
  Description of Artificial Sequence: Synthetic oligonucleotide
uaaaaugaguuccuuugu

SEQ ID NO: 40223 - RNA, 18 nt, Artificial Sequence
  Description of Artificial Sequence: Synthetic oligonucleotide
uccuuuaaaaugaguucc

SEQ ID NO: 40224 - RNA, 18 nt, Artificial Sequence
  Description of Artificial Sequence: Synthetic oligonucleotide
gcuaguccuuuaaaauga

SEQ ID NO: 40225 - RNA, 18 nt, Artificial Sequence
  Description of Artificial Sequence: Synthetic oligonucleotide
ucuuagcuaguccuuuaa

SEQ ID NO: 40226 - RNA, 18 nt, Artificial Sequence
  Description of Artificial Sequence: Synthetic oligonucleotide
gagcaucuuagcuagucc

SEQ ID NO: 40227 - RNA, 18 nt, Artificial Sequence
  Description of Artificial Sequence: Synthetic oligonucleotide
agauugagcaucuuagcu

SEQ ID NO: 40228 - RNA, 18 nt, Artificial Sequence
  Description of Artificial Sequence: Synthetic oligonucleotide
uuuagagauugagcaucu

SEQ ID NO: 40229 - RNA, 18 nt, Artificial Sequence
  Description of Artificial Sequence: Synthetic oligonucleotide
uuuuuuuuagagauugag

SEQ ID NO: 40230 - RNA, 18 nt, Artificial Sequence
  Description of Artificial Sequence: Synthetic oligonucleotide
uccuuuuuuuuuuagaga

SEQ ID NO: 40231 - RNA, 18 nt, Artificial Sequence
  Description of Artificial Sequence: Synthetic oligonucleotide
acagauccuuuuuuuuuu

SEQ ID NO: 40232 - RNA, 18 nt, Artificial Sequence
  Description of Artificial Sequence: Synthetic oligonucleotide
cgaauacagauccuuuuu

SEQ ID NO: 40233 - RNA, 18 nt, Artificial Sequence
  Description of Artificial Sequence: Synthetic oligonucleotide
ucucacgaauacagaucc

SEQ ID NO: 40234 - RNA, 18 nt, Artificial Sequence
  Description of Artificial Sequence: Synthetic oligonucleotide
ucuacucucacgaauaca

SEQ ID NO: 40235 - RNA, 18 nt, Artificial Sequence
  Description of Artificial Sequence: Synthetic oligonucleotide
uucucucuacucucacga

SEQ ID NO: 40236 - RNA, 18 nt, Artificial Sequence
  Description of Artificial Sequence: Synthetic oligonucleotide
aaccuuucucucuacucu

SEQ ID NO: 40237 - RNA, 18 nt, Artificial Sequence
  Description of Artificial Sequence: Synthetic oligonucleotide
uaaacaaccuuucucucu

SEQ ID NO: 40238 - RNA, 18 nt, Artificial Sequence
  Description of Artificial Sequence: Synthetic oligonucleotide
cuuccuaaacaaccuuuc

SEQ ID NO: 40239 - RNA, 18 nt, Artificial Sequence
  Description of Artificial Sequence: Synthetic oligonucleotide
ugacucuuccuaaacaac

SEQ ID NO: 40240 - RNA, 18 nt, Artificial Sequence
  Description of Artificial Sequence: Synthetic oligonucleotide
ucuguugacucuuccuaa

SEQ ID NO: 40241 - RNA, 18 nt, Artificial Sequence
  Description of Artificial Sequence: Synthetic oligonucleotide
uaaagucuguugacucuu

SEQ ID NO: 40242 - RNA, 18 nt, Artificial Sequence
  Description of Artificial Sequence: Synthetic oligonucleotide
uuugcuaaagucuguuga

SEQ ID NO: 40243 - RNA, 18 nt, Artificial Sequence
  Description of Artificial Sequence: Synthetic oligonucleotide
aggauuuugcuaaagucu

SEQ ID NO: 40244 - RNA, 18 nt, Artificial Sequence
  Description of Artificial Sequence: Synthetic oligonucleotide
auaaaaggauuuugcuaa

SEQ ID NO: 40245 - RNA, 18 nt, Artificial Sequence
  Description of Artificial Sequence: Synthetic oligonucleotide
aucaaauaaaaggauuuu

SEQ ID NO: 40246 - RNA, 18 nt, Artificial Sequence
  Description of Artificial Sequence: Synthetic oligonucleotide
caugaaucaaauaaaagg

SEQ ID NO: 40247 - RNA, 18 nt, Artificial Sequence
  Description of Artificial Sequence: Synthetic oligonucleotide
uuaugcaugaaucaaaua

SEQ ID NO: 40248 - RNA, 18 nt, Artificial Sequence
  Description of Artificial Sequence: Synthetic oligonucleotide
aggaguuaugcaugaauc

SEQ ID NO: 40249 - RNA, 18 nt, Artificial Sequence
  Description of Artificial Sequence: Synthetic oligonucleotide
ccaucaggaguuaugcau

SEQ ID NO: 40250 - RNA, 18 nt, Artificial Sequence
  Description of Artificial Sequence: Synthetic oligonucleotide
acacuccaucaggaguua

SEQ ID NO: 40251 - RNA, 18 nt, Artificial Sequence
  Description of Artificial Sequence: Synthetic oligonucleotide
ccuugacacuccaucagg

SEQ ID NO: 40252 - RNA, 18 nt, Artificial Sequence
  Description of Artificial Sequence: Synthetic oligonucleotide
gucuuccuugacacucca

SEQ ID NO: 40253 - RNA, 18 nt, Artificial Sequence
  Description of Artificial Sequence: Synthetic oligonucleotide
aaugagucuuccuugaca

SEQ ID NO: 40254 - RNA, 18 nt, Artificial Sequence
  Description of Artificial Sequence: Synthetic oligonucleotide
aagugaaugagucuuccu

SEQ ID NO: 40255 - RNA, 18 nt, Artificial Sequence
  Description of Artificial Sequence: Synthetic oligonucleotide
aagaaaagugaaugaguc

SEQ ID NO: 40256 - RNA, 18 nt, Artificial Sequence
  Description of Artificial Sequence: Synthetic oligonucleotide
caggaaagaaaagugaau

SEQ ID NO: 40257 - RNA, 18 nt, Artificial Sequence
  Description of Artificial Sequence: Synthetic oligonucleotide
ucuggcaggaaagaaaag

SEQ ID NO: 40258 - RNA, 18 nt, Artificial Sequence
  Description of Artificial Sequence: Synthetic oligonucleotide
aacuuucuggcaggaaag

SEQ ID NO: 40259 - RNA, 18 nt, Artificial Sequence
  Description of Artificial Sequence: Synthetic oligonucleotide
gaaccaacuuucuggcag

SEQ ID NO: 40260 - RNA, 18 nt, Artificial Sequence
  Description of Artificial Sequence: Synthetic oligonucleotide
ugcaagaaccaacuuucu

SEQ ID NO: 40261 - RNA, 18 nt, Artificial Sequence
  Description of Artificial Sequence: Synthetic oligonucleotide
uauuuugcaagaaccaac

SEQ ID NO: 40262 - RNA, 18 nt, Artificial Sequence
  Description of Artificial Sequence: Synthetic oligonucleotide
uaaucuauuuugcaagaa

SEQ ID NO: 40263 - RNA, 18 nt, Artificial Sequence
  Description of Artificial Sequence: Synthetic oligonucleotide
caaguuaaucuauuuugc

SEQ ID NO: 40264 - RNA, 18 nt, Artificial Sequence
  Description of Artificial Sequence: Synthetic oligonucleotide
gucaucaaguuaaucuau

SEQ ID NO: 40265 - RNA, 18 nt, Artificial Sequence
  Description of Artificial Sequence: Synthetic oligonucleotide
acauagucaucaaguuaa

SEQ ID NO: 40266 - RNA, 18 nt, Artificial Sequence
  Description of Artificial Sequence: Synthetic oligonucleotide
uauacacauagucaucaa

SEQ ID NO: 40267 - RNA, 18 nt, Artificial Sequence
  Description of Artificial Sequence: Synthetic oligonucleotide
uccaauauacacauaguc

SEQ ID NO: 40268 - RNA, 18 nt, Artificial Sequence
  Description of Artificial Sequence: Synthetic oligonucleotide
gaguauccaauauacaca

SEQ ID NO: 40269 - RNA, 18 nt, Artificial Sequence
  Description of Artificial Sequence: Synthetic oligonucleotide
auuaggaguauccaauau

SEQ ID NO: 40270 - RNA, 18 nt, Artificial Sequence
  Description of Artificial Sequence: Synthetic oligonucleotide
cuaaaauuaggaguaucc

SEQ ID NO: 40271 - RNA, 18 nt, Artificial Sequence
  Description of Artificial Sequence: Synthetic oligonucleotide
cagagcuaaaauuaggag

SEQ ID NO: 40272 - RNA, 18 nt, Artificial Sequence
  Description of Artificial Sequence: Synthetic oligonucleotide
ucuaacagagcuaaaauu

SEQ ID NO: 40273 - RNA, 18 nt, Artificial Sequence
  Description of Artificial Sequence: Synthetic oligonucleotide
acauaucuaacagagcua

SEQ ID NO: 40274 - RNA, 18 nt, Artificial Sequence
  Description of Artificial Sequence: Synthetic oligonucleotide
aagaaacauaucuaacag

SEQ ID NO: 40275 - RNA, 18 nt, Artificial Sequence
  Description of Artificial Sequence: Synthetic oligonucleotide
uuagaaagaaacauaucu

SEQ ID NO: 40276 - RNA, 18 nt, Artificial Sequence
  Description of Artificial Sequence: Synthetic oligonucleotide
uguccuuagaaagaaaca

SEQ ID NO: 40277 - RNA, 18 nt, Artificial Sequence
  Description of Artificial Sequence: Synthetic oligonucleotide
uugcuuguccuuagaaag

SEQ ID NO: 40278 - RNA, 18 nt, Artificial Sequence
  Description of Artificial Sequence: Synthetic oligonucleotide
cauaguugcuuguccuua

SEQ ID NO: 40279 - RNA, 18 nt, Artificial Sequence
  Description of Artificial Sequence: Synthetic oligonucleotide
cuauacauaguugcuugu

SEQ ID NO: 40280 - RNA, 18 nt, Artificial Sequence
  Description of Artificial Sequence: Synthetic oligonucleotide
caagucuauacauaguug

SEQ ID NO: 40281 - RNA, 18 nt, Artificial Sequence
  Description of Artificial Sequence: Synthetic oligonucleotide
aacaacaagucuauacau

SEQ ID NO: 40282 - RNA, 18 nt, Artificial Sequence
  Description of Artificial Sequence: Synthetic oligonucleotide
auucaaacaacaagucua

SEQ ID NO: 40283 - RNA, 18 nt, Artificial Sequence
  Description of Artificial Sequence: Synthetic oligonucleotide
aaaaaauucaaacaacaa

SEQ ID NO: 40284 - RNA, 18 nt, Artificial Sequence
  Description of Artificial Sequence: Synthetic oligonucleotide
cugaaaaaaaauucaaac

SEQ ID NO: 40285 - RNA, 18 nt, Artificial Sequence
  Description of Artificial Sequence: Synthetic oligonucleotide
auauacugaaaaaaaauu

SEQ ID NO: 40286 - RNA, 18 nt, Artificial Sequence
  Description of Artificial Sequence: Synthetic oligonucleotide
cauauauauacugaaaaa

SEQ ID NO: 40287 - RNA, 18 nt, Artificial Sequence
  Description of Artificial Sequence: Synthetic oligonucleotide
agaaacauauauauacug

SEQ ID NO: 40288 - RNA, 18 nt, Artificial Sequence
  Description of Artificial Sequence: Synthetic oligonucleotide
aaacaagaaacauauaua

SEQ ID NO: 40289 - RNA, 18 nt, Artificial Sequence
  Description of Artificial Sequence: Synthetic oligonucleotide
uagaaaaacaagaaacau

SEQ ID NO: 40290 - RNA, 18 nt, Artificial Sequence
  Description of Artificial Sequence: Synthetic oligonucleotide
aaaaauagaaaaacaaga

SEQ ID NO: 40291 - RNA, 18 nt, Artificial Sequence
  Description of Artificial Sequence: Synthetic oligonucleotide
aguagaaaaauagaaaaa

SEQ ID NO: 40292 - RNA, 18 nt, Artificial Sequence
  Description of Artificial Sequence: Synthetic oligonucleotide
uaugaaguagaaaaauag

SEQ ID NO: 40293 - RNA, 18 nt, Artificial Sequence
  Description of Artificial Sequence: Synthetic oligonucleotide
aacaguaugaaguagaaa

SEQ ID NO: 40294 - RNA, 18 nt, Artificial Sequence
  Description of Artificial Sequence: Synthetic oligonucleotide
acauuaacaguaugaagu

SEQ ID NO: 40295 - RNA, 18 nt, Artificial Sequence
  Description of Artificial Sequence: Synthetic oligonucleotide
auuugacauuaacaguau

SEQ ID NO: 40296 - RNA, 18 nt, Artificial Sequence
  Description of Artificial Sequence: Synthetic oligonucleotide
uugauauuugacauuaac

SEQ ID NO: 40297 - RNA, 18 nt, Artificial Sequence
  Description of Artificial Sequence: Synthetic oligonucleotide
cauuuuugauauuugaca

SEQ ID NO: 40298 - RNA, 18 nt, Artificial Sequence
  Description of Artificial Sequence: Synthetic oligonucleotide
gaaaacauuuuugauauu

SEQ ID NO: 40299 - RNA, 18 nt, Artificial Sequence
  Description of Artificial Sequence: Synthetic oligonucleotide
ugcuggaaaacauuuuug

SEQ ID NO: 40300 - RNA, 18 nt, Artificial Sequence
  Description of Artificial Sequence: Synthetic oligonucleotide
gauauugcuggaaaacau

SEQ ID NO: 40301 - RNA, 18 nt, Artificial Sequence
  Description of Artificial Sequence: Synthetic oligonucleotide
aacuugauauugcuggaa

SEQ ID NO: 40302 - RNA, 18 nt, Artificial Sequence
  Description of Artificial Sequence: Synthetic oligonucleotide
gccauaacuugauauugc

SEQ ID NO: 40303 - RNA, 18 nt, Artificial Sequence
  Description of Artificial Sequence: Synthetic oligonucleotide
ccauugccauaacuugau

SEQ ID NO: 40304 - RNA, 18 nt, Artificial Sequence
  Description of Artificial Sequence: Synthetic oligonucleotide
uuuugccauugccauaac

SEQ ID NO: 40305 - RNA, 18 nt, Artificial Sequence
  Description of Artificial Sequence: Synthetic oligonucleotide
aggacuuuugccauugcc

SEQ ID NO: 40306 - RNA, 18 nt, Artificial Sequence
  Description of Artificial Sequence: Synthetic oligonucleotide
caacaaggacuuuugcca

SEQ ID NO: 40307 - RNA, 18 nt, Artificial Sequence
  Description of Artificial Sequence: Synthetic oligonucleotide
aucuacaacaaggacuuu

SEQ ID NO: 40308 - RNA, 18 nt, Artificial Sequence
  Description of Artificial Sequence: Synthetic oligonucleotide
uucucaucuacaacaagg

SEQ ID NO: 40309 - RNA, 18 nt, Artificial Sequence
  Description of Artificial Sequence: Synthetic oligonucleotide
uaugcuucucaucuacaa

SEQ ID NO: 40310 - RNA, 18 nt, Artificial Sequence
  Description of Artificial Sequence: Synthetic oligonucleotide
ucuuauaugcuucucauc

SEQ ID NO: 40311 - RNA, 18 nt, Artificial Sequence
  Description of Artificial Sequence: Synthetic oligonucleotide
ccauuucuuauaugcuuc

SEQ ID NO: 40312 - RNA, 18 nt, Artificial Sequence
  Description of Artificial Sequence: Synthetic oligonucleotide
ggcaaccauuucuuauau

SEQ ID NO: 40313 - RNA, 18 nt, Artificial Sequence
  Description of Artificial Sequence: Synthetic oligonucleotide
agauuggcaaccauuucu

SEQ ID NO: 40314 - RNA, 18 nt, Artificial Sequence
  Description of Artificial Sequence: Synthetic oligonucleotide
aacaaagauuggcaacca

SEQ ID NO: 40315 - RNA, 18 nt, Artificial Sequence
  Description of Artificial Sequence: Synthetic oligonucleotide
uacaaaacaaagauuggc

SEQ ID NO: 40316 - RNA, 18 nt, Artificial Sequence
  Description of Artificial Sequence: Synthetic oligonucleotide
gaucauacaaaacaaaga

SEQ ID NO: 40317 - RNA, 18 nt, Artificial Sequence
  Description of Artificial Sequence: Synthetic oligonucleotide
aaauagaucauacaaaac

SEQ ID NO: 40318 - RNA, 18 nt, Artificial Sequence
  Description of Artificial Sequence: Synthetic oligonucleotide
acucuaaauagaucauac

SEQ ID NO: 40319 - RNA, 18 nt, Artificial Sequence
  Description of Artificial Sequence: Synthetic oligonucleotide
uuaaaacucuaaauagau

SEQ ID NO: 40320 - RNA, 18 nt, Artificial Sequence
  Description of Artificial Sequence: Synthetic oligonucleotide
guugguuaaaacucuaaa

SEQ ID NO: 40321 - RNA, 18 nt, Artificial Sequence
  Description of Artificial Sequence: Synthetic oligonucleotide
ucuagguugguuaaaacu

SEQ ID NO: 40322 - RNA, 18 nt, Artificial Sequence
  Description of Artificial Sequence: Synthetic oligonucleotide
acagaucuagguugguua

SEQ ID NO: 40323 - RNA, 18 nt, Artificial Sequence
  Description of Artificial Sequence: Synthetic oligonucleotide
agcugacagaucuagguu

SEQ ID NO: 40324 - RNA, 18 nt, Artificial Sequence
  Description of Artificial Sequence: Synthetic oligonucleotide
agcuuagcugacagaucu

SEQ ID NO: 40325 - RNA, 18 nt, Artificial Sequence
  Description of Artificial Sequence: Synthetic oligonucleotide
aaauuagcuuagcugaca

SEQ ID NO: 40326 - RNA, 18 nt, Artificial Sequence
  Description of Artificial Sequence: Synthetic oligonucleotide
auauaaaauuagcuuagc

SEQ ID NO: 40327 - RNA, 18 nt, Artificial Sequence
  Description of Artificial Sequence: Synthetic oligonucleotide
accaaauauaaaauuagc

SEQ ID NO: 40328 - RNA, 18 nt, Artificial Sequence
  Description of Artificial Sequence: Synthetic oligonucleotide
uguauaccaaauauaaaa

SEQ ID NO: 40329 - RNA, 18 nt, Artificial Sequence
  Description of Artificial Sequence: Synthetic oligonucleotide
augcauguauaccaaaua

SEQ ID NO: 40330 - RNA, 18 nt, Artificial Sequence
  Description of Artificial Sequence: Synthetic oligonucleotide
uugacaugcauguauacc

SEQ ID NO: 40331 - RNA, 18 nt, Artificial Sequence
  Description of Artificial Sequence: Synthetic oligonucleotide
uuuauuugacaugcaugu

SEQ ID NO: 40332 - RNA, 18 nt, Artificial Sequence
  Description of Artificial Sequence: Synthetic oligonucleotide
uuaacuuuauuugacaug

SEQ ID NO: 40333 - RNA, 18 nt, Artificial Sequence
  Description of Artificial Sequence: Synthetic oligonucleotide
uaaaauuaacuuuauuug

SEQ ID NO: 40334 - RNA, 18 nt, Artificial Sequence
  Description of Artificial Sequence: Synthetic oligonucleotide
guauguaaaauuaacuuu

SEQ ID NO: 40335 - RNA, 18 nt, Artificial Sequence
  Description of Artificial Sequence: Synthetic oligonucleotide
caccaccuccagcauggg

SEQ ID NO: 40336 - RNA, 18 nt, Artificial Sequence
  Description of Artificial Sequence: Synthetic oligonucleotide
aaagacaccaccuccagc

SEQ ID NO: 40337 - RNA, 18 nt, Artificial Sequence
  Description of Artificial Sequence: Synthetic oligonucleotide
guaguaaagacaccaccu

SEQ ID NO: 40338 - RNA, 18 nt, Artificial Sequence
  Description of Artificial Sequence: Synthetic oligonucleotide
cuccaguaguaaagacac

SEQ ID NO: 40339 - RNA, 18 nt, Artificial Sequence
  Description of Artificial Sequence: Synthetic oligonucleotide
agcuucuccaguaguaaa

SEQ ID NO: 40340 - RNA, 18 nt, Artificial Sequence
  Description of Artificial Sequence: Synthetic oligonucleotide
ggagcagcuucuccagua

SEQ ID NO: 40341 - RNA, 18 nt, Artificial Sequence
  Description of Artificial Sequence: Synthetic oligonucleotide
gaugaggagcagcuucuc

SEQ ID NO: 40342 - RNA, 18 nt, Artificial Sequence
  Description of Artificial Sequence: Synthetic oligonucleotide
uuggagaugaggagcagc

SEQ ID NO: 40343 - RNA, 18 nt, Artificial Sequence
  Description of Artificial Sequence: Synthetic oligonucleotide
ugaaguuggagaugagga

SEQ ID NO: 40344 - RNA, 18 nt, Artificial Sequence
  Description of Artificial Sequence: Synthetic oligonucleotide
gagcgugaaguuggagau

SEQ ID NO: 40345 - RNA, 18 nt, Artificial Sequence
  Description of Artificial Sequence: Synthetic oligonucleotide
cuaaagagcgugaaguug

SEQ ID NO: 40346 - RNA, 18 nt, Artificial Sequence
  Description of Artificial Sequence: Synthetic oligonucleotide
ccgaacuaaagagcguga

SEQ ID NO: 40347 - RNA, 18 nt, Artificial Sequence
  Description of Artificial Sequence: Synthetic oligonucleotide
ggcgcccgaacuaaagag

SEQ ID NO: 40348 - RNA, 18 nt, Artificial Sequence
  Description of Artificial Sequence: Synthetic oligonucleotide
cccgcggcgcccgaacua

SEQ ID NO: 40349 - RNA, 18 nt, Artificial Sequence
  Description of Artificial Sequence: Synthetic oligonucleotide
cuucgcccgcggcgcccg

SEQ ID NO: 40350 - RNA, 18 nt, Artificial Sequence
  Description of Artificial Sequence: Synthetic oligonucleotide
uuugucuucgcccgcggc

SEQ ID NO: 40351 - RNA, 18 nt, Artificial Sequence
  Description of Artificial Sequence: Synthetic oligonucleotide
cucccuuugucuucgccc

SEQ ID NO: 40352 - RNA, 18 nt, Artificial Sequence
  Description of Artificial Sequence: Synthetic oligonucleotide
uguuccucccuuugucuu

SEQ ID NO: 40353 - RNA, 18 nt, Artificial Sequence
  Description of Artificial Sequence: Synthetic oligonucleotide
aaaacuguuccucccuuu

SEQ ID NO: 40354 - RNA, 18 nt, Artificial Sequence
  Description of Artificial Sequence: Synthetic oligonucleotide
ucauaaaaacuguuccuc

SEQ ID NO: 40355 - RNA, 18 nt, Artificial Sequence
  Description of Artificial Sequence: Synthetic oligonucleotide
ugguuucauaaaaacugu

SEQ ID NO: 40356 - RNA, 18 nt, Artificial Sequence
  Description of Artificial Sequence: Synthetic oligonucleotide
agagcugguuucauaaaa

SEQ ID NO: 40357 - RNA, 18 nt, Artificial Sequence
  Description of Artificial Sequence: Synthetic oligonucleotide
uggaaagagcugguuuca

SEQ ID NO: 40358 - RNA, 18 nt, Artificial Sequence
  Description of Artificial Sequence: Synthetic oligonucleotide
cucgguggaaagagcugg

SEQ ID NO: 40359 - RNA, 18 nt, Artificial Sequence
  Description of Artificial Sequence: Synthetic oligonucleotide
gucgccucgguggaaaga

SEQ ID NO: 40360 - RNA, 18 nt, Artificial Sequence
  Description of Artificial Sequence: Synthetic oligonucleotide
agcacgucgccucggugg

SEQ ID NO: 40361 - RNA, 18 nt, Artificial Sequence
  Description of Artificial Sequence: Synthetic oligonucleotide
ccuccagcacgucgccuc

SEQ ID NO: 40362 - RNA, 18 nt, Artificial Sequence
  Description of Artificial Sequence: Synthetic oligonucleotide
gggcaccuccagcacguc

SEQ ID NO: 40363 - RNA, 18 nt, Artificial Sequence
  Description of Artificial Sequence: Synthetic oligonucleotide
gggucagguggguccggg

SEQ ID NO: 40364 - RNA, 18 nt, Artificial Sequence
  Description of Artificial Sequence: Synthetic oligonucleotide
uagugggucagguggguc

SEQ ID NO: 40365 - RNA, 18 nt, Artificial Sequence
  Description of Artificial Sequence: Synthetic oligonucleotide
ugccauagugggucaggu

SEQ ID NO: 40366 - RNA, 18 nt, Artificial Sequence
  Description of Artificial Sequence: Synthetic oligonucleotide
guagaugccauagugggu

SEQ ID NO: 40367 - RNA, 18 nt, Artificial Sequence
  Description of Artificial Sequence: Synthetic oligonucleotide
ccuagguagaugccauag

SEQ ID NO: 40368 - RNA, 18 nt, Artificial Sequence
  Description of Artificial Sequence: Synthetic oligonucleotide
ugucuccuagguagaugc

SEQ ID NO: 40369 - RNA, 18 nt, Artificial Sequence
  Description of Artificial Sequence: Synthetic oligonucleotide
acgguugucuccuaggua

SEQ ID NO: 40370 - RNA, 18 nt, Artificial Sequence
  Description of Artificial Sequence: Synthetic oligonucleotide
gcaacacgguugucuccu

SEQ ID NO: 40371 - RNA, 18 nt, Artificial Sequence
  Description of Artificial Sequence: Synthetic oligonucleotide
ugugggcaacacgguugu

SEQ ID NO: 40372 - RNA, 18 nt, Artificial Sequence
  Description of Artificial Sequence: Synthetic oligonucleotide
caucaugugggcaacacg

SEQ ID NO: 40373 - RNA, 18 nt, Artificial Sequence
  Description of Artificial Sequence: Synthetic oligonucleotide
ucgggcaucaugugggca

SEQ ID NO: 40374 - RNA, 18 nt, Artificial Sequence
  Description of Artificial Sequence: Synthetic oligonucleotide
ggaugucgggcaucaugu

SEQ ID NO: 40375 - RNA, 18 nt, Artificial Sequence
  Description of Artificial Sequence: Synthetic oligonucleotide
caacaggaugucgggcau

SEQ ID NO: 40376 - RNA, 18 nt, Artificial Sequence
  Description of Artificial Sequence: Synthetic oligonucleotide
agggccaacaggaugucg

SEQ ID NO: 40377 - RNA, 18 nt, Artificial Sequence
  Description of Artificial Sequence: Synthetic oligonucleotide
cugucagggccaacagga

SEQ ID NO: 40378 - RNA, 18 nt, Artificial Sequence
  Description of Artificial Sequence: Synthetic oligonucleotide
gucgucugucagggccaa

SEQ ID NO: 40379 - RNA, 18 nt, Artificial Sequence
  Description of Artificial Sequence: Synthetic oligonucleotide
cccaugucgucugucagg

SEQ ID NO: 40380 - RNA, 18 nt, Artificial Sequence
  Description of Artificial Sequence: Synthetic oligonucleotide
ugcgccccaugucgucug

SEQ ID NO: 40381 - RNA, 18 nt, Artificial Sequence
  Description of Artificial Sequence: Synthetic oligonucleotide
cugcgugcgccccauguc

SEQ ID NO: 40382 - RNA, 18 nt, Artificial Sequence
  Description of Artificial Sequence: Synthetic oligonucleotide
accuucugcgugcgcccc

SEQ ID NO: 40383 - RNA, 18 nt, Artificial Sequence
  Description of Artificial Sequence: Synthetic oligonucleotide
agaccaccuucugcgugc

SEQ ID NO: 40384 - RNA, 18 nt, Artificial Sequence
  Description of Artificial Sequence: Synthetic oligonucleotide
guuggagaccaccuucug

SEQ ID NO: 40385 - RNA, 18 nt, Artificial Sequence
  Description of Artificial Sequence: Synthetic oligonucleotide
cgcuuguuggagaccacc

SEQ ID NO: 40386 - RNA, 18 nt, Artificial Sequence
  Description of Artificial Sequence: Synthetic oligonucleotide
ugagacgcuuguuggaga

SEQ ID NO: 40387 - RNA, 18 nt, Artificial Sequence
  Description of Artificial Sequence: Synthetic oligonucleotide
caggaugagacgcuuguu

SEQ ID NO: 40388 - RNA, 18 nt, Artificial Sequence
  Description of Artificial Sequence: Synthetic oligonucleotide
acgcccaggaugagacgc

SEQ ID NO: 40389 - RNA, 18 nt, Artificial Sequence
  Description of Artificial Sequence: Synthetic oligonucleotide
caauaacgcccaggauga

SEQ ID NO: 40390 - RNA, 18 nt, Artificial Sequence
  Description of Artificial Sequence: Synthetic oligonucleotide
uuugacaauaacgcccag

SEQ ID NO: 40391 - RNA, 18 nt, Artificial Sequence
  Description of Artificial Sequence: Synthetic oligonucleotide
gccacuuugacaauaacg

SEQ ID NO: 40392 - RNA, 18 nt, Artificial Sequence
  Description of Artificial Sequence: Synthetic oligonucleotide
ugcuggccacuuugacaa

SEQ ID NO: 40393 - RNA, 18 nt, Artificial Sequence
  Description of Artificial Sequence: Synthetic oligonucleotide
gcggaugcuggccacuuu

SEQ ID NO: 40394 - RNA, 18 nt, Artificial Sequence
  Description of Artificial Sequence: Synthetic oligonucleotide
uccacgcggaugcuggcc

SEQ ID NO: 40395 - RNA, 18 nt, Artificial Sequence
  Description of Artificial Sequence: Synthetic oligonucleotide
cuguguccacgcggaugc

SEQ ID NO: 40396 - RNA, 18 nt, Artificial Sequence
  Description of Artificial Sequence: Synthetic oligonucleotide
cuccacuguguccacgcg

SEQ ID NO: 40397 - RNA, 18 nt, Artificial Sequence
  Description of Artificial Sequence: Synthetic oligonucleotide
aaguccuccacugugucc

SEQ ID NO: 40398 - RNA, 18 nt, Artificial Sequence
  Description of Artificial Sequence: Synthetic oligonucleotide
aggcgaaguccuccacug

SEQ ID NO: 40399 - RNA, 18 nt, Artificial Sequence
  Description of Artificial Sequence: Synthetic oligonucleotide
uccguaggcgaaguccuc

SEQ ID NO: 40400 - RNA, 18 nt, Artificial Sequence
  Description of Artificial Sequence: Synthetic oligonucleotide
uuagcuccguaggcgaag

SEQ ID NO: 40401 - RNA, 18 nt, Artificial Sequence
  Description of Artificial Sequence: Synthetic oligonucleotide
ggauguuagcuccguagg

SEQ ID NO: 40402 - RNA, 18 nt, Artificial Sequence
  Description of Artificial Sequence: Synthetic oligonucleotide
gaccaggauguuagcucc

SEQ ID NO: 40403 - RNA, 18 nt, Artificial Sequence
  Description of Artificial Sequence: Synthetic oligonucleotide
ugauugaccaggauguua

SEQ ID NO: 40404 - RNA, 18 nt, Artificial Sequence
  Description of Artificial Sequence: Synthetic oligonucleotide
ccaggugauugaccagga

SEQ ID NO: 40405 - RNA, 18 nt, Artificial Sequence
  Description of Artificial Sequence: Synthetic oligonucleotide
cucguccaggugauugac

SEQ ID NO: 40406 - RNA, 18 nt, Artificial Sequence
  Description of Artificial Sequence: Synthetic oligonucleotide
agggacucguccagguga

SEQ ID NO: 40407 - RNA, 18 nt, Artificial Sequence
  Description of Artificial Sequence: Synthetic oligonucleotide
ucuggagggacucgucca

SEQ ID NO: 40408 - RNA, 18 nt, Artificial Sequence
  Description of Artificial Sequence: Synthetic oligonucleotide
cuuuuucuggagggacuc

SEQ ID NO: 40409 - RNA, 18 nt, Artificial Sequence
  Description of Artificial Sequence: Synthetic oligonucleotide
agugccuuuuucuggagg

SEQ ID NO: 40410 - RNA, 18 nt, Artificial Sequence
  Description of Artificial Sequence: Synthetic oligonucleotide
ugagcagugccuuuuucu

SEQ ID NO: 40411 - RNA, 18 nt, Artificial Sequence
  Description of Artificial Sequence: Synthetic oligonucleotide
cucguugagcagugccuu

SEQ ID NO: 40412 - RNA, 18 nt, Artificial Sequence
  Description of Artificial Sequence: Synthetic oligonucleotide
accuccucguugagcagu

SEQ ID NO: 40413 - RNA, 18 nt, Artificial Sequence
  Description of Artificial Sequence: Synthetic oligonucleotide
gcgccaccuccucguuga

SEQ ID NO: 40414 - RNA, 18 nt, Artificial Sequence
  Description of Artificial Sequence: Synthetic oligonucleotide
ccuccgcgccaccuccuc

SEQ ID NO: 40415 - RNA, 18 nt, Artificial Sequence
  Description of Artificial Sequence: Synthetic oligonucleotide
ucagcccuccgcgccacc

SEQ ID NO: 40416 - RNA, 18 nt, Artificial Sequence
  Description of Artificial Sequence: Synthetic oligonucleotide
gcuuuucagcccuccgcg

SEQ ID NO: 40417 - RNA, 18 nt, Artificial Sequence
  Description of Artificial Sequence: Synthetic oligonucleotide
cagcagcuuuucagcccu

SEQ ID NO: 40418 - RNA, 18 nt, Artificial Sequence
  Description of Artificial Sequence: Synthetic oligonucleotide
aagcccagcagcuuuuca

SEQ ID NO: 40419 - RNA, 18 nt, Artificial Sequence
  Description of Artificial Sequence: Synthetic oligonucleotide
ggguaaagcccagcagcu

SEQ ID NO: 40420 - RNA, 18 nt, Artificial Sequence
  Description of Artificial Sequence: Synthetic oligonucleotide
ccacagcaggcuguaggg

SEQ ID NO: 40421 - RNA, 18 nt, Artificial Sequence
  Description of Artificial Sequence: Synthetic oligonucleotide
guuccacagcaggcugua

SEQ ID NO: 40422 - RNA, 18 nt, Artificial Sequence
  Description of Artificial Sequence: Synthetic oligonucleotide
caguuguuccacagcagg

SEQ ID NO: 40423 - RNA, 18 nt, Artificial Sequence
  Description of Artificial Sequence: Synthetic oligonucleotide
gcucgcaguuguuccaca

SEQ ID NO: 40424 - RNA, 18 nt, Artificial Sequence
  Description of Artificial Sequence: Synthetic oligonucleotide
gaagugcucgcaguuguu

SEQ ID NO: 40425 - RNA, 18 nt, Artificial Sequence
  Description of Artificial Sequence: Synthetic oligonucleotide
gucacgaagugcucgcag

SEQ ID NO: 40426 - RNA, 18 nt, Artificial Sequence
  Description of Artificial Sequence: Synthetic oligonucleotide
aguaggucacgaagugcu

SEQ ID NO: 40427 - RNA, 18 nt, Artificial Sequence
  Description of Artificial Sequence: Synthetic oligonucleotide
ucugcaguaggucacgaa

SEQ ID NO: 40428 - RNA, 18 nt, Artificial Sequence
  Description of Artificial Sequence: Synthetic oligonucleotide
ccauaucugcaguagguc

SEQ ID NO: 40429 - RNA, 18 nt, Artificial Sequence
  Description of Artificial Sequence: Synthetic oligonucleotide
gggugccauaucugcagu

SEQ ID NO: 40430 - RNA, 18 nt, Artificial Sequence
  Description of Artificial Sequence: Synthetic oligonucleotide
ccccugggagucacacau

SEQ ID NO: 40431 - RNA, 18 nt, Artificial Sequence
  Description of Artificial Sequence: Synthetic oligonucleotide
cacuuccccugggaguca

SEQ ID NO: 40432 - RNA, 18 nt, Artificial Sequence
  Description of Artificial Sequence: Synthetic oligonucleotide
gagcccacuuccccuggg

SEQ ID NO: 40433 - RNA, 18 nt, Artificial Sequence
  Description of Artificial Sequence: Synthetic oligonucleotide
ccgcggagcccacuuccc

SEQ ID NO: 40434 - RNA, 18 nt, Artificial Sequence
  Description of Artificial Sequence: Synthetic oligonucleotide
caucuccgcggagcccac

SEQ ID NO: 40435 - RNA, 18 nt, Artificial Sequence
  Description of Artificial Sequence: Synthetic oligonucleotide
gggcaucuccgcggagcc

SEQ ID NO: 40436 - RNA, 18 nt, Artificial Sequence
  Description of Artificial Sequence: Synthetic oligonucleotide
aggucagggaugggaggg

SEQ ID NO: 40437 - RNA, 18 nt, Artificial Sequence
  Description of Artificial Sequence: Synthetic oligonucleotide
agaaaaggucagggaugg

SEQ ID NO: 40438 - RNA, 18 nt, Artificial Sequence
  Description of Artificial Sequence: Synthetic oligonucleotide
ggaagagaaaaggucagg

SEQ ID NO: 40439 - RNA, 18 nt, Artificial Sequence
  Description of Artificial Sequence: Synthetic oligonucleotide
gggaagagaaaaggucag

SEQ ID NO: 40440 - RNA, 18 nt, Artificial Sequence
  Description of Artificial Sequence: Synthetic oligonucleotide
uagaucccuacucgcggg

SEQ ID NO: 40441 - RNA, 18 nt, Artificial Sequence
  Description of Artificial Sequence: Synthetic oligonucleotide
ggaauuagaucccuacuc

SEQ ID NO: 40442 - RNA, 18 nt, Artificial Sequence
  Description of Artificial Sequence: Synthetic oligonucleotide
guccaggaauuagauccc

SEQ ID NO: 40443 - RNA, 18 nt, Artificial Sequence
  Description of Artificial Sequence: Synthetic oligonucleotide
gagguguccaggaauuag

SEQ ID NO: 40444 - RNA, 18 nt, Artificial Sequence
  Description of Artificial Sequence: Synthetic oligonucleotide
gggagguguccaggaauu

SEQ ID NO: 40445 - RNA, 18 nt, Artificial Sequence
  Description of Artificial Sequence: Synthetic oligonucleotide
gguauggaagugguaggg

SEQ ID NO: 40446 - RNA, 18 nt, Artificial Sequence
  Description of Artificial Sequence: Synthetic oligonucleotide
aggaugguauggaagugg

SEQ ID NO: 40447 - RNA, 18 nt, Artificial Sequence
  Description of Artificial Sequence: Synthetic oligonucleotide
gaaaaaggaugguaugga

SEQ ID NO: 40448 - RNA, 18 nt, Artificial Sequence
  Description of Artificial Sequence: Synthetic oligonucleotide
aaaaagaaaaaggauggu

SEQ ID NO: 40449 - RNA, 18 nt, Artificial Sequence
  Description of Artificial Sequence: Synthetic oligonucleotide
aaaggaaaaagaaaaagg

SEQ ID NO: 40450 - RNA, 18 nt, Artificial Sequence
  Description of Artificial Sequence: Synthetic oligonucleotide
aaaaaaaaggaaaaagaa

SEQ ID NO: 40451 - RNA, 18 nt, Artificial Sequence
  Description of Artificial Sequence: Synthetic oligonucleotide
aaaaaaaaaaaaaggaaa

SEQ ID NO: 40452 - RNA, 18 nt, Artificial Sequence
  Description of Artificial Sequence: Synthetic oligonucleotide
aaaaaaaaaaaaaaaaaa

SEQ ID NO: 40453 - RNA, 18 nt, Artificial Sequence
  Description of Artificial Sequence: Synthetic oligonucleotide
aaaaaaaaaaaaaaaaaa

SEQ ID NO: 40454 - RNA, 18 nt, Artificial Sequence
  Description of Artificial Sequence: Synthetic oligonucleotide
aaaaaaaaaaaaaaaaaa

SEQ ID NO: 40455 - RNA, 18 nt, Artificial Sequence
  Description of Artificial Sequence: Synthetic oligonucleotide
cucaaaaaaaaaaaaaaa

SEQ ID NO: 40456 - RNA, 18 nt, Artificial Sequence
  Description of Artificial Sequence: Synthetic oligonucleotide
uccgucucaaaaaaaaaa

SEQ ID NO: 40457 - RNA, 18 nt, Artificial Sequence
  Description of Artificial Sequence: Synthetic oligonucleotide
gagacuccgucucaaaaa

SEQ ID NO: 40458 - RNA, 18 nt, Artificial Sequence
  Description of Artificial Sequence: Synthetic oligonucleotide
agagcgagacuccgucuc

SEQ ID NO: 40459 - RNA, 18 nt, Artificial Sequence
  Description of Artificial Sequence: Synthetic oligonucleotide
gcaacagagcgagacucc

SEQ ID NO: 40460 - RNA, 18 nt, Artificial Sequence
  Description of Artificial Sequence: Synthetic oligonucleotide
ccugagcaacagagcgag

SEQ ID NO: 40461 - RNA, 18 nt, Artificial Sequence
  Description of Artificial Sequence: Synthetic oligonucleotide
uccagccugagcaacaga

SEQ ID NO: 40462 - RNA, 18 nt, Artificial Sequence
  Description of Artificial Sequence: Synthetic oligonucleotide
ugcacuccagccugagca

SEQ ID NO: 40463 - RNA, 18 nt, Artificial Sequence
  Description of Artificial Sequence: Synthetic oligonucleotide
gccacugcacuccagccu

SEQ ID NO: 40464 - RNA, 18 nt, Artificial Sequence
  Description of Artificial Sequence: Synthetic oligonucleotide
aucgcgccacugcacucc

SEQ ID NO: 40465 - RNA, 18 nt, Artificial Sequence
  Description of Artificial Sequence: Synthetic oligonucleotide
uggagaucgcgccacugc

SEQ ID NO: 40466 - RNA, 18 nt, Artificial Sequence
  Description of Artificial Sequence: Synthetic oligonucleotide
gugaguggagaucgcgcc

SEQ ID NO: 40467 - RNA, 18 nt, Artificial Sequence
  Description of Artificial Sequence: Synthetic oligonucleotide
uugcagugaguggagauc

SEQ ID NO: 40468 - RNA, 18 nt, Artificial Sequence
  Description of Artificial Sequence: Synthetic oligonucleotide
ggaguuugcagugagugg

SEQ ID NO: 40469 - RNA, 18 nt, Artificial Sequence
  Description of Artificial Sequence: Synthetic oligonucleotide
gaggcggaguuugcagug

SEQ ID NO: 40470 - RNA, 18 nt, Artificial Sequence
  Description of Artificial Sequence: Synthetic oligonucleotide
cucuggaggcggaguuug

SEQ ID NO: 40471 - RNA, 18 nt, Artificial Sequence
  Description of Artificial Sequence: Synthetic oligonucleotide
gugaacucuggaggcgga

SEQ ID NO: 40472 - RNA, 18 nt, Artificial Sequence
  Description of Artificial Sequence: Synthetic oligonucleotide
auggcgugaacucuggag

SEQ ID NO: 40473 - RNA, 18 nt, Artificial Sequence
  Description of Artificial Sequence: Synthetic oligonucleotide
ggagaauggcgugaacuc

SEQ ID NO: 40474 - RNA, 18 nt, Artificial Sequence
  Description of Artificial Sequence: Synthetic oligonucleotide
aggcaggagaauggcgug

SEQ ID NO: 40475 - RNA, 18 nt, Artificial Sequence
  Description of Artificial Sequence: Synthetic oligonucleotide
ggcugaggcaggagaaug

SEQ ID NO: 40476 - RNA, 18 nt, Artificial Sequence
  Description of Artificial Sequence: Synthetic oligonucleotide
caggaggcugaggcagga

SEQ ID NO: 40477 - RNA, 18 nt, Artificial Sequence
  Description of Artificial Sequence: Synthetic oligonucleotide
cuacucaggaggcugagg

SEQ ID NO: 40478 - RNA, 18 nt, Artificial Sequence
  Description of Artificial Sequence: Synthetic oligonucleotide
cccagcuacucaggaggc

SEQ ID NO: 40479 - RNA, 18 nt, Artificial Sequence
  Description of Artificial Sequence: Synthetic oligonucleotide
guagucccagcuacucag

SEQ ID NO: 40480 - RNA, 18 nt, Artificial Sequence
  Description of Artificial Sequence: Synthetic oligonucleotide
ugccuguagucccagcua

SEQ ID NO: 40481 - RNA, 18 nt, Artificial Sequence
  Description of Artificial Sequence: Synthetic oligonucleotide
gcgggugccuguaguccc

SEQ ID NO: 40482 - RNA, 18 nt, Artificial Sequence
  Description of Artificial Sequence: Synthetic oligonucleotide
ugguggcgggugccugua

SEQ ID NO: 40483 - RNA, 18 nt, Artificial Sequence
  Description of Artificial Sequence: Synthetic oligonucleotide
gggcgugguggcgggugc

SEQ ID NO: 40484 - RNA, 18 nt, Artificial Sequence
  Description of Artificial Sequence: Synthetic oligonucleotide
uagccgggcgugguggcg

SEQ ID NO: 40485 - RNA, 18 nt, Artificial Sequence
  Description of Artificial Sequence: Synthetic oligonucleotide
uaaauuagccgggcgugg

SEQ ID NO: 40486 - RNA, 18 nt, Artificial Sequence
  Description of Artificial Sequence: Synthetic oligonucleotide
aaaaauaaauuagccggg

SEQ ID NO: 40487 - RNA, 18 nt, Artificial Sequence
  Description of Artificial Sequence: Synthetic oligonucleotide
aauacaaaaauaaauuag

SEQ ID NO: 40488 - RNA, 18 nt, Artificial Sequence
  Description of Artificial Sequence: Synthetic oligonucleotide
cuaaaaauacaaaaauaa

SEQ ID NO: 40489 - RNA, 18 nt, Artificial Sequence
  Description of Artificial Sequence: Synthetic oligonucleotide
cucuacuaaaaauacaaa

SEQ ID NO: 40490 - RNA, 18 nt, Artificial Sequence
  Description of Artificial Sequence: Synthetic oligonucleotide
cccaucucuacuaaaaau

SEQ ID NO: 40491 - RNA, 18 nt, Artificial Sequence
  Description of Artificial Sequence: Synthetic oligonucleotide
gaaaccccaucucuacua

SEQ ID NO: 40492 - RNA, 18 nt, Artificial Sequence
  Description of Artificial Sequence: Synthetic oligonucleotide
acggugaaaccccaucuc

SEQ ID NO: 40493 - RNA, 18 nt, Artificial Sequence
  Description of Artificial Sequence: Synthetic oligonucleotide
cuaauacggugaaacccc

SEQ ID NO: 40494 - RNA, 18 nt, Artificial Sequence
  Description of Artificial Sequence: Synthetic oligonucleotide
ccuugcuaauacggugaa

SEQ ID NO: 40495 - RNA, 18 nt, Artificial Sequence
  Description of Artificial Sequence: Synthetic oligonucleotide
accauccuugcuaauacg

SEQ ID NO: 40496 - RNA, 18 nt, Artificial Sequence
  Description of Artificial Sequence: Synthetic oligonucleotide
ucgggaccauccuugcua

SEQ ID NO: 40497 - RNA, 18 nt, Artificial Sequence
  Description of Artificial Sequence: Synthetic oligonucleotide
ggagaucgggaccauccu

SEQ ID NO: 40498 - RNA, 18 nt, Artificial Sequence
  Description of Artificial Sequence: Synthetic oligonucleotide
ggucaggagaucgggacc

SEQ ID NO: 40499 - RNA, 18 nt, Artificial Sequence
  Description of Artificial Sequence: Synthetic oligonucleotide
cacgaggucaggagaucg

SEQ ID NO: 40500 - RNA, 18 nt, Artificial Sequence
  Description of Artificial Sequence: Synthetic oligonucleotide
aggaucacgaggucagga

SEQ ID NO: 40501 - RNA, 18 nt, Artificial Sequence
  Description of Artificial Sequence: Synthetic oligonucleotide
gcgggaggaucacgaggu

SEQ ID NO: 40502 - RNA, 18 nt, Artificial Sequence
  Description of Artificial Sequence: Synthetic oligonucleotide
cugaggcgggaggaucac

SEQ ID NO: 40503 - RNA, 18 nt, Artificial Sequence
  Description of Artificial Sequence: Synthetic oligonucleotide
ggaugcugaggcgggagg

SEQ ID NO: 40504 - RNA, 18 nt, Artificial Sequence
  Description of Artificial Sequence: Synthetic oligonucleotide
cuuugggaugcugaggcg

SEQ ID NO: 40505 - RNA, 18 nt, Artificial Sequence
  Description of Artificial Sequence: Synthetic oligonucleotide
cagcacuuugggaugcug

SEQ ID NO: 40506 - RNA, 18 nt, Artificial Sequence
  Description of Artificial Sequence: Synthetic oligonucleotide
aaucccagcacuuuggga

SEQ ID NO: 40507 - RNA, 18 nt, Artificial Sequence
  Description of Artificial Sequence: Synthetic oligonucleotide
ccuguaaucccagcacuu

SEQ ID NO: 40508 - RNA, 18 nt, Artificial Sequence
  Description of Artificial Sequence: Synthetic oligonucleotide
ucacgccuguaaucccag

SEQ ID NO: 40509 - RNA, 18 nt, Artificial Sequence
  Description of Artificial Sequence: Synthetic oligonucleotide
guggcucacgccuguaau

SEQ ID NO: 40510 - RNA, 18 nt, Artificial Sequence
  Description of Artificial Sequence: Synthetic oligonucleotide
gcacgguggcucacgccu

SEQ ID NO: 40511 - RNA, 18 nt, Artificial Sequence
  Description of Artificial Sequence: Synthetic oligonucleotide
gccgggcacgguggcuca

SEQ ID NO: 40512 - RNA, 18 nt, Artificial Sequence
  Description of Artificial Sequence: Synthetic oligonucleotide
ggaaggccgggcacggug

SEQ ID NO: 40513 - RNA, 18 nt, Artificial Sequence
  Description of Artificial Sequence: Synthetic oligonucleotide
guuauggaaggccgggca

SEQ ID NO: 40514 - RNA, 18 nt, Artificial Sequence
  Description of Artificial Sequence: Synthetic oligonucleotide
agaauguuauggaaggcc

SEQ ID NO: 40515 - RNA, 18 nt, Artificial Sequence
  Description of Artificial Sequence: Synthetic oligonucleotide
cuuuaagaauguuaugga

SEQ ID NO: 40516 - RNA, 18 nt, Artificial Sequence
  Description of Artificial Sequence: Synthetic oligonucleotide
uagaacuuuaagaauguu

SEQ ID NO: 40517 - RNA, 18 nt, Artificial Sequence
  Description of Artificial Sequence: Synthetic oligonucleotide
uaaucuagaacuuuaaga

SEQ ID NO: 40518 - RNA, 18 nt, Artificial Sequence
  Description of Artificial Sequence: Synthetic oligonucleotide
uuacuuaaucuagaacuu

SEQ ID NO: 40519 - RNA, 18 nt, Artificial Sequence
  Description of Artificial Sequence: Synthetic oligonucleotide
uuuccuuacuuaaucuag

SEQ ID NO: 40520 - RNA, 18 nt, Artificial Sequence
  Description of Artificial Sequence: Synthetic oligonucleotide
agaacuuuccuuacuuaa

SEQ ID NO: 40521 - RNA, 18 nt, Artificial Sequence
  Description of Artificial Sequence: Synthetic oligonucleotide
acaccagaacuuuccuua

SEQ ID NO: 40522 - RNA, 18 nt, Artificial Sequence
  Description of Artificial Sequence: Synthetic oligonucleotide
uaggaacaccagaacuuu

SEQ ID NO: 40523 - RNA, 18 nt, Artificial Sequence
  Description of Artificial Sequence: Synthetic oligonucleotide
uaccuuaggaacaccaga

SEQ ID NO: 40524 - RNA, 18 nt, Artificial Sequence
  Description of Artificial Sequence: Synthetic oligonucleotide
uuauugucaaaucccauu

SEQ ID NO: 40525 - RNA, 18 nt, Artificial Sequence
  Description of Artificial Sequence: Synthetic oligonucleotide
uaauuuuauugucaaauc

SEQ ID NO: 40526 - RNA, 18 nt, Artificial Sequence
  Description of Artificial Sequence: Synthetic oligonucleotide
aagucuaauuuuauuguc

SEQ ID NO: 40527 - RNA, 18 nt, Artificial Sequence
  Description of Artificial Sequence: Synthetic oligonucleotide
auagaaagucuaauuuua

SEQ ID NO: 40528 - RNA, 18 nt, Artificial Sequence
  Description of Artificial Sequence: Synthetic oligonucleotide
caggcauagaaagucuaa

SEQ ID NO: 40529 - RNA, 18 nt, Artificial Sequence
  Description of Artificial Sequence: Synthetic oligonucleotide
aucuacaggcauagaaag

SEQ ID NO: 40530 - RNA, 18 nt, Artificial Sequence
  Description of Artificial Sequence: Synthetic oligonucleotide
ucaaaaucuacaggcaua

SEQ ID NO: 40531 - RNA, 18 nt, Artificial Sequence
  Description of Artificial Sequence: Synthetic oligonucleotide
aagucucaaaaucuacag

SEQ ID NO: 40532 - RNA, 18 nt, Artificial Sequence
  Description of Artificial Sequence: Synthetic oligonucleotide
uuuauaagucucaaaauc

SEQ ID NO: 40533 - RNA, 18 nt, Artificial Sequence
  Description of Artificial Sequence: Synthetic oligonucleotide
acuuuuuuauaagucuca

SEQ ID NO: 40534 - RNA, 18 nt, Artificial Sequence
  Description of Artificial Sequence: Synthetic oligonucleotide
ugauaacuuuuuuauaag

SEQ ID NO: 40535 - RNA, 18 nt, Artificial Sequence
  Description of Artificial Sequence: Synthetic oligonucleotide
accaaugauaacuuuuuu

SEQ ID NO: 40536 - RNA, 18 nt, Artificial Sequence
  Description of Artificial Sequence: Synthetic oligonucleotide
augauaccaaugauaacu

SEQ ID NO: 40537 - RNA, 18 nt, Artificial Sequence
  Description of Artificial Sequence: Synthetic oligonucleotide
aucuaaugauaccaauga

SEQ ID NO: 40538 - RNA, 18 nt, Artificial Sequence
  Description of Artificial Sequence: Synthetic oligonucleotide
cuaaaaucuaaugauacc

SEQ ID NO: 40539 - RNA, 18 nt, Artificial Sequence
  Description of Artificial Sequence: Synthetic oligonucleotide
ccauucuaaaaucuaaug

SEQ ID NO: 40540 - RNA, 18 nt, Artificial Sequence
  Description of Artificial Sequence: Synthetic oligonucleotide
aucugccauucuaaaauc

SEQ ID NO: 40541 - RNA, 18 nt, Artificial Sequence
  Description of Artificial Sequence: Synthetic oligonucleotide
cuccaaucugccauucua

SEQ ID NO: 40542 - RNA, 18 nt, Artificial Sequence
  Description of Artificial Sequence: Synthetic oligonucleotide
aauuccuccaaucugcca

SEQ ID NO: 40543 - RNA, 18 nt, Artificial Sequence
  Description of Artificial Sequence: Synthetic oligonucleotide
gauucaauuccuccaauc

SEQ ID NO: 40544 - RNA, 18 nt, Artificial Sequence
  Description of Artificial Sequence: Synthetic oligonucleotide
aaguagauucaauuccuc

SEQ ID NO: 40545 - RNA, 18 nt, Artificial Sequence
  Description of Artificial Sequence: Synthetic oligonucleotide
auuaaaaguagauucaau

SEQ ID NO: 40546 - RNA, 18 nt, Artificial Sequence
  Description of Artificial Sequence: Synthetic oligonucleotide
ggccaauuaaaaguagau

SEQ ID NO: 40547 - RNA, 18 nt, Artificial Sequence
  Description of Artificial Sequence: Synthetic oligonucleotide
aauuuggccaauuaaaag

SEQ ID NO: 40548 - RNA, 18 nt, Artificial Sequence
  Description of Artificial Sequence: Synthetic oligonucleotide
aauagaauuuggccaauu

SEQ ID NO: 40549 - RNA, 18 nt, Artificial Sequence
  Description of Artificial Sequence: Synthetic oligonucleotide
aaaauaauagaauuuggc

SEQ ID NO: 40550 - RNA, 18 nt, Artificial Sequence
  Description of Artificial Sequence: Synthetic oligonucleotide
gaguaaaaauaauagaau

SEQ ID NO: 40551 - RNA, 18 nt, Artificial Sequence
  Description of Artificial Sequence: Synthetic oligonucleotide
aucuugaguaaaaauaau

SEQ ID NO: 40552 - RNA, 18 nt, Artificial Sequence
  Description of Artificial Sequence: Synthetic oligonucleotide
cucuaaucuugaguaaaa

SEQ ID NO: 40553 - RNA, 18 nt, Artificial Sequence
  Description of Artificial Sequence: Synthetic oligonucleotide
ggugucucuaaucuugag

SEQ ID NO: 40554 - RNA, 18 nt, Artificial Sequence
  Description of Artificial Sequence: Synthetic oligonucleotide
aaagaggugucucuaauc

SEQ ID NO: 40555 - RNA, 18 nt, Artificial Sequence
  Description of Artificial Sequence: Synthetic oligonucleotide
ugagcaaagaggugucuc

SEQ ID NO: 40556 - RNA, 18 nt, Artificial Sequence
  Description of Artificial Sequence: Synthetic oligonucleotide
uuagaugagcaaagaggu

SEQ ID NO: 40557 - RNA, 18 nt, Artificial Sequence
  Description of Artificial Sequence: Synthetic oligonucleotide
uaaaauuagaugagcaaa

SEQ ID NO: 40558 - RNA, 18 nt, Artificial Sequence
  Description of Artificial Sequence: Synthetic oligonucleotide
uauuuuaaaauuagauga

SEQ ID NO: 40559 - RNA, 18 nt, Artificial Sequence
  Description of Artificial Sequence: Synthetic oligonucleotide
uagcauauuuuaaaauua

SEQ ID NO: 40560 - RNA, 18 nt, Artificial Sequence
  Description of Artificial Sequence: Synthetic oligonucleotide
aacaauagcauauuuuaa

SEQ ID NO: 40561 - RNA, 18 nt, Artificial Sequence
  Description of Artificial Sequence: Synthetic oligonucleotide
ucaauaacaauagcauau

SEQ ID NO: 40562 - RNA, 18 nt, Artificial Sequence
  Description of Artificial Sequence: Synthetic oligonucleotide
gcuuaucaauaacaauag

SEQ ID NO: 40563 - RNA, 18 nt, Artificial Sequence
  Description of Artificial Sequence: Synthetic oligonucleotide
aaacugcuuaucaauaac

SEQ ID NO: 40564 - RNA, 18 nt, Artificial Sequence
  Description of Artificial Sequence: Synthetic oligonucleotide
acaucaaacugcuuauca

SEQ ID NO: 40565 - RNA, 18 nt, Artificial Sequence
  Description of Artificial Sequence: Synthetic oligonucleotide
uuaaaacaucaaacugcu

SEQ ID NO: 40566 - RNA, 18 nt, Artificial Sequence
  Description of Artificial Sequence: Synthetic oligonucleotide
aagguuuaaaacaucaaa

SEQ ID NO: 40567 - RNA, 18 nt, Artificial Sequence
  Description of Artificial Sequence: Synthetic oligonucleotide
gacuaaagguuuaaaaca

SEQ ID NO: 40568 - RNA, 18 nt, Artificial Sequence
  Description of Artificial Sequence: Synthetic oligonucleotide
uucaggacuaaagguuua

SEQ ID NO: 40569 - RNA, 18 nt, Artificial Sequence
  Description of Artificial Sequence: Synthetic oligonucleotide
gguuauucaggacuaaag

SEQ ID NO: 40570 - RNA, 18 nt, Artificial Sequence
  Description of Artificial Sequence: Synthetic oligonucleotide
cacaugguuauucaggac

SEQ ID NO: 40571 - RNA, 18 nt, Artificial Sequence
  Description of Artificial Sequence: Synthetic oligonucleotide
auaaccacaugguuauuc

SEQ ID NO: 40572 - RNA, 18 nt, Artificial Sequence
  Description of Artificial Sequence: Synthetic oligonucleotide
aaaguauaaccacauggu

SEQ ID NO: 40573 - RNA, 18 nt, Artificial Sequence
  Description of Artificial Sequence: Synthetic oligonucleotide
uauagaaaguauaaccac

SEQ ID NO: 40574 - RNA, 18 nt, Artificial Sequence
  Description of Artificial Sequence: Synthetic oligonucleotide
aaaacuauagaaaguaua

SEQ ID NO: 40575 - RNA, 18 nt, Artificial Sequence
  Description of Artificial Sequence: Synthetic oligonucleotide
uauagaaaacuauagaaa

SEQ ID NO: 40576 - RNA, 18 nt, Artificial Sequence
  Description of Artificial Sequence: Synthetic oligonucleotide
gcauuuauagaaaacuau

SEQ ID NO: 40577 - RNA, 18 nt, Artificial Sequence
  Description of Artificial Sequence: Synthetic oligonucleotide
auacagcauuuauagaaa

SEQ ID NO: 40578 - RNA, 18 nt, Artificial Sequence
  Description of Artificial Sequence: Synthetic oligonucleotide
uguaaauacagcauuuau

SEQ ID NO: 40579 - RNA, 18 nt, Artificial Sequence
  Description of Artificial Sequence: Synthetic oligonucleotide
gccuauguaaauacagca

SEQ ID NO: 40580 - RNA, 18 nt, Artificial Sequence
  Description of Artificial Sequence: Synthetic oligonucleotide
caguugccuauguaaaua

SEQ ID NO: 40581 - RNA, 18 nt, Artificial Sequence
  Description of Artificial Sequence: Synthetic oligonucleotide
aauggcaguugccuaugu

SEQ ID NO: 40582 - RNA, 18 nt, Artificial Sequence
  Description of Artificial Sequence: Synthetic oligonucleotide
cuaauaauggcaguugcc

SEQ ID NO: 40583 - RNA, 18 nt, Artificial Sequence
  Description of Artificial Sequence: Synthetic oligonucleotide
ggcaacuaauaauggcag

SEQ ID NO: 40584 - RNA, 18 nt, Artificial Sequence
  Description of Artificial Sequence: Synthetic oligonucleotide
ccuuaggcaacuaauaau

SEQ ID NO: 40585 - RNA, 18 nt, Artificial Sequence
  Description of Artificial Sequence: Synthetic oligonucleotide
ugaucccuuaggcaacua

SEQ ID NO: 40586 - RNA, 18 nt, Artificial Sequence
  Description of Artificial Sequence: Synthetic oligonucleotide
agaaaugaucccuuaggc

SEQ ID NO: 40587 - RNA, 18 nt, Artificial Sequence
  Description of Artificial Sequence: Synthetic oligonucleotide
guagcagaaaugaucccu

SEQ ID NO: 40588 - RNA, 18 nt, Artificial Sequence
  Description of Artificial Sequence: Synthetic oligonucleotide
guauaguagcagaaauga

SEQ ID NO: 40589 - RNA, 18 nt, Artificial Sequence
  Description of Artificial Sequence: Synthetic oligonucleotide
auaccguauaguagcaga

SEQ ID NO: 40590 - RNA, 18 nt, Artificial Sequence
  Description of Artificial Sequence: Synthetic oligonucleotide
auucuauaccguauagua

SEQ ID NO: 40591 - RNA, 18 nt, Artificial Sequence
  Description of Artificial Sequence: Synthetic oligonucleotide
uucugauucuauaccgua

SEQ ID NO: 40592 - RNA, 18 nt, Artificial Sequence
  Description of Artificial Sequence: Synthetic oligonucleotide
uccaguucugauucuaua

SEQ ID NO: 40593 - RNA, 18 nt, Artificial Sequence
  Description of Artificial Sequence: Synthetic oligonucleotide
aagaguccaguucugauu

SEQ ID NO: 40594 - RNA, 18 nt, Artificial Sequence
  Description of Artificial Sequence: Synthetic oligonucleotide
auguuaagaguccaguuc

SEQ ID NO: 40595 - RNA, 18 nt, Artificial Sequence
  Description of Artificial Sequence: Synthetic oligonucleotide
uuacaauguuaagagucc

SEQ ID NO: 40596 - RNA, 18 nt, Artificial Sequence
  Description of Artificial Sequence: Synthetic oligonucleotide
aaaauuuacaauguuaag

SEQ ID NO: 40597 - RNA, 18 nt, Artificial Sequence
  Description of Artificial Sequence: Synthetic oligonucleotide
acaaaaaaauuuacaaug

SEQ ID NO: 40598 - RNA, 18 nt, Artificial Sequence
  Description of Artificial Sequence: Synthetic oligonucleotide
gacuuacaaaaaaauuua

SEQ ID NO: 40599 - RNA, 18 nt, Artificial Sequence
  Description of Artificial Sequence: Synthetic oligonucleotide
cuuaugacuuacaaaaaa

SEQ ID NO: 40600 - RNA, 18 nt, Artificial Sequence
  Description of Artificial Sequence: Synthetic oligonucleotide
uuuuucuuaugacuuaca

SEQ ID NO: 40601 - RNA, 18 nt, Artificial Sequence
  Description of Artificial Sequence: Synthetic oligonucleotide
uagacuuuuucuuaugac

SEQ ID NO: 40602 - RNA, 18 nt, Artificial Sequence
  Description of Artificial Sequence: Synthetic oligonucleotide
agaacuagacuuuuucuu

SEQ ID NO: 40603 - RNA, 18 nt, Artificial Sequence
  Description of Artificial Sequence: Synthetic oligonucleotide
ccagaagaacuagacuuu

SEQ ID NO: 40604 - RNA, 18 nt, Artificial Sequence
  Description of Artificial Sequence: Synthetic oligonucleotide
gucuaccagaagaacuag

SEQ ID NO: 40605 - RNA, 18 nt, Artificial Sequence
  Description of Artificial Sequence: Synthetic oligonucleotide
uuucugucuaccagaaga

SEQ ID NO: 40606 - RNA, 18 nt, Artificial Sequence
  Description of Artificial Sequence: Synthetic oligonucleotide
gcuauuuucugucuacca

SEQ ID NO: 40607 - RNA, 18 nt, Artificial Sequence
  Description of Artificial Sequence: Synthetic oligonucleotide
ucccagcuauuuucuguc

SEQ ID NO: 40608 - RNA, 18 nt, Artificial Sequence
  Description of Artificial Sequence: Synthetic oligonucleotide
aguuuucccagcuauuuu

SEQ ID NO: 40609 - RNA, 18 nt, Artificial Sequence
  Description of Artificial Sequence: Synthetic oligonucleotide
aaaucaguuuucccagcu

SEQ ID NO: 40610 - RNA, 18 nt, Artificial Sequence
  Description of Artificial Sequence: Synthetic oligonucleotide
acaguaaaucaguuuucc

SEQ ID NO: 40611 - RNA, 18 nt, Artificial Sequence
  Description of Artificial Sequence: Synthetic oligonucleotide
aucaaacaguaaaucagu

SEQ ID NO: 40612 - RNA, 18 nt, Artificial Sequence
  Description of Artificial Sequence: Synthetic oligonucleotide
cauauaucaaacaguaaa

SEQ ID NO: 40613 - RNA, 18 nt, Artificial Sequence
  Description of Artificial Sequence: Synthetic oligonucleotide
aaucacauauaucaaaca

SEQ ID NO: 40614 - RNA, 18 nt, Artificial Sequence
  Description of Artificial Sequence: Synthetic oligonucleotide
agaagaaucacauauauc

SEQ ID NO: 40615 - RNA, 18 nt, Artificial Sequence
  Description of Artificial Sequence: Synthetic oligonucleotide
acccaagaagaaucacau

SEQ ID NO: 40616 - RNA, 18 nt, Artificial Sequence
  Description of Artificial Sequence: Synthetic oligonucleotide
gcuaaacccaagaagaau

SEQ ID NO: 40617 - RNA, 18 nt, Artificial Sequence
  Description of Artificial Sequence: Synthetic oligonucleotide
agguggcuaaacccaaga

SEQ ID NO: 40618 - RNA, 18 nt, Artificial Sequence
  Description of Artificial Sequence: Synthetic oligonucleotide
aggaaagguggcuaaacc

SEQ ID NO: 40619 - RNA, 18 nt, Artificial Sequence
  Description of Artificial Sequence: Synthetic oligonucleotide
aaauuaggaaagguggcu

SEQ ID NO: 40620 - RNA, 18 nt, Artificial Sequence
  Description of Artificial Sequence: Synthetic oligonucleotide
uuggaaaauuaggaaagg

SEQ ID NO: 40621 - RNA, 18 nt, Artificial Sequence
  Description of Artificial Sequence: Synthetic oligonucleotide
ucuucacagucucacaaa

SEQ ID NO: 40622 - RNA, 18 nt, Artificial Sequence
  Description of Artificial Sequence: Synthetic oligonucleotide
aauuaucuucacagucuc

SEQ ID NO: 40623 - RNA, 18 nt, Artificial Sequence
  Description of Artificial Sequence: Synthetic oligonucleotide
cgaauaauuaucuucaca

SEQ ID NO: 40624 - RNA, 18 nt, Artificial Sequence
  Description of Artificial Sequence: Synthetic oligonucleotide
gaucacgaauaauuaucu

SEQ ID NO: 40625 - RNA, 18 nt, Artificial Sequence
  Description of Artificial Sequence: Synthetic oligonucleotide
ucucugaucacgaauaau

SEQ ID NO: 40626 - RNA, 18 nt, Artificial Sequence
  Description of Artificial Sequence: Synthetic oligonucleotide
acacuucucugaucacga

SEQ ID NO: 40627 - RNA, 18 nt, Artificial Sequence
  Description of Artificial Sequence: Synthetic oligonucleotide
caagaacacuucucugau

SEQ ID NO: 40628 - RNA, 18 nt, Artificial Sequence
  Description of Artificial Sequence: Synthetic oligonucleotide
ugaagcaagaacacuucu

SEQ ID NO: 40629 - RNA, 18 nt, Artificial Sequence
  Description of Artificial Sequence: Synthetic oligonucleotide
acugcugaagcaagaaca

SEQ ID NO: 40630 - RNA, 18 nt, Artificial Sequence
  Description of Artificial Sequence: Synthetic oligonucleotide
ccaagacugcugaagcaa

SEQ ID NO: 40631 - RNA, 18 nt, Artificial Sequence
  Description of Artificial Sequence: Synthetic oligonucleotide
caaucccaagacugcuga

SEQ ID NO: 40632 - RNA, 18 nt, Artificial Sequence
  Description of Artificial Sequence: Synthetic oligonucleotide
gacgccaaucccaagacu

SEQ ID NO: 40633 - RNA, 18 nt, Artificial Sequence
  Description of Artificial Sequence: Synthetic oligonucleotide
cuauagacgccaauccca

SEQ ID NO: 40634 - RNA, 18 nt, Artificial Sequence
  Description of Artificial Sequence: Synthetic oligonucleotide
acagacuauagacgccaa

SEQ ID NO: 40635 - RNA, 18 nt, Artificial Sequence
  Description of Artificial Sequence: Synthetic oligonucleotide
cccguacagacuauagac

SEQ ID NO: 40636 - RNA, 18 nt, Artificial Sequence
  Description of Artificial Sequence: Synthetic oligonucleotide
ccaagcccguacagacua

SEQ ID NO: 40637 - RNA, 18 nt, Artificial Sequence
  Description of Artificial Sequence: Synthetic oligonucleotide
ugauaccaagcccguaca

SEQ ID NO: 40638 - RNA, 18 nt, Artificial Sequence
  Description of Artificial Sequence: Synthetic oligonucleotide
guguaugauaccaagccc

SEQ ID NO: 40639 - RNA, 18 nt, Artificial Sequence
  Description of Artificial Sequence: Synthetic oligonucleotide
ggguaguguaugauacca

SEQ ID NO: 40640 - RNA, 18 nt, Artificial Sequence
  Description of Artificial Sequence: Synthetic oligonucleotide
aggaaggguaguguauga

SEQ ID NO: 40641 - RNA, 18 nt, Artificial Sequence
  Description of Artificial Sequence: Synthetic oligonucleotide
auugcaggaaggguagug

SEQ ID NO: 40642 - RNA, 18 nt, Artificial Sequence
  Description of Artificial Sequence: Synthetic oligonucleotide
uaaaaauugcaggaaggg

SEQ ID NO: 40643 - RNA, 18 nt, Artificial Sequence
  Description of Artificial Sequence: Synthetic oligonucleotide
uggaauaaaaauugcagg

SEQ ID NO: 40644 - RNA, 18 nt, Artificial Sequence
  Description of Artificial Sequence: Synthetic oligonucleotide
aagaauggaauaaaaauu

SEQ ID NO: 40645 - RNA, 18 nt, Artificial Sequence
  Description of Artificial Sequence: Synthetic oligonucleotide
auaggaagaauggaauaa

SEQ ID NO: 40646 - RNA, 18 nt, Artificial Sequence
  Description of Artificial Sequence: Synthetic oligonucleotide
cauccauaggaagaaugg

SEQ ID NO: 40647 - RNA, 18 nt, Artificial Sequence
  Description of Artificial Sequence: Synthetic oligonucleotide
ccagccauccauaggaag

SEQ ID NO: 40648 - RNA, 18 nt, Artificial Sequence
  Description of Artificial Sequence: Synthetic oligonucleotide
guuagccagccauccaua

SEQ ID NO: 40649 - RNA, 18 nt, Artificial Sequence
  Description of Artificial Sequence: Synthetic oligonucleotide
augaaguuagccagccau

SEQ ID NO: 40650 - RNA, 18 nt, Artificial Sequence
  Description of Artificial Sequence: Synthetic oligonucleotide
ggguaugaaguuagccag

SEQ ID NO: 40651 - RNA, 18 nt, Artificial Sequence
  Description of Artificial Sequence: Synthetic oligonucleotide
uacacacacugacauggg

SEQ ID NO: 40652 - RNA, 18 nt, Artificial Sequence
  Description of Artificial Sequence: Synthetic oligonucleotide
cagaauacacacacugac

SEQ ID NO: 40653 - RNA, 18 nt, Artificial Sequence
  Description of Artificial Sequence: Synthetic oligonucleotide
acauacagaauacacaca

SEQ ID NO: 40654 - RNA, 18 nt, Artificial Sequence
  Description of Artificial Sequence: Synthetic oligonucleotide
uauuuacauacagaauac

SEQ ID NO: 40655 - RNA, 18 nt, Artificial Sequence
  Description of Artificial Sequence: Synthetic oligonucleotide
aaacauauuuacauacag

SEQ ID NO: 40656 - RNA, 18 nt, Artificial Sequence
  Description of Artificial Sequence: Synthetic oligonucleotide
aauauaaacauauuuaca

SEQ ID NO: 40657 - RNA, 18 nt, Artificial Sequence
  Description of Artificial Sequence: Synthetic oligonucleotide
cuauaaauauaaacauau

SEQ ID NO: 40658 - RNA, 18 nt, Artificial Sequence
  Description of Artificial Sequence: Synthetic oligonucleotide
augcucuauaaauauaaa

SEQ ID NO: 40659 - RNA, 18 nt, Artificial Sequence
  Description of Artificial Sequence: Synthetic oligonucleotide
gauugaugcucuauaaau

SEQ ID NO: 40660 - RNA, 18 nt, Artificial Sequence
  Description of Artificial Sequence: Synthetic oligonucleotide
auauugauugaugcucua

SEQ ID NO: 40661 - RNA, 18 nt, Artificial Sequence
  Description of Artificial Sequence: Synthetic oligonucleotide
ugcuuauauugauugaug

SEQ ID NO: 40662 - RNA, 18 nt, Artificial Sequence
  Description of Artificial Sequence: Synthetic oligonucleotide
aauaaugcuuauauugau

SEQ ID NO: 40663 - RNA, 18 nt, Artificial Sequence
  Description of Artificial Sequence: Synthetic oligonucleotide
uucucaauaaugcuuaua

SEQ ID NO: 40664 - RNA, 18 nt, Artificial Sequence
  Description of Artificial Sequence: Synthetic oligonucleotide
cauuuuucucaauaaugc

SEQ ID NO: 40665 - RNA, 18 nt, Artificial Sequence
  Description of Artificial Sequence: Synthetic oligonucleotide
ggucacauuuuucucaau

SEQ ID NO: 40666 - RNA, 18 nt, Artificial Sequence
  Description of Artificial Sequence: Synthetic oligonucleotide
uuacgggucacauuuuuc

SEQ ID NO: 40667 - RNA, 18 nt, Artificial Sequence
  Description of Artificial Sequence: Synthetic oligonucleotide
caguguuacgggucacau

SEQ ID NO: 40668 - RNA, 18 nt, Artificial Sequence
  Description of Artificial Sequence: Synthetic oligonucleotide
gaacacaguguuacgggu

SEQ ID NO: 40669 - RNA, 18 nt, Artificial Sequence
  Description of Artificial Sequence: Synthetic oligonucleotide
auccagaacacaguguua

SEQ ID NO: 40670 - RNA, 18 nt, Artificial Sequence
  Description of Artificial Sequence: Synthetic oligonucleotide
uuuuuauccagaacacag

SEQ ID NO: 40671 - RNA, 18 nt, Artificial Sequence
  Description of Artificial Sequence: Synthetic oligonucleotide
ucacauuuuuauccagaa

SEQ ID NO: 40672 - RNA, 18 nt, Artificial Sequence
  Description of Artificial Sequence: Synthetic oligonucleotide
ccuaaucacauuuuuauc

SEQ ID NO: 40673 - RNA, 18 nt, Artificial Sequence
  Description of Artificial Sequence: Synthetic oligonucleotide
ugauuccuaaucacauuu

SEQ ID NO: 40674 - RNA, 18 nt, Artificial Sequence
  Description of Artificial Sequence: Synthetic oligonucleotide
uugcgugauuccuaauca

SEQ ID NO: 40675 - RNA, 18 nt, Artificial Sequence
  Description of Artificial Sequence: Synthetic oligonucleotide
gcacuuugcgugauuccu

SEQ ID NO: 40676 - RNA, 18 nt, Artificial Sequence
  Description of Artificial Sequence: Synthetic oligonucleotide
aguaagcacuuugcguga

SEQ ID NO: 40677 - RNA, 18 nt, Artificial Sequence
  Description of Artificial Sequence: Synthetic oligonucleotide
uacacaguaagcacuuug

SEQ ID NO: 40678 - RNA, 18 nt, Artificial Sequence
  Description of Artificial Sequence: Synthetic oligonucleotide
gggcuuacacaguaagca

SEQ ID NO: 40679 - RNA, 18 nt, Artificial Sequence
  Description of Artificial Sequence: Synthetic oligonucleotide
uucuugggcuuacacagu

SEQ ID NO: 40680 - RNA, 18 nt, Artificial Sequence
  Description of Artificial Sequence: Synthetic oligonucleotide
cuuuguucuugggcuuac

SEQ ID NO: 40681 - RNA, 18 nt, Artificial Sequence
  Description of Artificial Sequence: Synthetic oligonucleotide
aaagccuuuguucuuggg

SEQ ID NO: 40682 - RNA, 18 nt, Artificial Sequence
  Description of Artificial Sequence: Synthetic oligonucleotide
uucagaaagccuuuguuc

SEQ ID NO: 40683 - RNA, 18 nt, Artificial Sequence
  Description of Artificial Sequence: Synthetic oligonucleotide
gaagauucagaaagccuu

SEQ ID NO: 40684 - RNA, 18 nt, Artificial Sequence
  Description of Artificial Sequence: Synthetic oligonucleotide
ccugagaagauucagaaa

SEQ ID NO: 40685 - RNA, 18 nt, Artificial Sequence
  Description of Artificial Sequence: Synthetic oligonucleotide
aacugccugagaagauuc

SEQ ID NO: 40686 - RNA, 18 nt, Artificial Sequence
  Description of Artificial Sequence: Synthetic oligonucleotide
aucugaacugccugagaa

SEQ ID NO: 40687 - RNA, 18 nt, Artificial Sequence
  Description of Artificial Sequence: Synthetic oligonucleotide
uuuaaaucugaacugccu

SEQ ID NO: 40688 - RNA, 18 nt, Artificial Sequence
  Description of Artificial Sequence: Synthetic oligonucleotide
ggugcuuuaaaucugaac

SEQ ID NO: 40689 - RNA, 18 nt, Artificial Sequence
  Description of Artificial Sequence: Synthetic oligonucleotide
uggauggugcuuuaaauc

SEQ ID NO: 40690 - RNA, 18 nt, Artificial Sequence
  Description of Artificial Sequence: Synthetic oligonucleotide
agguuuggauggugcuuu

SEQ ID NO: 40691 - RNA, 18 nt, Artificial Sequence
  Description of Artificial Sequence: Synthetic oligonucleotide
uuccaagguuuggauggu

SEQ ID NO: 40692 - RNA, 18 nt, Artificial Sequence
  Description of Artificial Sequence: Synthetic oligonucleotide
cguauuuccaagguuugg

SEQ ID NO: 40693 - RNA, 18 nt, Artificial Sequence
  Description of Artificial Sequence: Synthetic oligonucleotide
ccugucguauuuccaagg

SEQ ID NO: 40694 - RNA, 18 nt, Artificial Sequence
  Description of Artificial Sequence: Synthetic oligonucleotide
cacacccugucguauuuc

SEQ ID NO: 40695 - RNA, 18 nt, Artificial Sequence
  Description of Artificial Sequence: Synthetic oligonucleotide
ucuaccacacccugucgu

SEQ ID NO: 40696 - RNA, 18 nt, Artificial Sequence
  Description of Artificial Sequence: Synthetic oligonucleotide
ugaauucuaccacacccu

SEQ ID NO: 40697 - RNA, 18 nt, Artificial Sequence
  Description of Artificial Sequence: Synthetic oligonucleotide
auugcugaauucuaccac

SEQ ID NO: 40698 - RNA, 18 nt, Artificial Sequence
  Description of Artificial Sequence: Synthetic oligonucleotide
cucauauugcugaauucu

SEQ ID NO: 40699 - RNA, 18 nt, Artificial Sequence
  Description of Artificial Sequence: Synthetic oligonucleotide
guuuucucauauugcuga

SEQ ID NO: 40700 - RNA, 18 nt, Artificial Sequence
  Description of Artificial Sequence: Synthetic oligonucleotide
ggcugguuuucucauauu

SEQ ID NO: 40701 - RNA, 18 nt, Artificial Sequence
  Description of Artificial Sequence: Synthetic oligonucleotide
gggcugguuuucucauau

SEQ ID NO: 40702 - RNA, 18 nt, Artificial Sequence
  Description of Artificial Sequence: Synthetic oligonucleotide
guggcuaucauuuuaggg

SEQ ID NO: 40703 - RNA, 18 nt, Artificial Sequence
  Description of Artificial Sequence: Synthetic oligonucleotide
cucuuguggcuaucauuu

SEQ ID NO: 40704 - RNA, 18 nt, Artificial Sequence
  Description of Artificial Sequence: Synthetic oligonucleotide
uuaaucucuuguggcuau

SEQ ID NO: 40705 - RNA, 18 nt, Artificial Sequence
  Description of Artificial Sequence: Synthetic oligonucleotide
cacaauuaaucucuugug

SEQ ID NO: 40706 - RNA, 18 nt, Artificial Sequence
  Description of Artificial Sequence: Synthetic oligonucleotide
aaaaacacaauuaaucuc

SEQ ID NO: 40707 - RNA, 18 nt, Artificial Sequence
  Description of Artificial Sequence: Synthetic oligonucleotide
gaaaaaaaaacacaauua

SEQ ID NO: 40708 - RNA, 18 nt, Artificial Sequence
  Description of Artificial Sequence: Synthetic oligonucleotide
caggagaaaaaaaaacac

SEQ ID NO: 40709 - RNA, 18 nt, Artificial Sequence
  Description of Artificial Sequence: Synthetic oligonucleotide
gauuacaggagaaaaaaa

SEQ ID NO: 40710 - RNA, 18 nt, Artificial Sequence
  Description of Artificial Sequence: Synthetic oligonucleotide
acaaggauuacaggagaa

SEQ ID NO: 40711 - RNA, 18 nt, Artificial Sequence
  Description of Artificial Sequence: Synthetic oligonucleotide
acaguacaaggauuacag

SEQ ID NO: 40712 - RNA, 18 nt, Artificial Sequence
  Description of Artificial Sequence: Synthetic oligonucleotide
gccgaacaguacaaggau

SEQ ID NO: 40713 - RNA, 18 nt, Artificial Sequence
  Description of Artificial Sequence: Synthetic oligonucleotide
auucagccgaacaguaca

SEQ ID NO: 40714 - RNA, 18 nt, Artificial Sequence
  Description of Artificial Sequence: Synthetic oligonucleotide
uucaaauucagccgaaca

SEQ ID NO: 40715 - RNA, 18 nt, Artificial Sequence
  Description of Artificial Sequence: Synthetic oligonucleotide
caaucuucaaauucagcc

SEQ ID NO: 40716 - RNA, 18 nt, Artificial Sequence
  Description of Artificial Sequence: Synthetic oligonucleotide
ucuuccaaucuucaaauu

SEQ ID NO: 40717 - RNA, 18 nt, Artificial Sequence
  Description of Artificial Sequence: Synthetic oligonucleotide
auaagucuuccaaucuuc

SEQ ID NO: 40718 - RNA, 18 nt, Artificial Sequence
  Description of Artificial Sequence: Synthetic oligonucleotide
ucaauauaagucuuccaa

SEQ ID NO: 40719 - RNA, 18 nt, Artificial Sequence
  Description of Artificial Sequence: Synthetic oligonucleotide
uggucucaauauaagucu

SEQ ID NO: 40720 - RNA, 18 nt, Artificial Sequence
  Description of Artificial Sequence: Synthetic oligonucleotide
guuacuggucucaauaua

SEQ ID NO: 40721 - RNA, 18 nt, Artificial Sequence
  Description of Artificial Sequence: Synthetic oligonucleotide
guaaaguuacuggucuca

SEQ ID NO: 40722 - RNA, 18 nt, Artificial Sequence
  Description of Artificial Sequence: Synthetic oligonucleotide
uuacaguaaaguuacugg

SEQ ID NO: 40723 - RNA, 18 nt, Artificial Sequence
  Description of Artificial Sequence: Synthetic oligonucleotide
uaaauuuacaguaaaguu

SEQ ID NO: 40724 - RNA, 18 nt, Artificial Sequence
  Description of Artificial Sequence: Synthetic oligonucleotide
caaaguaaauuuacagua

SEQ ID NO: 40725 - RNA, 18 nt, Artificial Sequence
  Description of Artificial Sequence: Synthetic oligonucleotide
ugaaacaaaguaaauuua

SEQ ID NO: 40726 - RNA, 18 nt, Artificial Sequence
  Description of Artificial Sequence: Synthetic oligonucleotide
uucaaugaaacaaaguaa

SEQ ID NO: 40727 - RNA, 18 nt, Artificial Sequence
  Description of Artificial Sequence: Synthetic oligonucleotide
guuuuuucaaugaaacaa

SEQ ID NO: 40728 - RNA, 18 nt, Artificial Sequence
  Description of Artificial Sequence: Synthetic oligonucleotide
aauuuguuuuuucaauga

SEQ ID NO: 40729 - RNA, 18 nt, Artificial Sequence
  Description of Artificial Sequence: Synthetic oligonucleotide
uuaucaauuuguuuuuuc

SEQ ID NO: 40730 - RNA, 18 nt, Artificial Sequence
  Description of Artificial Sequence: Synthetic oligonucleotide
uauguuuaucaauuuguu

SEQ ID NO: 40731 - RNA, 18 nt, Artificial Sequence
  Description of Artificial Sequence: Synthetic oligonucleotide
uuuaauauguuuaucaau

SEQ ID NO: 40732 - RNA, 18 nt, Artificial Sequence
  Description of Artificial Sequence: Synthetic oligonucleotide
uccaguuuaauauguuua

SEQ ID NO: 40733 - RNA, 18 nt, Artificial Sequence
  Description of Artificial Sequence: Synthetic oligonucleotide
auucuuccaguuuaauau

SEQ ID NO: 40734 - RNA, 18 nt, Artificial Sequence
  Description of Artificial Sequence: Synthetic oligonucleotide
agaaaauucuuccaguuu

SEQ ID NO: 40735 - RNA, 18 nt, Artificial Sequence
  Description of Artificial Sequence: Synthetic oligonucleotide
aauaaagaaaauucuucc

SEQ ID NO: 40736 - RNA, 18 nt, Artificial Sequence
  Description of Artificial Sequence: Synthetic oligonucleotide
auuugaauaaagaaaauu

SEQ ID NO: 40737 - RNA, 18 nt, Artificial Sequence
  Description of Artificial Sequence: Synthetic oligonucleotide
uuuucauuugaauaaaga

SEQ ID NO: 40738 - RNA, 18 nt, Artificial Sequence
  Description of Artificial Sequence: Synthetic oligonucleotide
acauguuuucauuugaau

SEQ ID NO: 40739 - RNA, 18 nt, Artificial Sequence
  Description of Artificial Sequence: Synthetic oligonucleotide
aucaaacauguuuucauu

SEQ ID NO: 40740 - RNA, 18 nt, Artificial Sequence
  Description of Artificial Sequence: Synthetic oligonucleotide
cagucaucaaacauguuu

SEQ ID NO: 40741 - RNA, 18 nt, Artificial Sequence
  Description of Artificial Sequence: Synthetic oligonucleotide
uugaccagucaucaaaca

SEQ ID NO: 40742 - RNA, 18 nt, Artificial Sequence
  Description of Artificial Sequence: Synthetic oligonucleotide
auuuuuugaccagucauc

SEQ ID NO: 40743 - RNA, 18 nt, Artificial Sequence
  Description of Artificial Sequence: Synthetic oligonucleotide
agcuuauuuuuugaccag

SEQ ID NO: 40744 - RNA, 18 nt, Artificial Sequence
  Description of Artificial Sequence: Synthetic oligonucleotide
uuaugagcuuauuuuuug

SEQ ID NO: 40745 - RNA, 18 nt, Artificial Sequence
  Description of Artificial Sequence: Synthetic oligonucleotide
auagauuaugagcuuauu

SEQ ID NO: 40746 - RNA, 18 nt, Artificial Sequence
  Description of Artificial Sequence: Synthetic oligonucleotide
aaaaaauagauuaugagc

SEQ ID NO: 40747 - RNA, 18 nt, Artificial Sequence
  Description of Artificial Sequence: Synthetic oligonucleotide
caugaaaaaaauagauua

SEQ ID NO: 40748 - RNA, 18 nt, Artificial Sequence
  Description of Artificial Sequence: Synthetic oligonucleotide
uacuacaugaaaaaaaua

SEQ ID NO: 40749 - RNA, 18 nt, Artificial Sequence
  Description of Artificial Sequence: Synthetic oligonucleotide
uuauauacuacaugaaaa

SEQ ID NO: 40750 - RNA, 18 nt, Artificial Sequence
  Description of Artificial Sequence: Synthetic oligonucleotide
uugacuuauauacuacau

SEQ ID NO: 40751 - RNA, 18 nt, Artificial Sequence
  Description of Artificial Sequence: Synthetic oligonucleotide
cauucuugacuuauauac

SEQ ID NO: 40752 - RNA, 18 nt, Artificial Sequence
  Description of Artificial Sequence: Synthetic oligonucleotide
uaaaacauucuugacuua

SEQ ID NO: 40753 - RNA, 18 nt, Artificial Sequence
  Description of Artificial Sequence: Synthetic oligonucleotide
gacaauaaaacauucuug

SEQ ID NO: 40754 - RNA, 18 nt, Artificial Sequence
  Description of Artificial Sequence: Synthetic oligonucleotide
auaaugacaauaaaacau

SEQ ID NO: 40755 - RNA, 18 nt, Artificial Sequence
  Description of Artificial Sequence: Synthetic oligonucleotide
uucacauaaugacaauaa

SEQ ID NO: 40756 - RNA, 18 nt, Artificial Sequence
  Description of Artificial Sequence: Synthetic oligonucleotide
uugguuucacauaaugac

SEQ ID NO: 40757 - RNA, 18 nt, Artificial Sequence
  Description of Artificial Sequence: Synthetic oligonucleotide
caauauugguuucacaua

SEQ ID NO: 40758 - RNA, 18 nt, Artificial Sequence
  Description of Artificial Sequence: Synthetic oligonucleotide
uuugccaauauugguuuc

SEQ ID NO: 40759 - RNA, 18 nt, Artificial Sequence
  Description of Artificial Sequence: Synthetic oligonucleotide
uacuauuugccaauauug

SEQ ID NO: 40760 - RNA, 18 nt, Artificial Sequence
  Description of Artificial Sequence: Synthetic oligonucleotide
uaaaguacuauuugccaa

SEQ ID NO: 40761 - RNA, 18 nt, Artificial Sequence
  Description of Artificial Sequence: Synthetic oligonucleotide
aucauuaaaguacuauuu

SEQ ID NO: 40762 - RNA, 18 nt, Artificial Sequence
  Description of Artificial Sequence: Synthetic oligonucleotide
acuucaucauuaaaguac

SEQ ID NO: 40763 - RNA, 18 nt, Artificial Sequence
  Description of Artificial Sequence: Synthetic oligonucleotide
cauuuacuucaucauuaa

SEQ ID NO: 40764 - RNA, 18 nt, Artificial Sequence
  Description of Artificial Sequence: Synthetic oligonucleotide
cuggucauuuacuucauc

SEQ ID NO: 40765 - RNA, 18 nt, Artificial Sequence
  Description of Artificial Sequence: Synthetic oligonucleotide
aauuucuggucauuuacu

SEQ ID NO: 40766 - RNA, 18 nt, Artificial Sequence
  Description of Artificial Sequence: Synthetic oligonucleotide
ucuauaauuucuggucau

SEQ ID NO: 40767 - RNA, 18 nt, Artificial Sequence
  Description of Artificial Sequence: Synthetic oligonucleotide
agauuucuauaauuucug

SEQ ID NO: 40768 - RNA, 18 nt, Artificial Sequence
  Description of Artificial Sequence: Synthetic oligonucleotide
aacacagauuucuauaau

SEQ ID NO: 40769 - RNA, 18 nt, Artificial Sequence
  Description of Artificial Sequence: Synthetic oligonucleotide
aggaaaacacagauuucu

SEQ ID NO: 40770 - RNA, 18 nt, Artificial Sequence
  Description of Artificial Sequence: Synthetic oligonucleotide
uuuacaggaaaacacaga

SEQ ID NO: 40771 - RNA, 18 nt, Artificial Sequence
  Description of Artificial Sequence: Synthetic oligonucleotide
cuauuuuuacaggaaaac

SEQ ID NO: 40772 - RNA, 18 nt, Artificial Sequence
  Description of Artificial Sequence: Synthetic oligonucleotide
uagugcuauuuuuacagg

SEQ ID NO: 40773 - RNA, 18 nt, Artificial Sequence
  Description of Artificial Sequence: Synthetic oligonucleotide
uacuauagugcuauuuuu

SEQ ID NO: 40774 - RNA, 18 nt, Artificial Sequence
  Description of Artificial Sequence: Synthetic oligonucleotide
agugauacuauagugcua

SEQ ID NO: 40775 - RNA, 18 nt, Artificial Sequence
  Description of Artificial Sequence: Synthetic oligonucleotide
guucaagugauacuauag

SEQ ID NO: 40776 - RNA, 18 nt, Artificial Sequence
  Description of Artificial Sequence: Synthetic oligonucleotide
aaauuguucaagugauac

SEQ ID NO: 40777 - RNA, 18 nt, Artificial Sequence
  Description of Artificial Sequence: Synthetic oligonucleotide
aaaucaaauuguucaagu

SEQ ID NO: 40778 - RNA, 18 nt, Artificial Sequence
  Description of Artificial Sequence: Synthetic oligonucleotide
aagccaaaucaaauuguu

SEQ ID NO: 40779 - RNA, 18 nt, Artificial Sequence
  Description of Artificial Sequence: Synthetic oligonucleotide
aaguaaagccaaaucaaa

SEQ ID NO: 40780 - RNA, 18 nt, Artificial Sequence
  Description of Artificial Sequence: Synthetic oligonucleotide
cuaguaaguaaagccaaa

SEQ ID NO: 40781 - RNA, 18 nt, Artificial Sequence
  Description of Artificial Sequence: Synthetic oligonucleotide
gcuuccuaguaaguaaag

SEQ ID NO: 40782 - RNA, 18 nt, Artificial Sequence
  Description of Artificial Sequence: Synthetic oligonucleotide
uccaggcuuccuaguaag

SEQ ID NO: 40783 - RNA, 18 nt, Artificial Sequence
  Description of Artificial Sequence: Synthetic oligonucleotide
ugaauuccaggcuuccua

SEQ ID NO: 40784 - RNA, 18 nt, Artificial Sequence
  Description of Artificial Sequence: Synthetic oligonucleotide
aauaaugaauuccaggcu

SEQ ID NO: 40785 - RNA, 18 nt, Artificial Sequence
  Description of Artificial Sequence: Synthetic oligonucleotide
aaaaaaauaaugaauucc

SEQ ID NO: 40786 - RNA, 18 nt, Artificial Sequence
  Description of Artificial Sequence: Synthetic oligonucleotide
aaaggaaaaaaauaauga

SEQ ID NO: 40787 - RNA, 18 nt, Artificial Sequence
  Description of Artificial Sequence: Synthetic oligonucleotide
acauaaaaggaaaaaaau

SEQ ID NO: 40788 - RNA, 18 nt, Artificial Sequence
  Description of Artificial Sequence: Synthetic oligonucleotide
guggcacauaaaaggaaa

SEQ ID NO: 40789 - RNA, 18 nt, Artificial Sequence
  Description of Artificial Sequence: Synthetic oligonucleotide
ccacaguggcacauaaaa

SEQ ID NO: 40790 - RNA, 18 nt, Artificial Sequence
  Description of Artificial Sequence: Synthetic oligonucleotide
aguagccacaguggcaca

SEQ ID NO: 40791 - RNA, 18 nt, Artificial Sequence
  Description of Artificial Sequence: Synthetic oligonucleotide
uuuaaaguagccacagug

SEQ ID NO: 40792 - RNA, 18 nt, Artificial Sequence
  Description of Artificial Sequence: Synthetic oligonucleotide
agugauuuaaaguagcca

SEQ ID NO: 40793 - RNA, 18 nt, Artificial Sequence
  Description of Artificial Sequence: Synthetic oligonucleotide
cucagagugauuuaaagu

SEQ ID NO: 40794 - RNA, 18 nt, Artificial Sequence
  Description of Artificial Sequence: Synthetic oligonucleotide
uaccucucagagugauuu

SEQ ID NO: 40795 - RNA, 18 nt, Artificial Sequence
  Description of Artificial Sequence: Synthetic oligonucleotide
ccauuuaccucucagagu

SEQ ID NO: 40796 - RNA, 18 nt, Artificial Sequence
  Description of Artificial Sequence: Synthetic oligonucleotide
uauauccauuuaccucuc

SEQ ID NO: 40797 - RNA, 18 nt, Artificial Sequence
  Description of Artificial Sequence: Synthetic oligonucleotide
aauccuauauccauuuac

SEQ ID NO: 40798 - RNA, 18 nt, Artificial Sequence
  Description of Artificial Sequence: Synthetic oligonucleotide
acuucaauccuauaucca

SEQ ID NO: 40799 - RNA, 18 nt, Artificial Sequence
  Description of Artificial Sequence: Synthetic oligonucleotide
acauaacuucaauccuau

SEQ ID NO: 40800 - RNA, 18 nt, Artificial Sequence
  Description of Artificial Sequence: Synthetic oligonucleotide
uacccacauaacuucaau

SEQ ID NO: 40801 - RNA, 18 nt, Artificial Sequence
  Description of Artificial Sequence: Synthetic oligonucleotide
ccaaauacccacauaacu

SEQ ID NO: 40802 - RNA, 18 nt, Artificial Sequence
  Description of Artificial Sequence: Synthetic oligonucleotide
acaugccaaauacccaca

SEQ ID NO: 40803 - RNA, 18 nt, Artificial Sequence
  Description of Artificial Sequence: Synthetic oligonucleotide
cacacacaugccaaauac

SEQ ID NO: 40804 - RNA, 18 nt, Artificial Sequence
  Description of Artificial Sequence: Synthetic oligonucleotide
uuucacacacacaugcca

SEQ ID NO: 40805 - RNA, 18 nt, Artificial Sequence
  Description of Artificial Sequence: Synthetic oligonucleotide
auuuauuucacacacaca

SEQ ID NO: 40806 - RNA, 18 nt, Artificial Sequence
  Description of Artificial Sequence: Synthetic oligonucleotide
uacauauuuauuucacac

SEQ ID NO: 40807 - RNA, 18 nt, Artificial Sequence
  Description of Artificial Sequence: Synthetic oligonucleotide
cuaucuacauauuuauuu

SEQ ID NO: 40808 - RNA, 18 nt, Artificial Sequence
  Description of Artificial Sequence: Synthetic oligonucleotide
ugugacuaucuacauauu

SEQ ID NO: 40809 - RNA, 18 nt, Artificial Sequence
  Description of Artificial Sequence: Synthetic oligonucleotide
guauaugugacuaucuac

SEQ ID NO: 40810 - RNA, 18 nt, Artificial Sequence
  Description of Artificial Sequence: Synthetic oligonucleotide
ucuguguauaugugacua

SEQ ID NO: 40811 - RNA, 18 nt, Artificial Sequence
  Description of Artificial Sequence: Synthetic oligonucleotide
cucagucuguguauaugu

SEQ ID NO: 40812 - RNA, 18 nt, Artificial Sequence
  Description of Artificial Sequence: Synthetic oligonucleotide
uaucucucagucugugua

SEQ ID NO: 40813 - RNA, 18 nt, Artificial Sequence
  Description of Artificial Sequence: Synthetic oligonucleotide
caauuuaucucucagucu

SEQ ID NO: 40814 - RNA, 18 nt, Artificial Sequence
  Description of Artificial Sequence: Synthetic oligonucleotide
aagaacaauuuaucucuc

SEQ ID NO: 40815 - RNA, 18 nt, Artificial Sequence
  Description of Artificial Sequence: Synthetic oligonucleotide
caaucaagaacaauuuau

SEQ ID NO: 40816 - RNA, 18 nt, Artificial Sequence
  Description of Artificial Sequence: Synthetic oligonucleotide
uaaagcaaucaagaacaa

SEQ ID NO: 40817 - RNA, 18 nt, Artificial Sequence
  Description of Artificial Sequence: Synthetic oligonucleotide
gauaauaaagcaaucaag

SEQ ID NO: 40818 - RNA, 18 nt, Artificial Sequence
  Description of Artificial Sequence: Synthetic oligonucleotide
augaugauaauaaagcaa

SEQ ID NO: 40819 - RNA, 18 nt, Artificial Sequence
  Description of Artificial Sequence: Synthetic oligonucleotide
cuaguaugaugauaauaa

SEQ ID NO: 40820 - RNA, 18 nt, Artificial Sequence
  Description of Artificial Sequence: Synthetic oligonucleotide
acacacuaguaugaugau

SEQ ID NO: 40821 - RNA, 18 nt, Artificial Sequence
  Description of Artificial Sequence: Synthetic oligonucleotide
aaugaacacacuaguaug

SEQ ID NO: 40822 - RNA, 18 nt, Artificial Sequence
  Description of Artificial Sequence: Synthetic oligonucleotide
ucuauaaugaacacacua

SEQ ID NO: 40823 - RNA, 18 nt, Artificial Sequence
  Description of Artificial Sequence: Synthetic oligonucleotide
gauacucuauaaugaaca

SEQ ID NO: 40824 - RNA, 18 nt, Artificial Sequence
  Description of Artificial Sequence: Synthetic oligonucleotide
cuacagauacucuauaau

SEQ ID NO: 40825 - RNA, 18 nt, Artificial Sequence
  Description of Artificial Sequence: Synthetic oligonucleotide
caccucuacagauacucu

SEQ ID NO: 40826 - RNA, 18 nt, Artificial Sequence
  Description of Artificial Sequence: Synthetic oligonucleotide
acauucaccucuacagau

SEQ ID NO: 40827 - RNA, 18 nt, Artificial Sequence
  Description of Artificial Sequence: Synthetic oligonucleotide
cuuuuacauucaccucua

SEQ ID NO: 40828 - RNA, 18 nt, Artificial Sequence
  Description of Artificial Sequence: Synthetic oligonucleotide
acuuacuuuuacauucac

SEQ ID NO: 40829 - RNA, 18 nt, Artificial Sequence
  Description of Artificial Sequence: Synthetic oligonucleotide
auuggacuuacuuuuaca

SEQ ID NO: 40830 - RNA, 18 nt, Artificial Sequence
  Description of Artificial Sequence: Synthetic oligonucleotide
aauagauuggacuuacuu

SEQ ID NO: 40831 - RNA, 18 nt, Artificial Sequence
  Description of Artificial Sequence: Synthetic oligonucleotide
aagaaaauagauuggacu

SEQ ID NO: 40832 - RNA, 18 nt, Artificial Sequence
  Description of Artificial Sequence: Synthetic oligonucleotide
gacauaagaaaauagauu

SEQ ID NO: 40833 - RNA, 18 nt, Artificial Sequence
  Description of Artificial Sequence: Synthetic oligonucleotide
ucaaugacauaagaaaau

SEQ ID NO: 40834 - RNA, 18 nt, Artificial Sequence
  Description of Artificial Sequence: Synthetic oligonucleotide
caaauucaaugacauaag

SEQ ID NO: 40835 - RNA, 18 nt, Artificial Sequence
  Description of Artificial Sequence: Synthetic oligonucleotide
cacuacaaauucaaugac

SEQ ID NO: 40836 - RNA, 18 nt, Artificial Sequence
  Description of Artificial Sequence: Synthetic oligonucleotide
guuaacacuacaaauuca

SEQ ID NO: 40837 - RNA, 18 nt, Artificial Sequence
  Description of Artificial Sequence: Synthetic oligonucleotide
ugcaaguuaacacuacaa

SEQ ID NO: 40838 - RNA, 18 nt, Artificial Sequence
  Description of Artificial Sequence: Synthetic oligonucleotide
auauaugcaaguuaacac

SEQ ID NO: 40839 - RNA, 18 nt, Artificial Sequence
  Description of Artificial Sequence: Synthetic oligonucleotide
auaacauauaugcaaguu

SEQ ID NO: 40840 - RNA, 18 nt, Artificial Sequence
  Description of Artificial Sequence: Synthetic oligonucleotide
auccaauaacauauaugc

SEQ ID NO: 40841 - RNA, 18 nt, Artificial Sequence
  Description of Artificial Sequence: Synthetic oligonucleotide
aacccauccaauaacaua

SEQ ID NO: 40842 - RNA, 18 nt, Artificial Sequence
  Description of Artificial Sequence: Synthetic oligonucleotide
aagacaacccauccaaua

SEQ ID NO: 40843 - RNA, 18 nt, Artificial Sequence
  Description of Artificial Sequence: Synthetic oligonucleotide
uuuaaaagacaacccauc

SEQ ID NO: 40844 - RNA, 18 nt, Artificial Sequence
  Description of Artificial Sequence: Synthetic oligonucleotide
aaugcuuuaaaagacaac

SEQ ID NO: 40845 - RNA, 18 nt, Artificial Sequence
  Description of Artificial Sequence: Synthetic oligonucleotide
uaguaaaugcuuuaaaag

SEQ ID NO: 40846 - RNA, 18 nt, Artificial Sequence
  Description of Artificial Sequence: Synthetic oligonucleotide
uacauuaguaaaugcuuu

SEQ ID NO: 40847 - RNA, 18 nt, Artificial Sequence
  Description of Artificial Sequence: Synthetic oligonucleotide
cagaguacauuaguaaau

SEQ ID NO: 40848 - RNA, 18 nt, Artificial Sequence
  Description of Artificial Sequence: Synthetic oligonucleotide
aauuucagaguacauuag

SEQ ID NO: 40849 - RNA, 18 nt, Artificial Sequence
  Description of Artificial Sequence: Synthetic oligonucleotide
uuaaaaauuucagaguac

SEQ ID NO: 40850 - RNA, 18 nt, Artificial Sequence
  Description of Artificial Sequence: Synthetic oligonucleotide
ggcuuuuaaaaauuucag

SEQ ID NO: 40851 - RNA, 18 nt, Artificial Sequence
  Description of Artificial Sequence: Synthetic oligonucleotide
cugaaggcuuuuaaaaau

SEQ ID NO: 40852 - RNA, 18 nt, Artificial Sequence
  Description of Artificial Sequence: Synthetic oligonucleotide
caaaucugaaggcuuuua

SEQ ID NO: 40853 - RNA, 18 nt, Artificial Sequence
  Description of Artificial Sequence: Synthetic oligonucleotide
gaaaacaaaucugaaggc

SEQ ID NO: 40854 - RNA, 18 nt, Artificial Sequence
  Description of Artificial Sequence: Synthetic oligonucleotide
gacuagaaaacaaaucug

SEQ ID NO: 40855 - RNA, 18 nt, Artificial Sequence
  Description of Artificial Sequence: Synthetic oligonucleotide
aaagugacuagaaaacaa

SEQ ID NO: 40856 - RNA, 18 nt, Artificial Sequence
  Description of Artificial Sequence: Synthetic oligonucleotide
ggaaaaaagugacuagaa

SEQ ID NO: 40857 - RNA, 18 nt, Artificial Sequence
  Description of Artificial Sequence: Synthetic oligonucleotide
gauauggaaaaaagugac

SEQ ID NO: 40858 - RNA, 18 nt, Artificial Sequence
  Description of Artificial Sequence: Synthetic oligonucleotide
gaaaugauauggaaaaaa

SEQ ID NO: 40859 - RNA, 18 nt, Artificial Sequence
  Description of Artificial Sequence: Synthetic oligonucleotide
aauuagaaaugauaugga

SEQ ID NO: 40860 - RNA, 18 nt, Artificial Sequence
  Description of Artificial Sequence: Synthetic oligonucleotide
acuauaauuagaaaugau

SEQ ID NO: 40861 - RNA, 18 nt, Artificial Sequence
  Description of Artificial Sequence: Synthetic oligonucleotide
uauaaacuauaauuagaa

SEQ ID NO: 40862 - RNA, 18 nt, Artificial Sequence
  Description of Artificial Sequence: Synthetic oligonucleotide
aaggauauaaacuauaau

SEQ ID NO: 40863 - RNA, 18 nt, Artificial Sequence
  Description of Artificial Sequence: Synthetic oligonucleotide
cuuuuaaggauauaaacu

SEQ ID NO: 40864 - RNA, 18 nt, Artificial Sequence
  Description of Artificial Sequence: Synthetic oligonucleotide
uccuucuuuuaaggauau

SEQ ID NO: 40865 - RNA, 18 nt, Artificial Sequence
  Description of Artificial Sequence: Synthetic oligonucleotide
uggcauccuucuuuuaag

SEQ ID NO: 40866 - RNA, 18 nt, Artificial Sequence
  Description of Artificial Sequence: Synthetic oligonucleotide
uacuguggcauccuucuu

SEQ ID NO: 40867 - RNA, 18 nt, Artificial Sequence
  Description of Artificial Sequence: Synthetic oligonucleotide
cauacuacuguggcaucc

SEQ ID NO: 40868 - RNA, 18 nt, Artificial Sequence
  Description of Artificial Sequence: Synthetic oligonucleotide
uuuuacauacuacugugg

SEQ ID NO: 40869 - RNA, 18 nt, Artificial Sequence
  Description of Artificial Sequence: Synthetic oligonucleotide
uuggguuuuacauacuac

SEQ ID NO: 40870 - RNA, 18 nt, Artificial Sequence
  Description of Artificial Sequence: Synthetic oligonucleotide
cuuguuuggguuuuacau

SEQ ID NO: 40871 - RNA, 18 nt, Artificial Sequence
  Description of Artificial Sequence: Synthetic oligonucleotide
uucuacuuguuuggguuu

SEQ ID NO: 40872 - RNA, 18 nt, Artificial Sequence
  Description of Artificial Sequence: Synthetic oligonucleotide
uuggguucuacuuguuug

SEQ ID NO: 40873 - RNA, 18 nt, Artificial Sequence
  Description of Artificial Sequence: Synthetic oligonucleotide
uuugcuuggguucuacuu

SEQ ID NO: 40874 - RNA, 18 nt, Artificial Sequence
  Description of Artificial Sequence: Synthetic oligonucleotide
uuuuauuugcuuggguuc

SEQ ID NO: 40875 - RNA, 18 nt, Artificial Sequence
  Description of Artificial Sequence: Synthetic oligonucleotide
aauaauuuuauuugcuug

SEQ ID NO: 40876 - RNA, 18 nt, Artificial Sequence
  Description of Artificial Sequence: Synthetic oligonucleotide
uuuuaaauaauuuuauuu

SEQ ID NO: 40877 - RNA, 18 nt, Artificial Sequence
  Description of Artificial Sequence: Synthetic oligonucleotide
aauuauuuuaaauaauuu

SEQ ID NO: 40878 - RNA, 18 nt, Artificial Sequence
  Description of Artificial Sequence: Synthetic oligonucleotide
uuuaaaauuauuuuaaau

SEQ ID NO: 40879 - RNA, 18 nt, Artificial Sequence
  Description of Artificial Sequence: Synthetic oligonucleotide
gccacuuuaaaauuauuu

SEQ ID NO: 40880 - RNA, 18 nt, Artificial Sequence
  Description of Artificial Sequence: Synthetic oligonucleotide
acuaagccacuuuaaaau

SEQ ID NO: 40881 - RNA, 18 nt, Artificial Sequence
  Description of Artificial Sequence: Synthetic oligonucleotide
gcaguacuaagccacuuu

SEQ ID NO: 40882 - RNA, 18 nt, Artificial Sequence
  Description of Artificial Sequence: Synthetic oligonucleotide
gacuggcaguacuaagcc

SEQ ID NO: 40883 - RNA, 18 nt, Artificial Sequence
  Description of Artificial Sequence: Synthetic oligonucleotide
uacaugacuggcaguacu

SEQ ID NO: 40884 - RNA, 18 nt, Artificial Sequence
  Description of Artificial Sequence: Synthetic oligonucleotide
caauuuacaugacuggca

SEQ ID NO: 40885 - RNA, 18 nt, Artificial Sequence
  Description of Artificial Sequence: Synthetic oligonucleotide
agaaucaauuuacaugac

SEQ ID NO: 40886 - RNA, 18 nt, Artificial Sequence
  Description of Artificial Sequence: Synthetic oligonucleotide
ucagcagaaucaauuuac

SEQ ID NO: 40887 - RNA, 18 nt, Artificial Sequence
  Description of Artificial Sequence: Synthetic oligonucleotide
gacccucagcagaaucaa

SEQ ID NO: 40888 - RNA, 18 nt, Artificial Sequence
  Description of Artificial Sequence: Synthetic oligonucleotide
uauaagacccucagcaga

SEQ ID NO: 40889 - RNA, 18 nt, Artificial Sequence
  Description of Artificial Sequence: Synthetic oligonucleotide
auucuuauaagacccuca

SEQ ID NO: 40890 - RNA, 18 nt, Artificial Sequence
  Description of Artificial Sequence: Synthetic oligonucleotide
ucucaauucuuauaagac

SEQ ID NO: 40891 - RNA, 18 nt, Artificial Sequence
  Description of Artificial Sequence: Synthetic oligonucleotide
uuauaucucaauucuuau

SEQ ID NO: 40892 - RNA, 18 nt, Artificial Sequence
  Description of Artificial Sequence: Synthetic oligonucleotide
cauuguuauaucucaauu

SEQ ID NO: 40893 - RNA, 18 nt, Artificial Sequence
  Description of Artificial Sequence: Synthetic oligonucleotide
uuuaccauuguuauaucu

SEQ ID NO: 40894 - RNA, 18 nt, Artificial Sequence
  Description of Artificial Sequence: Synthetic oligonucleotide
cuuguuuuaccauuguua

SEQ ID NO: 40895 - RNA, 18 nt, Artificial Sequence
  Description of Artificial Sequence: Synthetic oligonucleotide
gaaugcuuguuuuaccau

SEQ ID NO: 40896 - RNA, 18 nt, Artificial Sequence
  Description of Artificial Sequence: Synthetic oligonucleotide
ugcuugaaugcuuguuuu

SEQ ID NO: 40897 - RNA, 18 nt, Artificial Sequence
  Description of Artificial Sequence: Synthetic oligonucleotide
aaaagugcuugaaugcuu

SEQ ID NO: 40898 - RNA, 18 nt, Artificial Sequence
  Description of Artificial Sequence: Synthetic oligonucleotide
uuuguaaaagugcuugaa

SEQ ID NO: 40899 - RNA, 18 nt, Artificial Sequence
  Description of Artificial Sequence: Synthetic oligonucleotide
guaauuuuguaaaagugc

SEQ ID NO: 40900 - RNA, 18 nt, Artificial Sequence
  Description of Artificial Sequence: Synthetic oligonucleotide
auuugguaauuuuguaaa

SEQ ID NO: 40901 - RNA, 18 nt, Artificial Sequence
  Description of Artificial Sequence: Synthetic oligonucleotide
uaagaauuugguaauuuu

SEQ ID NO: 40902 - RNA, 18 nt, Artificial Sequence
  Description of Artificial Sequence: Synthetic oligonucleotide
cauuuuaagaauuuggua

SEQ ID NO: 40903 - RNA, 18 nt, Artificial Sequence
  Description of Artificial Sequence: Synthetic oligonucleotide
ggcuucauuuuaagaauu

SEQ ID NO: 40904 - RNA, 18 nt, Artificial Sequence
  Description of Artificial Sequence: Synthetic oligonucleotide
gcuguggcuucauuuuaa

SEQ ID NO: 40905 - RNA, 18 nt, Artificial Sequence
  Description of Artificial Sequence: Synthetic oligonucleotide
gucuagcuguggcuucau

SEQ ID NO: 40906 - RNA, 18 nt, Artificial Sequence
  Description of Artificial Sequence: Synthetic oligonucleotide
ugcaagucuagcuguggc

SEQ ID NO: 40907 - RNA, 18 nt, Artificial Sequence
  Description of Artificial Sequence: Synthetic oligonucleotide
ugaaaugcaagucuagcu

SEQ ID NO: 40908 - RNA, 18 nt, Artificial Sequence
  Description of Artificial Sequence: Synthetic oligonucleotide
auaccugaaaugcaaguc

SEQ ID NO: 40909 - RNA, 18 nt, Artificial Sequence
  Description of Artificial Sequence: Synthetic oligonucleotide
uuuuaauaccugaaaugc

SEQ ID NO: 40910 - RNA, 18 nt, Artificial Sequence
  Description of Artificial Sequence: Synthetic oligonucleotide
agcaauuuuaauaccuga

SEQ ID NO: 40911 - RNA, 18 nt, Artificial Sequence
  Description of Artificial Sequence: Synthetic oligonucleotide
aagaaagcaauuuuaaua

SEQ ID NO: 40912 - RNA, 18 nt, Artificial Sequence
  Description of Artificial Sequence: Synthetic oligonucleotide
caguuaagaaagcaauuu

SEQ ID NO: 40913 - RNA, 18 nt, Artificial Sequence
  Description of Artificial Sequence: Synthetic oligonucleotide
cuugacaguuaagaaagc

SEQ ID NO: 40914 - RNA, 18 nt, Artificial Sequence
  Description of Artificial Sequence: Synthetic oligonucleotide
ugauucuugacaguuaag

SEQ ID NO: 40915 - RNA, 18 nt, Artificial Sequence
  Description of Artificial Sequence: Synthetic oligonucleotide
uuuugugauucuugacag

SEQ ID NO: 40916 - RNA, 18 nt, Artificial Sequence
  Description of Artificial Sequence: Synthetic oligonucleotide
uguuauuuugugauucuu

SEQ ID NO: 40917 - RNA, 18 nt, Artificial Sequence
  Description of Artificial Sequence: Synthetic oligonucleotide
ugauuuguuauuuuguga

SEQ ID NO: 40918 - RNA, 18 nt, Artificial Sequence
  Description of Artificial Sequence: Synthetic oligonucleotide
uaauaugauuuguuauuu

SEQ ID NO: 40919 - RNA, 18 nt, Artificial Sequence
  Description of Artificial Sequence: Synthetic oligonucleotide
acucauaauaugauuugu

SEQ ID NO: 40920 - RNA, 18 nt, Artificial Sequence
  Description of Artificial Sequence: Synthetic oligonucleotide
uauucacucauaauauga

SEQ ID NO: 40921 - RNA, 18 nt, Artificial Sequence
  Description of Artificial Sequence: Synthetic oligonucleotide
ccccauauucacucauaa

SEQ ID NO: 40922 - RNA, 18 nt, Artificial Sequence
  Description of Artificial Sequence: Synthetic oligonucleotide
gcccuccccauauucacu

SEQ ID NO: 40923 - RNA, 18 nt, Artificial Sequence
  Description of Artificial Sequence: Synthetic oligonucleotide
gccccgcccuccccauau

SEQ ID NO: 40924 - RNA, 18 nt, Artificial Sequence
  Description of Artificial Sequence: Synthetic oligonucleotide
gauuggccccgcccuccc

SEQ ID NO: 40925 - RNA, 18 nt, Artificial Sequence
  Description of Artificial Sequence: Synthetic oligonucleotide
ugacugauuggccccgcc

SEQ ID NO: 40926 - RNA, 18 nt, Artificial Sequence
  Description of Artificial Sequence: Synthetic oligonucleotide
aucauugacugauuggcc

SEQ ID NO: 40927 - RNA, 18 nt, Artificial Sequence
  Description of Artificial Sequence: Synthetic oligonucleotide
agauuaucauugacugau

SEQ ID NO: 40928 - RNA, 18 nt, Artificial Sequence
  Description of Artificial Sequence: Synthetic oligonucleotide
uguucagauuaucauuga

SEQ ID NO: 40929 - RNA, 18 nt, Artificial Sequence
  Description of Artificial Sequence: Synthetic oligonucleotide
aaauuuguucagauuauc

SEQ ID NO: 40930 - RNA, 18 nt, Artificial Sequence
  Description of Artificial Sequence: Synthetic oligonucleotide
ucuuaaaauuuguucaga

SEQ ID NO: 40931 - RNA, 18 nt, Artificial Sequence
  Description of Artificial Sequence: Synthetic oligonucleotide
ucugcucuuaaaauuugu

SEQ ID NO: 40932 - RNA, 18 nt, Artificial Sequence
  Description of Artificial Sequence: Synthetic oligonucleotide
uaaaaucugcucuuaaaa

SEQ ID NO: 40933 - RNA, 18 nt, Artificial Sequence
  Description of Artificial Sequence: Synthetic oligonucleotide
uaaucuaaaaucugcucu

SEQ ID NO: 40934 - RNA, 18 nt, Artificial Sequence
  Description of Artificial Sequence: Synthetic oligonucleotide
auuauuaaucuaaaaucu

SEQ ID NO: 40935 - RNA, 18 nt, Artificial Sequence
  Description of Artificial Sequence: Synthetic oligonucleotide
aaaacauuauuaaucuaa

SEQ ID NO: 40936 - RNA, 18 nt, Artificial Sequence
  Description of Artificial Sequence: Synthetic oligonucleotide
gugauaaaacauuauuaa

SEQ ID NO: 40937 - RNA, 18 nt, Artificial Sequence
  Description of Artificial Sequence: Synthetic oligonucleotide
uaguggugauaaaacauu

SEQ ID NO: 40938 - RNA, 18 nt, Artificial Sequence
  Description of Artificial Sequence: Synthetic oligonucleotide
caaauuaguggugauaaa

SEQ ID NO: 40939 - RNA, 18 nt, Artificial Sequence
  Description of Artificial Sequence: Synthetic oligonucleotide
gugggcaaauuaguggug

SEQ ID NO: 40940 - RNA, 18 nt, Artificial Sequence
  Description of Artificial Sequence: Synthetic oligonucleotide
uuguugugggcaaauuag

SEQ ID NO: 40941 - RNA, 18 nt, Artificial Sequence
  Description of Artificial Sequence: Synthetic oligonucleotide
ugaguuuguugugggcaa

SEQ ID NO: 40942 - RNA, 18 nt, Artificial Sequence
  Description of Artificial Sequence: Synthetic oligonucleotide
aauacugaguuuguugug

SEQ ID NO: 40943 - RNA, 18 nt, Artificial Sequence
  Description of Artificial Sequence: Synthetic oligonucleotide
aauuaaauacugaguuug

SEQ ID NO: 40944 - RNA, 18 nt, Artificial Sequence
  Description of Artificial Sequence: Synthetic oligonucleotide
ugaaaaauuaaauacuga

SEQ ID NO: 40945 - RNA, 18 nt, Artificial Sequence
  Description of Artificial Sequence: Synthetic oligonucleotide
uaauuugaaaaauuaaau

SEQ ID NO: 40946 - RNA, 18 nt, Artificial Sequence
  Description of Artificial Sequence: Synthetic oligonucleotide
auauuuaauuugaaaaau

SEQ ID NO: 40947 - RNA, 18 nt, Artificial Sequence
  Description of Artificial Sequence: Synthetic oligonucleotide
auuuaauauuuaauuuga

SEQ ID NO: 40948 - RNA, 18 nt, Artificial Sequence
  Description of Artificial Sequence: Synthetic oligonucleotide
aaauaauuuaauauuuaa

SEQ ID NO: 40949 - RNA, 18 nt, Artificial Sequence
  Description of Artificial Sequence: Synthetic oligonucleotide
uacuuaaauaauuuaaua

SEQ ID NO: 40950 - RNA, 18 nt, Artificial Sequence
  Description of Artificial Sequence: Synthetic oligonucleotide
uaaaauacuuaaauaauu

SEQ ID NO: 40951 - RNA, 18 nt, Artificial Sequence
  Description of Artificial Sequence: Synthetic oligonucleotide
uuauuuaaaauacuuaaa

SEQ ID NO: 40952 - RNA, 18 nt, Artificial Sequence
  Description of Artificial Sequence: Synthetic oligonucleotide
uuuaauuauuuaaaauac

SEQ ID NO: 40953 - RNA, 18 nt, Artificial Sequence
  Description of Artificial Sequence: Synthetic oligonucleotide
aauguuuuaauuauuuaa

SEQ ID NO: 40954 - RNA, 18 nt, Artificial Sequence
  Description of Artificial Sequence: Synthetic oligonucleotide
cauuuaauguuuuaauua

SEQ ID NO: 40955 - RNA, 18 nt, Artificial Sequence
  Description of Artificial Sequence: Synthetic oligonucleotide
guugccauuuaauguuuu

SEQ ID NO: 40956 - RNA, 18 nt, Artificial Sequence
  Description of Artificial Sequence: Synthetic oligonucleotide
augguguugccauuuaau

SEQ ID NO: 40957 - RNA, 18 nt, Artificial Sequence
  Description of Artificial Sequence: Synthetic oligonucleotide
auucuaugguguugccau

SEQ ID NO: 40958 - RNA, 18 nt, Artificial Sequence
  Description of Artificial Sequence: Synthetic oligonucleotide
ccuauauucuaugguguu

SEQ ID NO: 40959 - RNA, 18 nt, Artificial Sequence
  Description of Artificial Sequence: Synthetic oligonucleotide
gaacaccuauauucuaug

SEQ ID NO: 40960 - RNA, 18 nt, Artificial Sequence
  Description of Artificial Sequence: Synthetic oligonucleotide
ccagagaacaccuauauu

SEQ ID NO: 40961 - RNA, 18 nt, Artificial Sequence
  Description of Artificial Sequence: Synthetic oligonucleotide
uagguccagagaacaccu

SEQ ID NO: 40962 - RNA, 18 nt, Artificial Sequence
  Description of Artificial Sequence: Synthetic oligonucleotide
uagaauagguccagagaa

SEQ ID NO: 40963 - RNA, 18 nt, Artificial Sequence
  Description of Artificial Sequence: Synthetic oligonucleotide
gugguuagaauaggucca

SEQ ID NO: 40964 - RNA, 18 nt, Artificial Sequence
  Description of Artificial Sequence: Synthetic oligonucleotide
uuuaagugguuagaauag

SEQ ID NO: 40965 - RNA, 18 nt, Artificial Sequence
  Description of Artificial Sequence: Synthetic oligonucleotide
auaauuuuaagugguuag

SEQ ID NO: 40966 - RNA, 18 nt, Artificial Sequence
  Description of Artificial Sequence: Synthetic oligonucleotide
uuaagauaauuuuaagug

SEQ ID NO: 40967 - RNA, 18 nt, Artificial Sequence
  Description of Artificial Sequence: Synthetic oligonucleotide
cauacuuaagauaauuuu

SEQ ID NO: 40968 - RNA, 18 nt, Artificial Sequence
  Description of Artificial Sequence: Synthetic oligonucleotide
guaugcauacuuaagaua

SEQ ID NO: 40969 - RNA, 18 nt, Artificial Sequence
  Description of Artificial Sequence: Synthetic oligonucleotide
uuuauguaugcauacuua

SEQ ID NO: 40970 - RNA, 18 nt, Artificial Sequence
  Description of Artificial Sequence: Synthetic oligonucleotide
uugcuuuuauguaugcau

SEQ ID NO: 40971 - RNA, 18 nt, Artificial Sequence
  Description of Artificial Sequence: Synthetic oligonucleotide
agugguugcuuuuaugua

SEQ ID NO: 40972 - RNA, 18 nt, Artificial Sequence
  Description of Artificial Sequence: Synthetic oligonucleotide
cucauagugguugcuuuu

SEQ ID NO: 40973 - RNA, 18 nt, Artificial Sequence
  Description of Artificial Sequence: Synthetic oligonucleotide
uaguucucauagugguug

SEQ ID NO: 40974 - RNA, 18 nt, Artificial Sequence
  Description of Artificial Sequence: Synthetic oligonucleotide
cacgguaguucucauagu

SEQ ID NO: 40975 - RNA, 18 nt, Artificial Sequence
  Description of Artificial Sequence: Synthetic oligonucleotide
acuaacacgguaguucuc

SEQ ID NO: 40976 - RNA, 18 nt, Artificial Sequence
  Description of Artificial Sequence: Synthetic oligonucleotide
aaaccacuaacacgguag

SEQ ID NO: 40977 - RNA, 18 nt, Artificial Sequence
  Description of Artificial Sequence: Synthetic oligonucleotide
gugaaaaaccacuaacac

SEQ ID NO: 40978 - RNA, 18 nt, Artificial Sequence
  Description of Artificial Sequence: Synthetic oligonucleotide
aguaagugaaaaaccacu

SEQ ID NO: 40979 - RNA, 18 nt, Artificial Sequence
  Description of Artificial Sequence: Synthetic oligonucleotide
uauacaguaagugaaaaa

SEQ ID NO: 40980 - RNA, 18 nt, Artificial Sequence
  Description of Artificial Sequence: Synthetic oligonucleotide
gguaauauacaguaagug

SEQ ID NO: 40981 - RNA, 18 nt, Artificial Sequence
  Description of Artificial Sequence: Synthetic oligonucleotide
acaaggguaauauacagu

SEQ ID NO: 40982 - RNA, 18 nt, Artificial Sequence
  Description of Artificial Sequence: Synthetic oligonucleotide
uuccuacaaggguaauau

SEQ ID NO: 40983 - RNA, 18 nt, Artificial Sequence
  Description of Artificial Sequence: Synthetic oligonucleotide
aacuauuccuacaagggu

SEQ ID NO: 40984 - RNA, 18 nt, Artificial Sequence
  Description of Artificial Sequence: Synthetic oligonucleotide
ccuuaaacuauuccuaca

SEQ ID NO: 40985 - RNA, 18 nt, Artificial Sequence
  Description of Artificial Sequence: Synthetic oligonucleotide
aauuuccuuaaacuauuc

SEQ ID NO: 40986 - RNA, 18 nt, Artificial Sequence
  Description of Artificial Sequence: Synthetic oligonucleotide
aaaugaauuuccuuaaac

SEQ ID NO: 40987 - RNA, 18 nt, Artificial Sequence
  Description of Artificial Sequence: Synthetic oligonucleotide
uuaagaaaugaauuuccu

SEQ ID NO: 40988 - RNA, 18 nt, Artificial Sequence
  Description of Artificial Sequence: Synthetic oligonucleotide
uauuuuuaagaaaugaau

SEQ ID NO: 40989 - RNA, 18 nt, Artificial Sequence
  Description of Artificial Sequence: Synthetic oligonucleotide
cacuauauuuuuaagaaa

SEQ ID NO: 40990 - RNA, 18 nt, Artificial Sequence
  Description of Artificial Sequence: Synthetic oligonucleotide
gaggacacuauauuuuua

SEQ ID NO: 40991 - RNA, 18 nt, Artificial Sequence
  Description of Artificial Sequence: Synthetic oligonucleotide
uauuugaggacacuauau

SEQ ID NO: 40992 - RNA, 18 nt, Artificial Sequence
  Description of Artificial Sequence: Synthetic oligonucleotide
uuaauuauuugaggacac

SEQ ID NO: 40993 - RNA, 18 nt, Artificial Sequence
  Description of Artificial Sequence: Synthetic oligonucleotide
aaaaauuaauuauuugag

SEQ ID NO: 40994 - RNA, 18 nt, Artificial Sequence
  Description of Artificial Sequence: Synthetic oligonucleotide
ugcaaaaaaauuaauuau

SEQ ID NO: 40995 - RNA, 18 nt, Artificial Sequence
  Description of Artificial Sequence: Synthetic oligonucleotide
aaguuugcaaaaaaauua

SEQ ID NO: 40996 - RNA, 18 nt, Artificial Sequence
  Description of Artificial Sequence: Synthetic oligonucleotide
aacuaaaguuugcaaaaa

SEQ ID NO: 40997 - RNA, 18 nt, Artificial Sequence
  Description of Artificial Sequence: Synthetic oligonucleotide
guaauaacuaaaguuugc

SEQ ID NO: 40998 - RNA, 18 nt, Artificial Sequence
  Description of Artificial Sequence: Synthetic oligonucleotide
ugccuguaauaacuaaag

SEQ ID NO: 40999 - RNA, 18 nt, Artificial Sequence
  Description of Artificial Sequence: Synthetic oligonucleotide
uuugcugccuguaauaac

SEQ ID NO: 41000 - RNA, 18 nt, Artificial Sequence
  Description of Artificial Sequence: Synthetic oligonucleotide
ugguuuuugcugccugua

SEQ ID NO: 41001 - RNA, 18 nt, Artificial Sequence
  Description of Artificial Sequence: Synthetic oligonucleotide
gacagugguuuuugcugc

SEQ ID NO: 41002 - RNA, 18 nt, Artificial Sequence
  Description of Artificial Sequence: Synthetic oligonucleotide
uuucagacagugguuuuu

SEQ ID NO: 41003 - RNA, 18 nt, Artificial Sequence
  Description of Artificial Sequence: Synthetic oligonucleotide
uuuaguuucagacagugg

SEQ ID NO: 41004 - RNA, 18 nt, Artificial Sequence
  Description of Artificial Sequence: Synthetic oligonucleotide
acagauuuaguuucagac

SEQ ID NO: 41005 - RNA, 18 nt, Artificial Sequence
  Description of Artificial Sequence: Synthetic oligonucleotide
ugaacacagauuuaguuu

SEQ ID NO: 41006 - RNA, 18 nt, Artificial Sequence
  Description of Artificial Sequence: Synthetic oligonucleotide
aucuuugaacacagauuu

SEQ ID NO: 41007 - RNA, 18 nt, Artificial Sequence
  Description of Artificial Sequence: Synthetic oligonucleotide
ucuucaucuuugaacaca

SEQ ID NO: 41008 - RNA, 18 nt, Artificial Sequence
  Description of Artificial Sequence: Synthetic oligonucleotide
gggucuucaucuuugaac

SEQ ID NO: 41009 - RNA, 18 nt, Artificial Sequence
  Description of Artificial Sequence: Synthetic oligonucleotide
cuuggcuuuuaaugaggg

SEQ ID NO: 41010 - RNA, 18 nt, Artificial Sequence
  Description of Artificial Sequence: Synthetic oligonucleotide
acguccuuggcuuuuaau

SEQ ID NO: 41011 - RNA, 18 nt, Artificial Sequence
  Description of Artificial Sequence: Synthetic oligonucleotide
uaagaacguccuuggcuu

SEQ ID NO: 41012 - RNA, 18 nt, Artificial Sequence
  Description of Artificial Sequence: Synthetic oligonucleotide
aaucuuaagaacguccuu

SEQ ID NO: 41013 - RNA, 18 nt, Artificial Sequence
  Description of Artificial Sequence: Synthetic oligonucleotide
guuccaaucuuaagaacg

SEQ ID NO: 41014 - RNA, 18 nt, Artificial Sequence
  Description of Artificial Sequence: Synthetic oligonucleotide
ugucaguuccaaucuuaa

SEQ ID NO: 41015 - RNA, 18 nt, Artificial Sequence
  Description of Artificial Sequence: Synthetic oligonucleotide
aauuaugucaguuccaau

SEQ ID NO: 41016 - RNA, 18 nt, Artificial Sequence
  Description of Artificial Sequence: Synthetic oligonucleotide
agacuaauuaugucaguu

SEQ ID NO: 41017 - RNA, 18 nt, Artificial Sequence
  Description of Artificial Sequence: Synthetic oligonucleotide
agucaagacuaauuaugu

SEQ ID NO: 41018 - RNA, 18 nt, Artificial Sequence
  Description of Artificial Sequence: Synthetic oligonucleotide
aaguaagucaagacuaau

SEQ ID NO: 41019 - RNA, 18 nt, Artificial Sequence
  Description of Artificial Sequence: Synthetic oligonucleotide
uaaugaaguaagucaaga

SEQ ID NO: 41020 - RNA, 18 nt, Artificial Sequence
  Description of Artificial Sequence: Synthetic oligonucleotide
ugcuuuaaugaaguaagu

SEQ ID NO: 41021 - RNA, 18 nt, Artificial Sequence
  Description of Artificial Sequence: Synthetic oligonucleotide
aaucuugcuuuaaugaag

SEQ ID NO: 41022 - RNA, 18 nt, Artificial Sequence
  Description of Artificial Sequence: Synthetic oligonucleotide
aauugaaucuugcuuuaa

SEQ ID NO: 41023 - RNA, 18 nt, Artificial Sequence
  Description of Artificial Sequence: Synthetic oligonucleotide
caaggaauugaaucuugc

SEQ ID NO: 41024 - RNA, 18 nt, Artificial Sequence
  Description of Artificial Sequence: Synthetic oligonucleotide
augaacaaggaauugaau

SEQ ID NO: 41025 - RNA, 18 nt, Artificial Sequence
  Description of Artificial Sequence: Synthetic oligonucleotide
cucaaaugaacaaggaau

SEQ ID NO: 41026 - RNA, 18 nt, Artificial Sequence
  Description of Artificial Sequence: Synthetic oligonucleotide
gaacacucaaaugaacaa

SEQ ID NO: 41027 - RNA, 18 nt, Artificial Sequence
  Description of Artificial Sequence: Synthetic oligonucleotide
auaaugaacacucaaaug

SEQ ID NO: 41028 - RNA, 18 nt, Artificial Sequence
  Description of Artificial Sequence: Synthetic oligonucleotide
ggcauauaaugaacacuc

SEQ ID NO: 41029 - RNA, 18 nt, Artificial Sequence
  Description of Artificial Sequence: Synthetic oligonucleotide
ugccuggcauauaaugaa

SEQ ID NO: 41030 - RNA, 18 nt, Artificial Sequence
  Description of Artificial Sequence: Synthetic oligonucleotide
gucaaugccuggcauaua

SEQ ID NO: 41031 - RNA, 18 nt, Artificial Sequence
  Description of Artificial Sequence: Synthetic oligonucleotide
aacuggucaaugccuggc

SEQ ID NO: 41032 - RNA, 18 nt, Artificial Sequence
  Description of Artificial Sequence: Synthetic oligonucleotide
auugcaacuggucaaugc

SEQ ID NO: 41033 - RNA, 18 nt, Artificial Sequence
  Description of Artificial Sequence: Synthetic oligonucleotide
auaaaauugcaacugguc

SEQ ID NO: 41034 - RNA, 18 nt, Artificial Sequence
  Description of Artificial Sequence: Synthetic oligonucleotide
ggaccauaaaauugcaac

SEQ ID NO: 41035 - RNA, 18 nt, Artificial Sequence
  Description of Artificial Sequence: Synthetic oligonucleotide
auucuggaccauaaaauu

SEQ ID NO: 41036 - RNA, 18 nt, Artificial Sequence
  Description of Artificial Sequence: Synthetic oligonucleotide
uauuaauucuggaccaua

SEQ ID NO: 41037 - RNA, 18 nt, Artificial Sequence
  Description of Artificial Sequence: Synthetic oligonucleotide
aauaauauuaauucugga

SEQ ID NO: 41038 - RNA, 18 nt, Artificial Sequence
  Description of Artificial Sequence: Synthetic oligonucleotide
cgaauaauaauauuaauu

SEQ ID NO: 41039 - RNA, 18 nt, Artificial Sequence
  Description of Artificial Sequence: Synthetic oligonucleotide
guuuacgaauaauaauau

SEQ ID NO: 41040 - RNA, 18 nt, Artificial Sequence
  Description of Artificial Sequence: Synthetic oligonucleotide
agcuaguuuacgaauaau

SEQ ID NO: 41041 - RNA, 18 nt, Artificial Sequence
  Description of Artificial Sequence: Synthetic oligonucleotide
auuauagcuaguuuacga

SEQ ID NO: 41042 - RNA, 18 nt, Artificial Sequence
  Description of Artificial Sequence: Synthetic oligonucleotide
acucuauuauagcuaguu

SEQ ID NO: 41043 - RNA, 18 nt, Artificial Sequence
  Description of Artificial Sequence: Synthetic oligonucleotide
uauauacucuauuauagc

SEQ ID NO: 41044 - RNA, 18 nt, Artificial Sequence
  Description of Artificial Sequence: Synthetic oligonucleotide
cacuguauauacucuauu

SEQ ID NO: 41045 - RNA, 18 nt, Artificial Sequence
  Description of Artificial Sequence: Synthetic oligonucleotide
cacagcacuguauauacu

SEQ ID NO: 41046 - RNA, 18 nt, Artificial Sequence
  Description of Artificial Sequence: Synthetic oligonucleotide
auucccacagcacuguau

SEQ ID NO: 41047 - RNA, 18 nt, Artificial Sequence
  Description of Artificial Sequence: Synthetic oligonucleotide
ccuguauucccacagcac

SEQ ID NO: 41048 - RNA, 18 nt, Artificial Sequence
  Description of Artificial Sequence: Synthetic oligonucleotide
cuuccccuguauucccac

SEQ ID NO: 41049 - RNA, 18 nt, Artificial Sequence
  Description of Artificial Sequence: Synthetic oligonucleotide
ugcuucuuccccuguauu

SEQ ID NO: 41050 - RNA, 18 nt, Artificial Sequence
  Description of Artificial Sequence: Synthetic oligonucleotide
uuaauugcuucuuccccu

SEQ ID NO: 41051 - RNA, 18 nt, Artificial Sequence
  Description of Artificial Sequence: Synthetic oligonucleotide
cagauuuaauugcuucuu

SEQ ID NO: 41052 - RNA, 18 nt, Artificial Sequence
  Description of Artificial Sequence: Synthetic oligonucleotide
ucuagcagauuuaauugc

SEQ ID NO: 41053 - RNA, 18 nt, Artificial Sequence
  Description of Artificial Sequence: Synthetic oligonucleotide
acccuucuagcagauuua

SEQ ID NO: 41054 - RNA, 18 nt, Artificial Sequence
  Description of Artificial Sequence: Synthetic oligonucleotide
cucuuacccuucuagcag

SEQ ID NO: 41055 - RNA, 18 nt, Artificial Sequence
  Description of Artificial Sequence: Synthetic oligonucleotide
gauuucucuuacccuucu

SEQ ID NO: 41056 - RNA, 18 nt, Artificial Sequence
  Description of Artificial Sequence: Synthetic oligonucleotide
auacagauuucucuuacc

SEQ ID NO: 41057 - RNA, 18 nt, Artificial Sequence
  Description of Artificial Sequence: Synthetic oligonucleotide
ccugcauacagauuucuc

SEQ ID NO: 41058 - RNA, 18 nt, Artificial Sequence
  Description of Artificial Sequence: Synthetic oligonucleotide
ugccuccugcauacagau

SEQ ID NO: 41059 - RNA, 18 nt, Artificial Sequence
  Description of Artificial Sequence: Synthetic oligonucleotide
agcauugccuccugcaua

SEQ ID NO: 41060 - RNA, 18 nt, Artificial Sequence
  Description of Artificial Sequence: Synthetic oligonucleotide
augcuagcauugccuccu

SEQ ID NO: 41061 - RNA, 18 nt, Artificial Sequence
  Description of Artificial Sequence: Synthetic oligonucleotide
gcuuaaugcuagcauugc

SEQ ID NO: 41062 - RNA, 18 nt, Artificial Sequence
  Description of Artificial Sequence: Synthetic oligonucleotide
ucuuggcuuaaugcuagc

SEQ ID NO: 41063 - RNA, 18 nt, Artificial Sequence
  Description of Artificial Sequence: Synthetic oligonucleotide
cuauuucuuggcuuaaug

SEQ ID NO: 41064 - RNA, 18 nt, Artificial Sequence
  Description of Artificial Sequence: Synthetic oligonucleotide
ucacacuauuucuuggcu

SEQ ID NO: 41065 - RNA, 18 nt, Artificial Sequence
  Description of Artificial Sequence: Synthetic oligonucleotide
ucaccucacacuauuucu

SEQ ID NO: 41066 - RNA, 18 nt, Artificial Sequence
  Description of Artificial Sequence: Synthetic oligonucleotide
uaagaucaccucacacua

SEQ ID NO: 41067 - RNA, 18 nt, Artificial Sequence
  Description of Artificial Sequence: Synthetic oligonucleotide
ugugauaagaucaccuca

SEQ ID NO: 41068 - RNA, 18 nt, Artificial Sequence
  Description of Artificial Sequence: Synthetic oligonucleotide
aucagugugauaagauca

SEQ ID NO: 41069 - RNA, 18 nt, Artificial Sequence
  Description of Artificial Sequence: Synthetic oligonucleotide
aacacaucagugugauaa

SEQ ID NO: 41070 - RNA, 18 nt, Artificial Sequence
  Description of Artificial Sequence: Synthetic oligonucleotide
aguugaacacaucagugu

SEQ ID NO: 41071 - RNA, 18 nt, Artificial Sequence
  Description of Artificial Sequence: Synthetic oligonucleotide
uaaacaguugaacacauc

SEQ ID NO: 41072 - RNA, 18 nt, Artificial Sequence
  Description of Artificial Sequence: Synthetic oligonucleotide
ucccauaaacaguugaac

SEQ ID NO: 41073 - RNA, 18 nt, Artificial Sequence
  Description of Artificial Sequence: Synthetic oligonucleotide
ccuuuucccauaaacagu

SEQ ID NO: 41074 - RNA, 18 nt, Artificial Sequence
  Description of Artificial Sequence: Synthetic oligonucleotide
aguuuccuuuucccauaa

SEQ ID NO: 41075 - RNA, 18 nt, Artificial Sequence
  Description of Artificial Sequence: Synthetic oligonucleotide
auccuaguuuccuuuucc

SEQ ID NO: 41076 - RNA, 18 nt, Artificial Sequence
  Description of Artificial Sequence: Synthetic oligonucleotide
aaaccauccuaguuuccu

SEQ ID NO: 41077 - RNA, 18 nt, Artificial Sequence
  Description of Artificial Sequence: Synthetic oligonucleotide
aaauaaaaccauccuagu

SEQ ID NO: 41078 - RNA, 18 nt, Artificial Sequence
  Description of Artificial Sequence: Synthetic oligonucleotide
uucacaaauaaaaccauc

SEQ ID NO: 41079 - RNA, 18 nt, Artificial Sequence
  Description of Artificial Sequence: Synthetic oligonucleotide
aacauuucacaaauaaaa

SEQ ID NO: 41080 - RNA, 18 nt, Artificial Sequence
  Description of Artificial Sequence: Synthetic oligonucleotide
uguagaacauuucacaaa

SEQ ID NO: 41081 - RNA, 18 nt, Artificial Sequence
  Description of Artificial Sequence: Synthetic oligonucleotide
agcguuguagaacauuuc

SEQ ID NO: 41082 - RNA, 18 nt, Artificial Sequence
  Description of Artificial Sequence: Synthetic oligonucleotide
guucuagcguuguagaac

SEQ ID NO: 41083 - RNA, 18 nt, Artificial Sequence
  Description of Artificial Sequence: Synthetic oligonucleotide
caacaguucuagcguugu

SEQ ID NO: 41084 - RNA, 18 nt, Artificial Sequence
  Description of Artificial Sequence: Synthetic oligonucleotide
aaguucaacaguucuagc

SEQ ID NO: 41085 - RNA, 18 nt, Artificial Sequence
  Description of Artificial Sequence: Synthetic oligonucleotide
ccaagaaguucaacaguu

SEQ ID NO: 41086 - RNA, 18 nt, Artificial Sequence
  Description of Artificial Sequence: Synthetic oligonucleotide
uucucccaagaaguucaa

SEQ ID NO: 41087 - RNA, 18 nt, Artificial Sequence
  Description of Artificial Sequence: Synthetic oligonucleotide
uccuuuucucccaagaag

SEQ ID NO: 41088 - RNA, 18 nt, Artificial Sequence
  Description of Artificial Sequence: Synthetic oligonucleotide
gauucuccuuuucuccca

SEQ ID NO: 41089 - RNA, 18 nt, Artificial Sequence
  Description of Artificial Sequence: Synthetic oligonucleotide
acaaagauucuccuuuuc

SEQ ID NO: 41090 - RNA, 18 nt, Artificial Sequence
  Description of Artificial Sequence: Synthetic oligonucleotide
acaaaacaaagauucucc

SEQ ID NO: 41091 - RNA, 18 nt, Artificial Sequence
  Description of Artificial Sequence: Synthetic oligonucleotide
gcacaacaaaacaaagau

SEQ ID NO: 41092 - RNA, 18 nt, Artificial Sequence
  Description of Artificial Sequence: Synthetic oligonucleotide
acucagcacaacaaaaca

SEQ ID NO: 41093 - RNA, 18 nt, Artificial Sequence
  Description of Artificial Sequence: Synthetic oligonucleotide
aucaaacucagcacaaca

SEQ ID NO: 41094 - RNA, 18 nt, Artificial Sequence
  Description of Artificial Sequence: Synthetic oligonucleotide
aacuaaucaaacucagca

SEQ ID NO: 41095 - RNA, 18 nt, Artificial Sequence
  Description of Artificial Sequence: Synthetic oligonucleotide
uaagcaacuaaucaaacu

SEQ ID NO: 41096 - RNA, 18 nt, Artificial Sequence
  Description of Artificial Sequence: Synthetic oligonucleotide
uugguuaagcaacuaauc

SEQ ID NO: 41097 - RNA, 18 nt, Artificial Sequence
  Description of Artificial Sequence: Synthetic oligonucleotide
ucuacuugguuaagcaac

SEQ ID NO: 41098 - RNA, 18 nt, Artificial Sequence
  Description of Artificial Sequence: Synthetic oligonucleotide
uucuuucuacuugguuaa

SEQ ID NO: 41099 - RNA, 18 nt, Artificial Sequence
  Description of Artificial Sequence: Synthetic oligonucleotide
ugcuuuucuuucuacuug

SEQ ID NO: 41100 - RNA, 18 nt, Artificial Sequence
  Description of Artificial Sequence: Synthetic oligonucleotide
agaugugcuuuucuuucu

SEQ ID NO: 41101 - RNA, 18 nt, Artificial Sequence
  Description of Artificial Sequence: Synthetic oligonucleotide
caggaagaugugcuuuuc

SEQ ID NO: 41102 - RNA, 18 nt, Artificial Sequence
  Description of Artificial Sequence: Synthetic oligonucleotide
gugaucaggaagaugugc

SEQ ID NO: 41103 - RNA, 18 nt, Artificial Sequence
  Description of Artificial Sequence: Synthetic oligonucleotide
uaacugugaucaggaaga

SEQ ID NO: 41104 - RNA, 18 nt, Artificial Sequence
  Description of Artificial Sequence: Synthetic oligonucleotide
uuuuauaacugugaucag

SEQ ID NO: 41105 - RNA, 18 nt, Artificial Sequence
  Description of Artificial Sequence: Synthetic oligonucleotide
guuucuuuuauaacugug

SEQ ID NO: 41106 - RNA, 18 nt, Artificial Sequence
  Description of Artificial Sequence: Synthetic oligonucleotide
ucaggguuucuuuuauaa

SEQ ID NO: 41107 - RNA, 18 nt, Artificial Sequence
  Description of Artificial Sequence: Synthetic oligonucleotide
cggccucaggguuucuuu

SEQ ID NO: 41108 - RNA, 18 nt, Artificial Sequence
  Description of Artificial Sequence: Synthetic oligonucleotide
gcgcccggccucaggguu

SEQ ID NO: 41109 - RNA, 18 nt, Artificial Sequence
  Description of Artificial Sequence: Synthetic oligonucleotide
ccaccgcgcccggccuca

SEQ ID NO: 41110 - RNA, 18 nt, Artificial Sequence
  Description of Artificial Sequence: Synthetic oligonucleotide
uugagccaccgcgcccgg

SEQ ID NO: 41111 - RNA, 18 nt, Artificial Sequence
  Description of Artificial Sequence: Synthetic oligonucleotide
caggcuugagccaccgcg

SEQ ID NO: 41112 - RNA, 18 nt, Artificial Sequence
  Description of Artificial Sequence: Synthetic oligonucleotide
gguuacaggcuugagcca

SEQ ID NO: 41113 - RNA, 18 nt, Artificial Sequence
  Description of Artificial Sequence: Synthetic oligonucleotide
ggguuacaggcuugagcc

SEQ ID NO: 41114 - RNA, 18 nt, Artificial Sequence
  Description of Artificial Sequence: Synthetic oligonucleotide
gccucccaaagugcuggg

SEQ ID NO: 41115 - RNA, 18 nt, Artificial Sequence
  Description of Artificial Sequence: Synthetic oligonucleotide
ccuuggccucccaaagug

SEQ ID NO: 41116 - RNA, 18 nt, Artificial Sequence
  Description of Artificial Sequence: Synthetic oligonucleotide
ucccuccuuggccuccca

SEQ ID NO: 41117 - RNA, 18 nt, Artificial Sequence
  Description of Artificial Sequence: Synthetic oligonucleotide
gauccucccuccuuggcc

SEQ ID NO: 41118 - RNA, 18 nt, Artificial Sequence
  Description of Artificial Sequence: Synthetic oligonucleotide
cuugugauccucccuccu

SEQ ID NO: 41119 - RNA, 18 nt, Artificial Sequence
  Description of Artificial Sequence: Synthetic oligonucleotide
cugaccuugugauccucc

SEQ ID NO: 41120 - RNA, 18 nt, Artificial Sequence
  Description of Artificial Sequence: Synthetic oligonucleotide
aucuccugaccuugugau

SEQ ID NO: 41121 - RNA, 18 nt, Artificial Sequence
  Description of Artificial Sequence: Synthetic oligonucleotide
ucucgaucuccugaccuu

SEQ ID NO: 41122 - RNA, 18 nt, Artificial Sequence
  Description of Artificial Sequence: Synthetic oligonucleotide
gauggucucgaucuccug

SEQ ID NO: 41123 - RNA, 18 nt, Artificial Sequence
  Description of Artificial Sequence: Synthetic oligonucleotide
gccaggauggucucgauc

SEQ ID NO: 41124 - RNA, 18 nt, Artificial Sequence
  Description of Artificial Sequence: Synthetic oligonucleotide
uguuagccaggauggucu

SEQ ID NO: 41125 - RNA, 18 nt, Artificial Sequence
  Description of Artificial Sequence: Synthetic oligonucleotide
caccguguuagccaggau

SEQ ID NO: 41126 - RNA, 18 nt, Artificial Sequence
  Description of Artificial Sequence: Synthetic oligonucleotide
gguuucaccguguuagcc

SEQ ID NO: 41127 - RNA, 18 nt, Artificial Sequence
  Description of Artificial Sequence: Synthetic oligonucleotide
ggguuucaccguguuagc

SEQ ID NO: 41128 - RNA, 18 nt, Artificial Sequence
  Description of Artificial Sequence: Synthetic oligonucleotide
auuuuuaguagagauggg

SEQ ID NO: 41129 - RNA, 18 nt, Artificial Sequence
  Description of Artificial Sequence: Synthetic oligonucleotide
uuuguauuuuuaguagag

SEQ ID NO: 41130 - RNA, 18 nt, Artificial Sequence
  Description of Artificial Sequence: Synthetic oligonucleotide
cuaauuuuguauuuuuag

SEQ ID NO: 41131 - RNA, 18 nt, Artificial Sequence
  Description of Artificial Sequence: Synthetic oligonucleotide
cccagcuaauuuuguauu

SEQ ID NO: 41132 - RNA, 18 nt, Artificial Sequence
  Description of Artificial Sequence: Synthetic oligonucleotide
ccacgcccagcuaauuuu

SEQ ID NO: 41133 - RNA, 18 nt, Artificial Sequence
  Description of Artificial Sequence: Synthetic oligonucleotide
ggccaccacgcccagcua

SEQ ID NO: 41134 - RNA, 18 nt, Artificial Sequence
  Description of Artificial Sequence: Synthetic oligonucleotide
gcgccggccaccacgccc

SEQ ID NO: 41135 - RNA, 18 nt, Artificial Sequence
  Description of Artificial Sequence: Synthetic oligonucleotide
uacaggcgccggccacca

SEQ ID NO: 41136 - RNA, 18 nt, Artificial Sequence
  Description of Artificial Sequence: Synthetic oligonucleotide
gggacuacaggcgccggc

SEQ ID NO: 41137 - RNA, 18 nt, Artificial Sequence
  Description of Artificial Sequence: Synthetic oligonucleotide
uagcugggacuacaggcg

SEQ ID NO: 41138 - RNA, 18 nt, Artificial Sequence
  Description of Artificial Sequence: Synthetic oligonucleotide
augaguagcugggacuac

SEQ ID NO: 41139 - RNA, 18 nt, Artificial Sequence
  Description of Artificial Sequence: Synthetic oligonucleotide
accucaugaguagcuggg

SEQ ID NO: 41140 - RNA, 18 nt, Artificial Sequence
  Description of Artificial Sequence: Synthetic oligonucleotide
ccucaaccucaugaguag

SEQ ID NO: 41141 - RNA, 18 nt, Artificial Sequence
  Description of Artificial Sequence: Synthetic oligonucleotide
uccugccucaaccucaug

SEQ ID NO: 41142 - RNA, 18 nt, Artificial Sequence
  Description of Artificial Sequence: Synthetic oligonucleotide
cauucuccugccucaacc

SEQ ID NO: 41143 - RNA, 18 nt, Artificial Sequence
  Description of Artificial Sequence: Synthetic oligonucleotide
cacgccauucuccugccu

SEQ ID NO: 41144 - RNA, 18 nt, Artificial Sequence
  Description of Artificial Sequence: Synthetic oligonucleotide
cgguucacgccauucucc

SEQ ID NO: 41145 - RNA, 18 nt, Artificial Sequence
  Description of Artificial Sequence: Synthetic oligonucleotide
cuccucgguucacgccau

SEQ ID NO: 41146 - RNA, 18 nt, Artificial Sequence
  Description of Artificial Sequence: Synthetic oligonucleotide
uccgccuccucgguucac

SEQ ID NO: 41147 - RNA, 18 nt, Artificial Sequence
  Description of Artificial Sequence: Synthetic oligonucleotide
caagcuccgccuccucgg

SEQ ID NO: 41148 - RNA, 18 nt, Artificial Sequence
  Description of Artificial Sequence: Synthetic oligonucleotide
cacugcaagcuccgccuc

SEQ ID NO: 41149 - RNA, 18 nt, Artificial Sequence
  Description of Artificial Sequence: Synthetic oligonucleotide
ccacucacugcaagcucc

SEQ ID NO: 41150 - RNA, 18 nt, Artificial Sequence
  Description of Artificial Sequence: Synthetic oligonucleotide
aauuuccacucacugcaa

SEQ ID NO: 41151 - RNA, 18 nt, Artificial Sequence
  Description of Artificial Sequence: Synthetic oligonucleotide
ggcgcaauuuccacucac

SEQ ID NO: 41152 - RNA, 18 nt, Artificial Sequence
  Description of Artificial Sequence: Synthetic oligonucleotide
gcaguggcgcaauuucca

SEQ ID NO: 41153 - RNA, 18 nt, Artificial Sequence
  Description of Artificial Sequence: Synthetic oligonucleotide
ggagugcaguggcgcaau

SEQ ID NO: 41154 - RNA, 18 nt, Artificial Sequence
  Description of Artificial Sequence: Synthetic oligonucleotide
aggcuggagugcaguggc

SEQ ID NO: 41155 - RNA, 18 nt, Artificial Sequence
  Description of Artificial Sequence: Synthetic oligonucleotide
ugcccaggcuggagugca

SEQ ID NO: 41156 - RNA, 18 nt, Artificial Sequence
  Description of Artificial Sequence: Synthetic oligonucleotide
uuuguugcccaggcugga

SEQ ID NO: 41157 - RNA, 18 nt, Artificial Sequence
  Description of Artificial Sequence: Synthetic oligonucleotide
cucacuuuguugcccagg

SEQ ID NO: 41158 - RNA, 18 nt, Artificial Sequence
  Description of Artificial Sequence: Synthetic oligonucleotide
ggagucucacuuuguugc

SEQ ID NO: 41159 - RNA, 18 nt, Artificial Sequence
  Description of Artificial Sequence: Synthetic oligonucleotide
gagauggagucucacuuu

SEQ ID NO: 41160 - RNA, 18 nt, Artificial Sequence
  Description of Artificial Sequence: Synthetic oligonucleotide
uuuuugagauggagucuc

SEQ ID NO: 41161 - RNA, 18 nt, Artificial Sequence
  Description of Artificial Sequence: Synthetic oligonucleotide
uuuuuuuuuugagaugga

SEQ ID NO: 41162 - RNA, 18 nt, Artificial Sequence
  Description of Artificial Sequence: Synthetic oligonucleotide
uuuuuuuuuuuuuuugag

SEQ ID NO: 41163 - RNA, 18 nt, Artificial Sequence
  Description of Artificial Sequence: Synthetic oligonucleotide
uuuuuuuuuuuuuuuuuu

SEQ ID NO: 41164 - RNA, 18 nt, Artificial Sequence
  Description of Artificial Sequence: Synthetic oligonucleotide
uuuuuuuuuuuuuuuuuu

SEQ ID NO: 41165 - RNA, 18 nt, Artificial Sequence
  Description of Artificial Sequence: Synthetic oligonucleotide
uuuuuuuuuuuuuuuuuu

SEQ ID NO: 41166 - RNA, 18 nt, Artificial Sequence
  Description of Artificial Sequence: Synthetic oligonucleotide
cuucuuuuuuuuuuuuuu

SEQ ID NO: 41167 - RNA, 18 nt, Artificial Sequence
  Description of Artificial Sequence: Synthetic oligonucleotide
uucuucuucuuuuuuuuu

SEQ ID NO: 41168 - RNA, 18 nt, Artificial Sequence
  Description of Artificial Sequence: Synthetic oligonucleotide
aggguuucuucuucuuuu

SEQ ID NO: 41169 - RNA, 18 nt, Artificial Sequence
  Description of Artificial Sequence: Synthetic oligonucleotide
ggcucaggguuucuucuu

SEQ ID NO: 41170 - RNA, 18 nt, Artificial Sequence
  Description of Artificial Sequence: Synthetic oligonucleotide
uuaauggcucaggguuuc

SEQ ID NO: 41171 - RNA, 18 nt, Artificial Sequence
  Description of Artificial Sequence: Synthetic oligonucleotide
acacauuaauggcucagg

SEQ ID NO: 41172 - RNA, 18 nt, Artificial Sequence
  Description of Artificial Sequence: Synthetic oligonucleotide
acgagacacauuaauggc

SEQ ID NO: 41173 - RNA, 18 nt, Artificial Sequence
  Description of Artificial Sequence: Synthetic oligonucleotide
aaguuacgagacacauua

SEQ ID NO: 41174 - RNA, 18 nt, Artificial Sequence
  Description of Artificial Sequence: Synthetic oligonucleotide
uccucaaguuacgagaca

SEQ ID NO: 41175 - RNA, 18 nt, Artificial Sequence
  Description of Artificial Sequence: Synthetic oligonucleotide
gaacuuccucaaguuacg

SEQ ID NO: 41176 - RNA, 18 nt, Artificial Sequence
  Description of Artificial Sequence: Synthetic oligonucleotide
uucaugaacuuccucaag

SEQ ID NO: 41177 - RNA, 18 nt, Artificial Sequence
  Description of Artificial Sequence: Synthetic oligonucleotide
gagaauucaugaacuucc

SEQ ID NO: 41178 - RNA, 18 nt, Artificial Sequence
  Description of Artificial Sequence: Synthetic oligonucleotide
gcccagagaauucaugaa

SEQ ID NO: 41179 - RNA, 18 nt, Artificial Sequence
  Description of Artificial Sequence: Synthetic oligonucleotide
augaagcccagagaauuc

SEQ ID NO: 41180 - RNA, 18 nt, Artificial Sequence
  Description of Artificial Sequence: Synthetic oligonucleotide
aauggaugaagcccagag

SEQ ID NO: 41181 - RNA, 18 nt, Artificial Sequence
  Description of Artificial Sequence: Synthetic oligonucleotide
aucuuaauggaugaagcc

SEQ ID NO: 41182 - RNA, 18 nt, Artificial Sequence
  Description of Artificial Sequence: Synthetic oligonucleotide
gaugaaucuuaauggaug

SEQ ID NO: 41183 - RNA, 18 nt, Artificial Sequence
  Description of Artificial Sequence: Synthetic oligonucleotide
auaaggaugaaucuuaau

SEQ ID NO: 41184 - RNA, 18 nt, Artificial Sequence
  Description of Artificial Sequence: Synthetic oligonucleotide
ggagcauaaggaugaauc

SEQ ID NO: 41185 - RNA, 18 nt, Artificial Sequence
  Description of Artificial Sequence: Synthetic oligonucleotide
uugcaggagcauaaggau

SEQ ID NO: 41186 - RNA, 18 nt, Artificial Sequence
  Description of Artificial Sequence: Synthetic oligonucleotide
gaaacuugcaggagcaua

SEQ ID NO: 41187 - RNA, 18 nt, Artificial Sequence
  Description of Artificial Sequence: Synthetic oligonucleotide
uauaagaaacuugcagga

SEQ ID NO: 41188 - RNA, 18 nt, Artificial Sequence
  Description of Artificial Sequence: Synthetic oligonucleotide
auaaauauaagaaacuug

SEQ ID NO: 41189 - RNA, 18 nt, Artificial Sequence
  Description of Artificial Sequence: Synthetic oligonucleotide
aauacauaaauauaagaa

SEQ ID NO: 41190 - RNA, 18 nt, Artificial Sequence
  Description of Artificial Sequence: Synthetic oligonucleotide
auagaaauacauaaauau

SEQ ID NO: 41191 - RNA, 18 nt, Artificial Sequence
  Description of Artificial Sequence: Synthetic oligonucleotide
ucagaauagaaauacaua

SEQ ID NO: 41192 - RNA, 18 nt, Artificial Sequence
  Description of Artificial Sequence: Synthetic oligonucleotide
agaaaucagaauagaaau

SEQ ID NO: 41193 - RNA, 18 nt, Artificial Sequence
  Description of Artificial Sequence: Synthetic oligonucleotide
auuucagaaaucagaaua

SEQ ID NO: 41194 - RNA, 18 nt, Artificial Sequence
  Description of Artificial Sequence: Synthetic oligonucleotide
uuaucauuucagaaauca

SEQ ID NO: 41195 - RNA, 18 nt, Artificial Sequence
  Description of Artificial Sequence: Synthetic oligonucleotide
cuagguuaucauuucaga

SEQ ID NO: 41196 - RNA, 18 nt, Artificial Sequence
  Description of Artificial Sequence: Synthetic oligonucleotide
cacuacuagguuaucauu

SEQ ID NO: 41197 - RNA, 18 nt, Artificial Sequence
  Description of Artificial Sequence: Synthetic oligonucleotide
ucagacacuacuagguua

SEQ ID NO: 41198 - RNA, 18 nt, Artificial Sequence
  Description of Artificial Sequence: Synthetic oligonucleotide
cuucaucagacacuacua

SEQ ID NO: 41199 - RNA, 18 nt, Artificial Sequence
  Description of Artificial Sequence: Synthetic oligonucleotide
aaaaacuucaucagacac

SEQ ID NO: 41200 - RNA, 18 nt, Artificial Sequence
  Description of Artificial Sequence: Synthetic oligonucleotide
caugaaaaaacuucauca

SEQ ID NO: 41201 - RNA, 18 nt, Artificial Sequence
  Description of Artificial Sequence: Synthetic oligonucleotide
auaagcaugaaaaaacuu

SEQ ID NO: 41202 - RNA, 18 nt, Artificial Sequence
  Description of Artificial Sequence: Synthetic oligonucleotide
auaaaauaagcaugaaaa

SEQ ID NO: 41203 - RNA, 18 nt, Artificial Sequence
  Description of Artificial Sequence: Synthetic oligonucleotide
aaagaauaaaauaagcau

SEQ ID NO: 41204 - RNA, 18 nt, Artificial Sequence
  Description of Artificial Sequence: Synthetic oligonucleotide
gugacaaagaauaaaaua

SEQ ID NO: 41205 - RNA, 18 nt, Artificial Sequence
  Description of Artificial Sequence: Synthetic oligonucleotide
caucugugacaaagaaua

SEQ ID NO: 41206 - RNA, 18 nt, Artificial Sequence
  Description of Artificial Sequence: Synthetic oligonucleotide
ucuuucaucugugacaaa

SEQ ID NO: 41207 - RNA, 18 nt, Artificial Sequence
  Description of Artificial Sequence: Synthetic oligonucleotide
auucuucuuucaucugug

SEQ ID NO: 41208 - RNA, 18 nt, Artificial Sequence
  Description of Artificial Sequence: Synthetic oligonucleotide
guccuauucuucuuucau

SEQ ID NO: 41209 - RNA, 18 nt, Artificial Sequence
  Description of Artificial Sequence: Synthetic oligonucleotide
aauuaguccuauucuucu

SEQ ID NO: 41210 - RNA, 18 nt, Artificial Sequence
  Description of Artificial Sequence: Synthetic oligonucleotide
gccccaauuaguccuauu

SEQ ID NO: 41211 - RNA, 18 nt, Artificial Sequence
  Description of Artificial Sequence: Synthetic oligonucleotide
ucuuagccccaauuaguc

SEQ ID NO: 41212 - RNA, 18 nt, Artificial Sequence
  Description of Artificial Sequence: Synthetic oligonucleotide
auucaucuuagccccaau

SEQ ID NO: 41213 - RNA, 18 nt, Artificial Sequence
  Description of Artificial Sequence: Synthetic oligonucleotide
cauuaauucaucuuagcc

SEQ ID NO: 41214 - RNA, 18 nt, Artificial Sequence
  Description of Artificial Sequence: Synthetic oligonucleotide
acuuacauuaauucaucu

SEQ ID NO: 41215 - RNA, 18 nt, Artificial Sequence
  Description of Artificial Sequence: Synthetic oligonucleotide
cugacacuuacauuaauu

SEQ ID NO: 41216 - RNA, 18 nt, Artificial Sequence
  Description of Artificial Sequence: Synthetic oligonucleotide
aguaucugacacuuacau

SEQ ID NO: 41217 - RNA, 18 nt, Artificial Sequence
  Description of Artificial Sequence: Synthetic oligonucleotide
ugccuaguaucugacacu

SEQ ID NO: 41218 - RNA, 18 nt, Artificial Sequence
  Description of Artificial Sequence: Synthetic oligonucleotide
acaccugccuaguaucug

SEQ ID NO: 41219 - RNA, 18 nt, Artificial Sequence
  Description of Artificial Sequence: Synthetic oligonucleotide
cccuaacaccugccuagu

SEQ ID NO: 41220 - RNA, 18 nt, Artificial Sequence
  Description of Artificial Sequence: Synthetic oligonucleotide
uucaucccuaacaccugc

SEQ ID NO: 41221 - RNA, 18 nt, Artificial Sequence
  Description of Artificial Sequence: Synthetic oligonucleotide
aucauuucaucccuaaca

SEQ ID NO: 41222 - RNA, 18 nt, Artificial Sequence
  Description of Artificial Sequence: Synthetic oligonucleotide
cauucaucauuucauccc

SEQ ID NO: 41223 - RNA, 18 nt, Artificial Sequence
  Description of Artificial Sequence: Synthetic oligonucleotide
ugccucauucaucauuuc

SEQ ID NO: 41224 - RNA, 18 nt, Artificial Sequence
  Description of Artificial Sequence: Synthetic oligonucleotide
guccaugccucauucauc

SEQ ID NO: 41225 - RNA, 18 nt, Artificial Sequence
  Description of Artificial Sequence: Synthetic oligonucleotide
aacagguccaugccucau

SEQ ID NO: 41226 - RNA, 18 nt, Artificial Sequence
  Description of Artificial Sequence: Synthetic oligonucleotide
ugaggaacagguccaugc

SEQ ID NO: 41227 - RNA, 18 nt, Artificial Sequence
  Description of Artificial Sequence: Synthetic oligonucleotide
aacucugaggaacagguc

SEQ ID NO: 41228 - RNA, 18 nt, Artificial Sequence
  Description of Artificial Sequence: Synthetic oligonucleotide
ccauaaacucugaggaac

SEQ ID NO: 41229 - RNA, 18 nt, Artificial Sequence
  Description of Artificial Sequence: Synthetic oligonucleotide
cugggccauaaacucuga

SEQ ID NO: 41230 - RNA, 18 nt, Artificial Sequence
  Description of Artificial Sequence: Synthetic oligonucleotide
gucuacugggccauaaac

SEQ ID NO: 41231 - RNA, 18 nt, Artificial Sequence
  Description of Artificial Sequence: Synthetic oligonucleotide
auuaugucuacugggcca

SEQ ID NO: 41232 - RNA, 18 nt, Artificial Sequence
  Description of Artificial Sequence: Synthetic oligonucleotide
auacaauuaugucuacug

SEQ ID NO: 41233 - RNA, 18 nt, Artificial Sequence
  Description of Artificial Sequence: Synthetic oligonucleotide
uccuaauacaauuauguc

SEQ ID NO: 41234 - RNA, 18 nt, Artificial Sequence
  Description of Artificial Sequence: Synthetic oligonucleotide
gaaaguccuaauacaauu

SEQ ID NO: 41235 - RNA, 18 nt, Artificial Sequence
  Description of Artificial Sequence: Synthetic oligonucleotide
cugcagaaaguccuaaua

SEQ ID NO: 41236 - RNA, 18 nt, Artificial Sequence
  Description of Artificial Sequence: Synthetic oligonucleotide
gucaacugcagaaagucc

SEQ ID NO: 41237 - RNA, 18 nt, Artificial Sequence
  Description of Artificial Sequence: Synthetic oligonucleotide
caaaugucaacugcagaa

SEQ ID NO: 41238 - RNA, 18 nt, Artificial Sequence
  Description of Artificial Sequence: Synthetic oligonucleotide
uuaugcaaaugucaacug

SEQ ID NO: 41239 - RNA, 18 nt, Artificial Sequence
  Description of Artificial Sequence: Synthetic oligonucleotide
cagcuuuaugcaaauguc

SEQ ID NO: 41240 - RNA, 18 nt, Artificial Sequence
  Description of Artificial Sequence: Synthetic oligonucleotide
ucagucagcuuuaugcaa

SEQ ID NO: 41241 - RNA, 18 nt, Artificial Sequence
  Description of Artificial Sequence: Synthetic oligonucleotide
uucagucagucagcuuua

SEQ ID NO: 41242 - RNA, 18 nt, Artificial Sequence
  Description of Artificial Sequence: Synthetic oligonucleotide
guuccuucagucagucag

SEQ ID NO: 41243 - RNA, 18 nt, Artificial Sequence
  Description of Artificial Sequence: Synthetic oligonucleotide
uuucuguuccuucaguca

SEQ ID NO: 41244 - RNA, 18 nt, Artificial Sequence
  Description of Artificial Sequence: Synthetic oligonucleotide
cucacuuucuguuccuuc

SEQ ID NO: 41245 - RNA, 18 nt, Artificial Sequence
  Description of Artificial Sequence: Synthetic oligonucleotide
ucugucucacuuucuguu

SEQ ID NO: 41246 - RNA, 18 nt, Artificial Sequence
  Description of Artificial Sequence: Synthetic oligonucleotide
aucugucugucucacuuu

SEQ ID NO: 41247 - RNA, 18 nt, Artificial Sequence
  Description of Artificial Sequence: Synthetic oligonucleotide
gucauaucugucugucuc

SEQ ID NO: 41248 - RNA, 18 nt, Artificial Sequence
  Description of Artificial Sequence: Synthetic oligonucleotide
auuuggucauaucugucu

SEQ ID NO: 41249 - RNA, 18 nt, Artificial Sequence
  Description of Artificial Sequence: Synthetic oligonucleotide
uauaaauuuggucauauc

SEQ ID NO: 41250 - RNA, 18 nt, Artificial Sequence
  Description of Artificial Sequence: Synthetic oligonucleotide
guuuguauaaauuugguc

SEQ ID NO: 41251 - RNA, 18 nt, Artificial Sequence
  Description of Artificial Sequence: Synthetic oligonucleotide
acaugguuuguauaaauu

SEQ ID NO: 41252 - RNA, 18 nt, Artificial Sequence
  Description of Artificial Sequence: Synthetic oligonucleotide
uugguacaugguuuguau

SEQ ID NO: 41253 - RNA, 18 nt, Artificial Sequence
  Description of Artificial Sequence: Synthetic oligonucleotide
aaguguugguacaugguu

SEQ ID NO: 41254 - RNA, 18 nt, Artificial Sequence
  Description of Artificial Sequence: Synthetic oligonucleotide
cuuucaaguguugguaca

SEQ ID NO: 41255 - RNA, 18 nt, Artificial Sequence
  Description of Artificial Sequence: Synthetic oligonucleotide
cccaucuuucaaguguug

SEQ ID NO: 41256 - RNA, 18 nt, Artificial Sequence
  Description of Artificial Sequence: Synthetic oligonucleotide
auccacccaucuuucaag

SEQ ID NO: 41257 - RNA, 18 nt, Artificial Sequence
  Description of Artificial Sequence: Synthetic oligonucleotide
aaaauauccacccaucuu

SEQ ID NO: 41258 - RNA, 18 nt, Artificial Sequence
  Description of Artificial Sequence: Synthetic oligonucleotide
ccuggaaaauauccaccc

SEQ ID NO: 41259 - RNA, 18 nt, Artificial Sequence
  Description of Artificial Sequence: Synthetic oligonucleotide
uguuuccuggaaaauauc

SEQ ID NO: 41260 - RNA, 18 nt, Artificial Sequence
  Description of Artificial Sequence: Synthetic oligonucleotide
aaaucuguuuccuggaaa

SEQ ID NO: 41261 - RNA, 18 nt, Artificial Sequence
  Description of Artificial Sequence: Synthetic oligonucleotide
gcccaaaaucuguuuccu

SEQ ID NO: 41262 - RNA, 18 nt, Artificial Sequence
  Description of Artificial Sequence: Synthetic oligonucleotide
guccugcccaaaaucugu

SEQ ID NO: 41263 - RNA, 18 nt, Artificial Sequence
  Description of Artificial Sequence: Synthetic oligonucleotide
ggaauguccugcccaaaa

SEQ ID NO: 41264 - RNA, 18 nt, Artificial Sequence
  Description of Artificial Sequence: Synthetic oligonucleotide
ugcauggaauguccugcc

SEQ ID NO: 41265 - RNA, 18 nt, Artificial Sequence
  Description of Artificial Sequence: Synthetic oligonucleotide
uccagugcauggaauguc

SEQ ID NO: 41266 - RNA, 18 nt, Artificial Sequence
  Description of Artificial Sequence: Synthetic oligonucleotide
cuauuuccagugcaugga

SEQ ID NO: 41267 - RNA, 18 nt, Artificial Sequence
  Description of Artificial Sequence: Synthetic oligonucleotide
ucaugcuauuuccagugc

SEQ ID NO: 41268 - RNA, 18 nt, Artificial Sequence
  Description of Artificial Sequence: Synthetic oligonucleotide
uuuguucaugcuauuucc

SEQ ID NO: 41269 - RNA, 18 nt, Artificial Sequence
  Description of Artificial Sequence: Synthetic oligonucleotide
augcauuuguucaugcua

SEQ ID NO: 41270 - RNA, 18 nt, Artificial Sequence
  Description of Artificial Sequence: Synthetic oligonucleotide
uuuucaugcauuuguuca

SEQ ID NO: 41271 - RNA, 18 nt, Artificial Sequence
  Description of Artificial Sequence: Synthetic oligonucleotide
ggcaauuuucaugcauuu

SEQ ID NO: 41272 - RNA, 18 nt, Artificial Sequence
  Description of Artificial Sequence: Synthetic oligonucleotide
uuguaggcaauuuucaug

SEQ ID NO: 41273 - RNA, 18 nt, Artificial Sequence
  Description of Artificial Sequence: Synthetic oligonucleotide
gcauguuguaggcaauuu

SEQ ID NO: 41274 - RNA, 18 nt, Artificial Sequence
  Description of Artificial Sequence: Synthetic oligonucleotide
gccaggcauguuguaggc

SEQ ID NO: 41275 - RNA, 18 nt, Artificial Sequence
  Description of Artificial Sequence: Synthetic oligonucleotide
uaugugccaggcauguug

SEQ ID NO: 41276 - RNA, 18 nt, Artificial Sequence
  Description of Artificial Sequence: Synthetic oligonucleotide
acagcuaugugccaggca

SEQ ID NO: 41277 - RNA, 18 nt, Artificial Sequence
  Description of Artificial Sequence: Synthetic oligonucleotide
accucacagcuaugugcc

SEQ ID NO: 41278 - RNA, 18 nt, Artificial Sequence
  Description of Artificial Sequence: Synthetic oligonucleotide
aggguaccucacagcuau

SEQ ID NO: 41279 - RNA, 18 nt, Artificial Sequence
  Description of Artificial Sequence: Synthetic oligonucleotide
cucauaggguaccucaca

SEQ ID NO: 41280 - RNA, 18 nt, Artificial Sequence
  Description of Artificial Sequence: Synthetic oligonucleotide
aacaacucauaggguacc

SEQ ID NO: 41281 - RNA, 18 nt, Artificial Sequence
  Description of Artificial Sequence: Synthetic oligonucleotide
aagucaacaacucauagg

SEQ ID NO: 41282 - RNA, 18 nt, Artificial Sequence
  Description of Artificial Sequence: Synthetic oligonucleotide
uuuucaagucaacaacuc

SEQ ID NO: 41283 - RNA, 18 nt, Artificial Sequence
  Description of Artificial Sequence: Synthetic oligonucleotide
ccauguuuucaagucaac

SEQ ID NO: 41284 - RNA, 18 nt, Artificial Sequence
  Description of Artificial Sequence: Synthetic oligonucleotide
caguuccauguuuucaag

SEQ ID NO: 41285 - RNA, 18 nt, Artificial Sequence
  Description of Artificial Sequence: Synthetic oligonucleotide
cugugcaguuccauguuu

SEQ ID NO: 41286 - RNA, 18 nt, Artificial Sequence
  Description of Artificial Sequence: Synthetic oligonucleotide
augcccugugcaguucca

SEQ ID NO: 41287 - RNA, 18 nt, Artificial Sequence
  Description of Artificial Sequence: Synthetic oligonucleotide
ccugaaugcccugugcag

SEQ ID NO: 41288 - RNA, 18 nt, Artificial Sequence
  Description of Artificial Sequence: Synthetic oligonucleotide
acuugccugaaugcccug

SEQ ID NO: 41289 - RNA, 18 nt, Artificial Sequence
  Description of Artificial Sequence: Synthetic oligonucleotide
cuugcacuugccugaaug

SEQ ID NO: 41290 - RNA, 18 nt, Artificial Sequence
  Description of Artificial Sequence: Synthetic oligonucleotide
aaccacuugcacuugccu

SEQ ID NO: 41291 - RNA, 18 nt, Artificial Sequence
  Description of Artificial Sequence: Synthetic oligonucleotide
cccugaaccacuugcacu

SEQ ID NO: 41292 - RNA, 18 nt, Artificial Sequence
  Description of Artificial Sequence: Synthetic oligonucleotide
cuggccccugaaccacuu

SEQ ID NO: 41293 - RNA, 18 nt, Artificial Sequence
  Description of Artificial Sequence: Synthetic oligonucleotide
cugcgcuggccccugaac

SEQ ID NO: 41294 - RNA, 18 nt, Artificial Sequence
  Description of Artificial Sequence: Synthetic oligonucleotide
cugcucugcgcuggcccc

SEQ ID NO: 41295 - RNA, 18 nt, Artificial Sequence
  Description of Artificial Sequence: Synthetic oligonucleotide
gcacucugcucugcgcug

SEQ ID NO: 41296 - RNA, 18 nt, Artificial Sequence
  Description of Artificial Sequence: Synthetic oligonucleotide
acucagcacucugcucug

SEQ ID NO: 41297 - RNA, 18 nt, Artificial Sequence
  Description of Artificial Sequence: Synthetic oligonucleotide
ucuuuacucagcacucug

SEQ ID NO: 41298 - RNA, 18 nt, Artificial Sequence
  Description of Artificial Sequence: Synthetic oligonucleotide
ugacaucuuuacucagca

SEQ ID NO: 41299 - RNA, 18 nt, Artificial Sequence
  Description of Artificial Sequence: Synthetic oligonucleotide
uuuucugacaucuuuacu

SEQ ID NO: 41300 - RNA, 18 nt, Artificial Sequence
  Description of Artificial Sequence: Synthetic oligonucleotide
uuuccuuuucugacaucu

SEQ ID NO: 41301 - RNA, 18 nt, Artificial Sequence
  Description of Artificial Sequence: Synthetic oligonucleotide
auugcuuuccuuuucuga

SEQ ID NO: 41302 - RNA, 18 nt, Artificial Sequence
  Description of Artificial Sequence: Synthetic oligonucleotide
agaccauugcuuuccuuu

SEQ ID NO: 41303 - RNA, 18 nt, Artificial Sequence
  Description of Artificial Sequence: Synthetic oligonucleotide
guaccagaccauugcuuu

SEQ ID NO: 41304 - RNA, 18 nt, Artificial Sequence
  Description of Artificial Sequence: Synthetic oligonucleotide
gacuuguaccagaccauu

SEQ ID NO: 41305 - RNA, 18 nt, Artificial Sequence
  Description of Artificial Sequence: Synthetic oligonucleotide
uacaagacuuguaccaga

SEQ ID NO: 41306 - RNA, 18 nt, Artificial Sequence
  Description of Artificial Sequence: Synthetic oligonucleotide
uucuauacaagacuugua

SEQ ID NO: 41307 - RNA, 18 nt, Artificial Sequence
  Description of Artificial Sequence: Synthetic oligonucleotide
ucuuguucuauacaagac

SEQ ID NO: 41308 - RNA, 18 nt, Artificial Sequence
  Description of Artificial Sequence: Synthetic oligonucleotide
aaacuucuuguucuauac

SEQ ID NO: 41309 - RNA, 18 nt, Artificial Sequence
  Description of Artificial Sequence: Synthetic oligonucleotide
agucuaaacuucuuguuc

SEQ ID NO: 41310 - RNA, 18 nt, Artificial Sequence
  Description of Artificial Sequence: Synthetic oligonucleotide
ucaaaagucuaaacuucu

SEQ ID NO: 41311 - RNA, 18 nt, Artificial Sequence
  Description of Artificial Sequence: Synthetic oligonucleotide
ccuguucaaaagucuaaa

SEQ ID NO: 41312 - RNA, 18 nt, Artificial Sequence
  Description of Artificial Sequence: Synthetic oligonucleotide
gauugccuguucaaaagu

SEQ ID NO: 41313 - RNA, 18 nt, Artificial Sequence
  Description of Artificial Sequence: Synthetic oligonucleotide
aucucgauugccuguuca

SEQ ID NO: 41314 - RNA, 18 nt, Artificial Sequence
  Description of Artificial Sequence: Synthetic oligonucleotide
cccaaaucucgauugccu

SEQ ID NO: 41315 - RNA, 18 nt, Artificial Sequence
  Description of Artificial Sequence: Synthetic oligonucleotide
ugaaccccaaaucucgau

SEQ ID NO: 41316 - RNA, 18 nt, Artificial Sequence
  Description of Artificial Sequence: Synthetic oligonucleotide
cuuucugaaccccaaauc

SEQ ID NO: 41317 - RNA, 18 nt, Artificial Sequence
  Description of Artificial Sequence: Synthetic oligonucleotide
uuuaucuuucugaacccc

SEQ ID NO: 41318 - RNA, 18 nt, Artificial Sequence
  Description of Artificial Sequence: Synthetic oligonucleotide
ugggauuuaucuuucuga

SEQ ID NO: 41319 - RNA, 18 nt, Artificial Sequence
  Description of Artificial Sequence: Synthetic oligonucleotide
acuuuugggauuuaucuu

SEQ ID NO: 41320 - RNA, 18 nt, Artificial Sequence
  Description of Artificial Sequence: Synthetic oligonucleotide
uccauacuuuugggauuu

SEQ ID NO: 41321 - RNA, 18 nt, Artificial Sequence
  Description of Artificial Sequence: Synthetic oligonucleotide
uguucuccauacuuuugg

SEQ ID NO: 41322 - RNA, 18 nt, Artificial Sequence
  Description of Artificial Sequence: Synthetic oligonucleotide
uccuuuguucuccauacu

SEQ ID NO: 41323 - RNA, 18 nt, Artificial Sequence
  Description of Artificial Sequence: Synthetic oligonucleotide
ugaguuccuuuguucucc

SEQ ID NO: 41324 - RNA, 18 nt, Artificial Sequence
  Description of Artificial Sequence: Synthetic oligonucleotide
uaaaaugaguuccuuugu

SEQ ID NO: 41325 - RNA, 18 nt, Artificial Sequence
  Description of Artificial Sequence: Synthetic oligonucleotide
uccuuuaaaaugaguucc

SEQ ID NO: 41326 - RNA, 18 nt, Artificial Sequence
  Description of Artificial Sequence: Synthetic oligonucleotide
gcuaguccuuuaaaauga

SEQ ID NO: 41327 - RNA, 18 nt, Artificial Sequence
  Description of Artificial Sequence: Synthetic oligonucleotide
ucuuagcuaguccuuuaa

SEQ ID NO: 41328 - RNA, 18 nt, Artificial Sequence
  Description of Artificial Sequence: Synthetic oligonucleotide
gagcaucuuagcuagucc

SEQ ID NO: 41329 - RNA, 18 nt, Artificial Sequence
  Description of Artificial Sequence: Synthetic oligonucleotide
agauugagcaucuuagcu

SEQ ID NO: 41330 - RNA, 18 nt, Artificial Sequence
  Description of Artificial Sequence: Synthetic oligonucleotide
uuuagagauugagcaucu

SEQ ID NO: 41331 - RNA, 18 nt, Artificial Sequence
  Description of Artificial Sequence: Synthetic oligonucleotide
uuuuuuuuagagauugag

SEQ ID NO: 41332 - RNA, 18 nt, Artificial Sequence
  Description of Artificial Sequence: Synthetic oligonucleotide
uccuuuuuuuuuuagaga

SEQ ID NO: 41333 - RNA, 18 nt, Artificial Sequence
  Description of Artificial Sequence: Synthetic oligonucleotide
acagauccuuuuuuuuuu

SEQ ID NO: 41334 - RNA, 18 nt, Artificial Sequence
  Description of Artificial Sequence: Synthetic oligonucleotide
cgaauacagauccuuuuu

SEQ ID NO: 41335 - RNA, 18 nt, Artificial Sequence
  Description of Artificial Sequence: Synthetic oligonucleotide
ucucacgaauacagaucc

SEQ ID NO: 41336 - RNA, 18 nt, Artificial Sequence
  Description of Artificial Sequence: Synthetic oligonucleotide
ucuacucucacgaauaca

SEQ ID NO: 41337 - RNA, 18 nt, Artificial Sequence
  Description of Artificial Sequence: Synthetic oligonucleotide
uucucucuacucucacga

SEQ ID NO: 41338 - RNA, 18 nt, Artificial Sequence
  Description of Artificial Sequence: Synthetic oligonucleotide
aaccuuucucucuacucu

SEQ ID NO: 41339 - RNA, 18 nt, Artificial Sequence
  Description of Artificial Sequence: Synthetic oligonucleotide
uaaacaaccuuucucucu

SEQ ID NO: 41340 - RNA, 18 nt, Artificial Sequence
  Description of Artificial Sequence: Synthetic oligonucleotide
cuuccuaaacaaccuuuc

SEQ ID NO: 41341 - RNA, 18 nt, Artificial Sequence
  Description of Artificial Sequence: Synthetic oligonucleotide
ugacucuuccuaaacaac

SEQ ID NO: 41342 - RNA, 18 nt, Artificial Sequence
  Description of Artificial Sequence: Synthetic oligonucleotide
ucuguugacucuuccuaa

SEQ ID NO: 41343 - RNA, 18 nt, Artificial Sequence
  Description of Artificial Sequence: Synthetic oligonucleotide
uaaagucuguugacucuu

SEQ ID NO: 41344 - RNA, 18 nt, Artificial Sequence
  Description of Artificial Sequence: Synthetic oligonucleotide
uuugcuaaagucuguuga

SEQ ID NO: 41345 - RNA, 18 nt, Artificial Sequence
  Description of Artificial Sequence: Synthetic oligonucleotide
aggauuuugcuaaagucu

SEQ ID NO: 41346 - RNA, 18 nt, Artificial Sequence
  Description of Artificial Sequence: Synthetic oligonucleotide
auaaaaggauuuugcuaa

SEQ ID NO: 41347 - RNA, 18 nt, Artificial Sequence
  Description of Artificial Sequence: Synthetic oligonucleotide
aucaaauaaaaggauuuu

SEQ ID NO: 41348 - RNA, 18 nt, Artificial Sequence
  Description of Artificial Sequence: Synthetic oligonucleotide
caugaaucaaauaaaagg

SEQ ID NO: 41349 - RNA, 18 nt, Artificial Sequence
  Description of Artificial Sequence: Synthetic oligonucleotide
uuaugcaugaaucaaaua

SEQ ID NO: 41350 - RNA, 18 nt, Artificial Sequence
  Description of Artificial Sequence: Synthetic oligonucleotide
aggaguuaugcaugaauc

SEQ ID NO: 41351 - RNA, 18 nt, Artificial Sequence
  Description of Artificial Sequence: Synthetic oligonucleotide
ccaucaggaguuaugcau

SEQ ID NO: 41352 - RNA, 18 nt, Artificial Sequence
  Description of Artificial Sequence: Synthetic oligonucleotide
acacuccaucaggaguua

SEQ ID NO: 41353 - RNA, 18 nt, Artificial Sequence
  Description of Artificial Sequence: Synthetic oligonucleotide
ccuugacacuccaucagg

SEQ ID NO: 41354 - RNA, 18 nt, Artificial Sequence
  Description of Artificial Sequence: Synthetic oligonucleotide
gucuuccuugacacucca

SEQ ID NO: 41355 - RNA, 18 nt, Artificial Sequence
  Description of Artificial Sequence: Synthetic oligonucleotide
aaugagucuuccuugaca

SEQ ID NO: 41356 - RNA, 18 nt, Artificial Sequence
  Description of Artificial Sequence: Synthetic oligonucleotide
aagugaaugagucuuccu

SEQ ID NO: 41357 - RNA, 18 nt, Artificial Sequence
  Description of Artificial Sequence: Synthetic oligonucleotide
aagaaaagugaaugaguc

SEQ ID NO: 41358 - RNA, 18 nt, Artificial Sequence
  Description of Artificial Sequence: Synthetic oligonucleotide
caggaaagaaaagugaau

SEQ ID NO: 41359 - RNA, 18 nt, Artificial Sequence
  Description of Artificial Sequence: Synthetic oligonucleotide
ucuggcaggaaagaaaag

SEQ ID NO: 41360 - RNA, 18 nt, Artificial Sequence
  Description of Artificial Sequence: Synthetic oligonucleotide
aacuuucuggcaggaaag

SEQ ID NO: 41361 - RNA, 18 nt, Artificial Sequence
  Description of Artificial Sequence: Synthetic oligonucleotide
gaaccaacuuucuggcag

SEQ ID NO: 41362 - RNA, 18 nt, Artificial Sequence
  Description of Artificial Sequence: Synthetic oligonucleotide
ugcaagaaccaacuuucu

SEQ ID NO: 41363 - RNA, 18 nt, Artificial Sequence
  Description of Artificial Sequence: Synthetic oligonucleotide
uauuuugcaagaaccaac

SEQ ID NO: 41364 - RNA, 18 nt, Artificial Sequence
  Description of Artificial Sequence: Synthetic oligonucleotide
uaaucuauuuugcaagaa

SEQ ID NO: 41365 - RNA, 18 nt, Artificial Sequence
  Description of Artificial Sequence: Synthetic oligonucleotide
caaguuaaucuauuuugc

SEQ ID NO: 41366 - RNA, 18 nt, Artificial Sequence
  Description of Artificial Sequence: Synthetic oligonucleotide
gucaucaaguuaaucuau

SEQ ID NO: 41367 - RNA, 18 nt, Artificial Sequence
  Description of Artificial Sequence: Synthetic oligonucleotide
acauagucaucaaguuaa

SEQ ID NO: 41368 - RNA, 18 nt, Artificial Sequence
  Description of Artificial Sequence: Synthetic oligonucleotide
uauacacauagucaucaa

SEQ ID NO: 41369 - RNA, 18 nt, Artificial Sequence
  Description of Artificial Sequence: Synthetic oligonucleotide
uccaauauacacauaguc

SEQ ID NO: 41370 - RNA, 18 nt, Artificial Sequence
  Description of Artificial Sequence: Synthetic oligonucleotide
gaguauccaauauacaca

SEQ ID NO: 41371 - RNA, 18 nt, Artificial Sequence
  Description of Artificial Sequence: Synthetic oligonucleotide
auuaggaguauccaauau

SEQ ID NO: 41372 - RNA, 18 nt, Artificial Sequence
  Description of Artificial Sequence: Synthetic oligonucleotide
cuaaaauuaggaguaucc

SEQ ID NO: 41373 - RNA, 18 nt, Artificial Sequence
  Description of Artificial Sequence: Synthetic oligonucleotide
cagagcuaaaauuaggag

SEQ ID NO: 41374 - RNA, 18 nt, Artificial Sequence
  Description of Artificial Sequence: Synthetic oligonucleotide
ucuaacagagcuaaaauu

SEQ ID NO: 41375 - RNA, 18 nt, Artificial Sequence
  Description of Artificial Sequence: Synthetic oligonucleotide
acauaucuaacagagcua

SEQ ID NO: 41376 - RNA, 18 nt, Artificial Sequence
  Description of Artificial Sequence: Synthetic oligonucleotide
aagaaacauaucuaacag

SEQ ID NO: 41377 - RNA, 18 nt, Artificial Sequence
  Description of Artificial Sequence: Synthetic oligonucleotide
uuagaaagaaacauaucu

SEQ ID NO: 41378 - RNA, 18 nt, Artificial Sequence
  Description of Artificial Sequence: Synthetic oligonucleotide
uguccuuagaaagaaaca

SEQ ID NO: 41379 - RNA, 18 nt, Artificial Sequence
  Description of Artificial Sequence: Synthetic oligonucleotide
uugcuuguccuuagaaag

SEQ ID NO: 41380 - RNA, 18 nt, Artificial Sequence
  Description of Artificial Sequence: Synthetic oligonucleotide
cauaguugcuuguccuua

SEQ ID NO: 41381 - RNA, 18 nt, Artificial Sequence
  Description of Artificial Sequence: Synthetic oligonucleotide
cuauacauaguugcuugu

SEQ ID NO: 41382 - RNA, 18 nt, Artificial Sequence
  Description of Artificial Sequence: Synthetic oligonucleotide
caagucuauacauaguug

SEQ ID NO: 41383 - RNA, 18 nt, Artificial Sequence
  Description of Artificial Sequence: Synthetic oligonucleotide
aacaacaagucuauacau

SEQ ID NO: 41384 - RNA, 18 nt, Artificial Sequence
  Description of Artificial Sequence: Synthetic oligonucleotide
auucaaacaacaagucua

SEQ ID NO: 41385 - RNA, 18 nt, Artificial Sequence
  Description of Artificial Sequence: Synthetic oligonucleotide
aaaaaauucaaacaacaa

SEQ ID NO: 41386 - RNA, 18 nt, Artificial Sequence
  Description of Artificial Sequence: Synthetic oligonucleotide
cugaaaaaaaauucaaac

SEQ ID NO: 41387 - RNA, 18 nt, Artificial Sequence
  Description of Artificial Sequence: Synthetic oligonucleotide
auauacugaaaaaaaauu

SEQ ID NO: 41388 - RNA, 18 nt, Artificial Sequence
  Description of Artificial Sequence: Synthetic oligonucleotide
cauauauauacugaaaaa

SEQ ID NO: 41389 - RNA, 18 nt, Artificial Sequence
  Description of Artificial Sequence: Synthetic oligonucleotide
agaaacauauauauacug

SEQ ID NO: 41390 - RNA, 18 nt, Artificial Sequence
  Description of Artificial Sequence: Synthetic oligonucleotide
aaacaagaaacauauaua

SEQ ID NO: 41391 - RNA, 18 nt, Artificial Sequence
  Description of Artificial Sequence: Synthetic oligonucleotide
uagaaaaacaagaaacau

SEQ ID NO: 41392 - RNA, 18 nt, Artificial Sequence
  Description of Artificial Sequence: Synthetic oligonucleotide
aaaaauagaaaaacaaga

SEQ ID NO: 41393 - RNA, 18 nt, Artificial Sequence
  Description of Artificial Sequence: Synthetic oligonucleotide
aguagaaaaauagaaaaa

SEQ ID NO: 41394 - RNA, 18 nt, Artificial Sequence
  Description of Artificial Sequence: Synthetic oligonucleotide
uaugaaguagaaaaauag

SEQ ID NO: 41395 - RNA, 18 nt, Artificial Sequence
  Description of Artificial Sequence: Synthetic oligonucleotide
aacaguaugaaguagaaa

SEQ ID NO: 41396 - RNA, 18 nt, Artificial Sequence
  Description of Artificial Sequence: Synthetic oligonucleotide
acauuaacaguaugaagu

SEQ ID NO: 41397 - RNA, 18 nt, Artificial Sequence
  Description of Artificial Sequence: Synthetic oligonucleotide
auuugacauuaacaguau

SEQ ID NO: 41398 - RNA, 18 nt, Artificial Sequence
  Description of Artificial Sequence: Synthetic oligonucleotide
uugauauuugacauuaac

SEQ ID NO: 41399 - RNA, 18 nt, Artificial Sequence
  Description of Artificial Sequence: Synthetic oligonucleotide
cauuuuugauauuugaca

SEQ ID NO: 41400 - RNA, 18 nt, Artificial Sequence
  Description of Artificial Sequence: Synthetic oligonucleotide
gaaaacauuuuugauauu

SEQ ID NO: 41401 - RNA, 18 nt, Artificial Sequence
  Description of Artificial Sequence: Synthetic oligonucleotide
ugcuggaaaacauuuuug

SEQ ID NO: 41402 - RNA, 18 nt, Artificial Sequence
  Description of Artificial Sequence: Synthetic oligonucleotide
gauauugcuggaaaacau

SEQ ID NO: 41403 - RNA, 18 nt, Artificial Sequence
  Description of Artificial Sequence: Synthetic oligonucleotide
aacuugauauugcuggaa

SEQ ID NO: 41404 - RNA, 18 nt, Artificial Sequence
  Description of Artificial Sequence: Synthetic oligonucleotide
gccauaacuugauauugc

SEQ ID NO: 41405 - RNA, 18 nt, Artificial Sequence
  Description of Artificial Sequence: Synthetic oligonucleotide
ccauugccauaacuugau

SEQ ID NO: 41406 - RNA, 18 nt, Artificial Sequence
  Description of Artificial Sequence: Synthetic oligonucleotide
uuuugccauugccauaac

SEQ ID NO: 41407 - RNA, 18 nt, Artificial Sequence
  Description of Artificial Sequence: Synthetic oligonucleotide
aggacuuuugccauugcc

SEQ ID NO: 41408 - RNA, 18 nt, Artificial Sequence
  Description of Artificial Sequence: Synthetic oligonucleotide
caacaaggacuuuugcca

SEQ ID NO: 41409 - RNA, 18 nt, Artificial Sequence
  Description of Artificial Sequence: Synthetic oligonucleotide
aucuacaacaaggacuuu

SEQ ID NO: 41410 - RNA, 18 nt, Artificial Sequence
  Description of Artificial Sequence: Synthetic oligonucleotide
uucucaucuacaacaagg

SEQ ID NO: 41411 - RNA, 18 nt, Artificial Sequence
  Description of Artificial Sequence: Synthetic oligonucleotide
uaugcuucucaucuacaa

SEQ ID NO: 41412 - RNA, 18 nt, Artificial Sequence
  Description of Artificial Sequence: Synthetic oligonucleotide
ucuuauaugcuucucauc

SEQ ID NO: 41413 - RNA, 18 nt, Artificial Sequence
  Description of Artificial Sequence: Synthetic oligonucleotide
ccauuucuuauaugcuuc

SEQ ID NO: 41414 - RNA, 18 nt, Artificial Sequence
  Description of Artificial Sequence: Synthetic oligonucleotide
ggcaaccauuucuuauau

SEQ ID NO: 41415 - RNA, 18 nt, Artificial Sequence
  Description of Artificial Sequence: Synthetic oligonucleotide
agauuggcaaccauuucu

SEQ ID NO: 41416 - RNA, 18 nt, Artificial Sequence
  Description of Artificial Sequence: Synthetic oligonucleotide
aacaaagauuggcaacca

SEQ ID NO: 41417 - RNA, 18 nt, Artificial Sequence
  Description of Artificial Sequence: Synthetic oligonucleotide
uacaaaacaaagauuggc

SEQ ID NO: 41418 - RNA, 18 nt, Artificial Sequence
  Description of Artificial Sequence: Synthetic oligonucleotide
gaucauacaaaacaaaga

SEQ ID NO: 41419 - RNA, 18 nt, Artificial Sequence
  Description of Artificial Sequence: Synthetic oligonucleotide
aaauagaucauacaaaac

SEQ ID NO: 41420 - RNA, 18 nt, Artificial Sequence
  Description of Artificial Sequence: Synthetic oligonucleotide
acucuaaauagaucauac

SEQ ID NO: 41421 - RNA, 18 nt, Artificial Sequence
  Description of Artificial Sequence: Synthetic oligonucleotide
uuaaaacucuaaauagau

SEQ ID NO: 41422 - RNA, 18 nt, Artificial Sequence
  Description of Artificial Sequence: Synthetic oligonucleotide
guugguuaaaacucuaaa

SEQ ID NO: 41423 - RNA, 18 nt, Artificial Sequence
  Description of Artificial Sequence: Synthetic oligonucleotide
ucuagguugguuaaaacu

SEQ ID NO: 41424 - RNA, 18 nt, Artificial Sequence
  Description of Artificial Sequence: Synthetic oligonucleotide
acagaucuagguugguua

SEQ ID NO: 41425 - RNA, 18 nt, Artificial Sequence
  Description of Artificial Sequence: Synthetic oligonucleotide
agcugacagaucuagguu

SEQ ID NO: 41426 - RNA, 18 nt, Artificial Sequence
  Description of Artificial Sequence: Synthetic oligonucleotide
agcuuagcugacagaucu

SEQ ID NO: 41427 - RNA, 18 nt, Artificial Sequence
  Description of Artificial Sequence: Synthetic oligonucleotide
aaauuagcuuagcugaca

SEQ ID NO: 41428 - RNA, 18 nt, Artificial Sequence
  Description of Artificial Sequence: Synthetic oligonucleotide
auauaaaauuagcuuagc

SEQ ID NO: 41429 - RNA, 18 nt, Artificial Sequence
  Description of Artificial Sequence: Synthetic oligonucleotide
accaaauauaaaauuagc

SEQ ID NO: 41430 - RNA, 18 nt, Artificial Sequence
  Description of Artificial Sequence: Synthetic oligonucleotide
uguauaccaaauauaaaa

SEQ ID NO: 41431 - RNA, 18 nt, Artificial Sequence
  Description of Artificial Sequence: Synthetic oligonucleotide
augcauguauaccaaaua

SEQ ID NO: 41432 - RNA, 18 nt, Artificial Sequence
  Description of Artificial Sequence: Synthetic oligonucleotide
uugacaugcauguauacc

SEQ ID NO: 41433 - RNA, 18 nt, Artificial Sequence
  Description of Artificial Sequence: Synthetic oligonucleotide
uuuauuugacaugcaugu

SEQ ID NO: 41434 - RNA, 18 nt, Artificial Sequence
  Description of Artificial Sequence: Synthetic oligonucleotide
uuaacuuuauuugacaug

SEQ ID NO: 41435 - RNA, 18 nt, Artificial Sequence
  Description of Artificial Sequence: Synthetic oligonucleotide
uaaaauuaacuuuauuug

SEQ ID NO: 41436 - RNA, 18 nt, Artificial Sequence
  Description of Artificial Sequence: Synthetic oligonucleotide
guauguaaaauuaacuuu

SEQ ID NO: 41437 - RNA, 18 nt, Artificial Sequence
  Description of Artificial Sequence: Synthetic oligonucleotide
ucuuuucaaaaucugaaa

SEQ ID NO: 41438 - RNA, 18 nt, Artificial Sequence
  Description of Artificial Sequence: Synthetic oligonucleotide
uguuuucuuuucaaaauc

SEQ ID NO: 41439 - RNA, 18 nt, Artificial Sequence
  Description of Artificial Sequence: Synthetic oligonucleotide
uuacuuguuuucuuuuca

SEQ ID NO: 41440 - RNA, 18 nt, Artificial Sequence
  Description of Artificial Sequence: Synthetic oligonucleotide
aacgauuacuuguuuucu

SEQ ID NO: 41441 - RNA, 18 nt, Artificial Sequence
  Description of Artificial Sequence: Synthetic oligonucleotide
cucagaacgauuacuugu

SEQ ID NO: 41442 - RNA, 18 nt, Artificial Sequence
  Description of Artificial Sequence: Synthetic oligonucleotide
ucaaucucagaacgauua

SEQ ID NO: 41443 - RNA, 18 nt, Artificial Sequence
  Description of Artificial Sequence: Synthetic oligonucleotide
ggguuucaaucucagaac

SEQ ID NO: 41444 - RNA, 18 nt, Artificial Sequence
  Description of Artificial Sequence: Synthetic oligonucleotide
ugucuggguuucaaucuc

SEQ ID NO: 41445 - RNA, 18 nt, Artificial Sequence
  Description of Artificial Sequence: Synthetic oligonucleotide
cccucugucuggguuuca

SEQ ID NO: 41446 - RNA, 18 nt, Artificial Sequence
  Description of Artificial Sequence: Synthetic oligonucleotide
ugcuccccucugucuggg

SEQ ID NO: 41447 - RNA, 18 nt, Artificial Sequence
  Description of Artificial Sequence: Synthetic oligonucleotide
cucugugcuccccucugu

SEQ ID NO: 41448 - RNA, 18 nt, Artificial Sequence
  Description of Artificial Sequence: Synthetic oligonucleotide
ucuuucucugugcucccc

SEQ ID NO: 41449 - RNA, 18 nt, Artificial Sequence
  Description of Artificial Sequence: Synthetic oligonucleotide
cauucucuuucucugugc

SEQ ID NO: 41450 - RNA, 18 nt, Artificial Sequence
  Description of Artificial Sequence: Synthetic oligonucleotide
uucaucauucucuuucuc

SEQ ID NO: 41451 - RNA, 18 nt, Artificial Sequence
  Description of Artificial Sequence: Synthetic oligonucleotide
uucucuucaucauucucu

SEQ ID NO: 41452 - RNA, 18 nt, Artificial Sequence
  Description of Artificial Sequence: Synthetic oligonucleotide
ggccuuucucuucaucau

SEQ ID NO: 41453 - RNA, 18 nt, Artificial Sequence
  Description of Artificial Sequence: Synthetic oligonucleotide
cuccgggccuuucucuuc

SEQ ID NO: 41454 - RNA, 18 nt, Artificial Sequence
  Description of Artificial Sequence: Synthetic oligonucleotide
ggccguggaaucuuagga

SEQ ID NO: 41455 - RNA, 18 nt, Artificial Sequence
  Description of Artificial Sequence: Synthetic oligonucleotide
guaguggccguggaaucu

SEQ ID NO: 41456 - RNA, 18 nt, Artificial Sequence
  Description of Artificial Sequence: Synthetic oligonucleotide
gugugguaguggccgugg

SEQ ID NO: 41457 - RNA, 18 nt, Artificial Sequence
  Description of Artificial Sequence: Synthetic oligonucleotide
ugugggugugguaguggc

SEQ ID NO: 41458 - RNA, 18 nt, Artificial Sequence
  Description of Artificial Sequence: Synthetic oligonucleotide
guguguguggguguggua

SEQ ID NO: 41459 - RNA, 18 nt, Artificial Sequence
  Description of Artificial Sequence: Synthetic oligonucleotide
cucucgugugugugggug

SEQ ID NO: 41460 - RNA, 18 nt, Artificial Sequence
  Description of Artificial Sequence: Synthetic oligonucleotide
gacuacucucgugugugu

SEQ ID NO: 41461 - RNA, 18 nt, Artificial Sequence
  Description of Artificial Sequence: Synthetic oligonucleotide
ggcuggacuacucucgug

SEQ ID NO: 41462 - RNA, 18 nt, Artificial Sequence
  Description of Artificial Sequence: Synthetic oligonucleotide
ucaguggcuggacuacuc

SEQ ID NO: 41463 - RNA, 18 nt, Artificial Sequence
  Description of Artificial Sequence: Synthetic oligonucleotide
ugaauucaguggcuggac

SEQ ID NO: 41464 - RNA, 18 nt, Artificial Sequence
  Description of Artificial Sequence: Synthetic oligonucleotide
agauuugaauucaguggc

SEQ ID NO: 41465 - RNA, 18 nt, Artificial Sequence
  Description of Artificial Sequence: Synthetic oligonucleotide
ucacaagauuugaauuca

SEQ ID NO: 41466 - RNA, 18 nt, Artificial Sequence
  Description of Artificial Sequence: Synthetic oligonucleotide
acccaucacaagauuuga

SEQ ID NO: 41467 - RNA, 18 nt, Artificial Sequence
  Description of Artificial Sequence: Synthetic oligonucleotide
aaauaacccaucacaaga

SEQ ID NO: 41468 - RNA, 18 nt, Artificial Sequence
  Description of Artificial Sequence: Synthetic oligonucleotide
aaagcaaauaacccauca

SEQ ID NO: 41469 - RNA, 18 nt, Artificial Sequence
  Description of Artificial Sequence: Synthetic oligonucleotide
uuucuaaagcaaauaacc

SEQ ID NO: 41470 - RNA, 18 nt, Artificial Sequence
  Description of Artificial Sequence: Synthetic oligonucleotide
cuauauuucuaaagcaaa

SEQ ID NO: 41471 - RNA, 18 nt, Artificial Sequence
  Description of Artificial Sequence: Synthetic oligonucleotide
gauuucuauauuucuaaa

SEQ ID NO: 41472 - RNA, 18 nt, Artificial Sequence
  Description of Artificial Sequence: Synthetic oligonucleotide
aacaugauuucuauauuu

SEQ ID NO: 41473 - RNA, 18 nt, Artificial Sequence
  Description of Artificial Sequence: Synthetic oligonucleotide
auaucaacaugauuucua

SEQ ID NO: 41474 - RNA, 18 nt, Artificial Sequence
  Description of Artificial Sequence: Synthetic oligonucleotide
auucaauaucaacaugau

SEQ ID NO: 41475 - RNA, 18 nt, Artificial Sequence
  Description of Artificial Sequence: Synthetic oligonucleotide
auaauauucaauaucaac

SEQ ID NO: 41476 - RNA, 18 nt, Artificial Sequence
  Description of Artificial Sequence: Synthetic oligonucleotide
gauagauaauauucaaua

SEQ ID NO: 41477 - RNA, 18 nt, Artificial Sequence
  Description of Artificial Sequence: Synthetic oligonucleotide
gaauagauagauaauauu

SEQ ID NO: 41478 - RNA, 18 nt, Artificial Sequence
  Description of Artificial Sequence: Synthetic oligonucleotide
aaaaggaauagauagaua

SEQ ID NO: 41479 - RNA, 18 nt, Artificial Sequence
  Description of Artificial Sequence: Synthetic oligonucleotide
cauauaaaaggaauagau

SEQ ID NO: 41480 - RNA, 18 nt, Artificial Sequence
  Description of Artificial Sequence: Synthetic oligonucleotide
aaggacauauaaaaggaa

SEQ ID NO: 41481 - RNA, 18 nt, Artificial Sequence
  Description of Artificial Sequence: Synthetic oligonucleotide
aggacaaggacauauaaa

SEQ ID NO: 41482 - RNA, 18 nt, Artificial Sequence
  Description of Artificial Sequence: Synthetic oligonucleotide
agagcaggacaaggacau

SEQ ID NO: 41483 - RNA, 18 nt, Artificial Sequence
  Description of Artificial Sequence: Synthetic oligonucleotide
gacacagagcaggacaag

SEQ ID NO: 41484 - RNA, 18 nt, Artificial Sequence
  Description of Artificial Sequence: Synthetic oligonucleotide
caauugacacagagcagg

SEQ ID NO: 41485 - RNA, 18 nt, Artificial Sequence
  Description of Artificial Sequence: Synthetic oligonucleotide
cgcuacaauugacacaga

SEQ ID NO: 41486 - RNA, 18 nt, Artificial Sequence
  Description of Artificial Sequence: Synthetic oligonucleotide
caucucgcuacaauugac

SEQ ID NO: 41487 - RNA, 18 nt, Artificial Sequence
  Description of Artificial Sequence: Synthetic oligonucleotide
aaauacaucucgcuacaa

SEQ ID NO: 41488 - RNA, 18 nt, Artificial Sequence
  Description of Artificial Sequence: Synthetic oligonucleotide
aaaagaaauacaucucgc

SEQ ID NO: 41489 - RNA, 18 nt, Artificial Sequence
  Description of Artificial Sequence: Synthetic oligonucleotide
aacaaaaaagaaauacau

SEQ ID NO: 41490 - RNA, 18 nt, Artificial Sequence
  Description of Artificial Sequence: Synthetic oligonucleotide
acaacaacaaaaaagaaa

SEQ ID NO: 41491 - RNA, 18 nt, Artificial Sequence
  Description of Artificial Sequence: Synthetic oligonucleotide
caacaacaacaacaaaaa

SEQ ID NO: 41492 - RNA, 18 nt, Artificial Sequence
  Description of Artificial Sequence: Synthetic oligonucleotide
aucuccaacaacaacaac

SEQ ID NO: 41493 - RNA, 18 nt, Artificial Sequence
  Description of Artificial Sequence: Synthetic oligonucleotide
acuccaucuccaacaaca

SEQ ID NO: 41494 - RNA, 18 nt, Artificial Sequence
  Description of Artificial Sequence: Synthetic oligonucleotide
gugagacuccaucuccaa

SEQ ID NO: 41495 - RNA, 18 nt, Artificial Sequence
  Description of Artificial Sequence: Synthetic oligonucleotide
acagagugagacuccauc

SEQ ID NO: 41496 - RNA, 18 nt, Artificial Sequence
  Description of Artificial Sequence: Synthetic oligonucleotide
uggcgacagagugagacu

SEQ ID NO: 41497 - RNA, 18 nt, Artificial Sequence
  Description of Artificial Sequence: Synthetic oligonucleotide
cagccuggcgacagagug

SEQ ID NO: 41498 - RNA, 18 nt, Artificial Sequence
  Description of Artificial Sequence: Synthetic oligonucleotide
cacuccagccuggcgaca

SEQ ID NO: 41499 - RNA, 18 nt, Artificial Sequence
  Description of Artificial Sequence: Synthetic oligonucleotide
cacugcacuccagccugg

SEQ ID NO: 41500 - RNA, 18 nt, Artificial Sequence
  Description of Artificial Sequence: Synthetic oligonucleotide
cgugccacugcacuccag

SEQ ID NO: 41501 - RNA, 18 nt, Artificial Sequence
  Description of Artificial Sequence: Synthetic oligonucleotide
gagaucgugccacugcac

SEQ ID NO: 41502 - RNA, 18 nt, Artificial Sequence
  Description of Artificial Sequence: Synthetic oligonucleotide
gagcugagaucgugccac

SEQ ID NO: 41503 - RNA, 18 nt, Artificial Sequence
  Description of Artificial Sequence: Synthetic oligonucleotide
gcagugagcugagaucgu

SEQ ID NO: 41504 - RNA, 18 nt, Artificial Sequence
  Description of Artificial Sequence: Synthetic oligonucleotide
agguugcagugagcugag

SEQ ID NO: 41505 - RNA, 18 nt, Artificial Sequence
  Description of Artificial Sequence: Synthetic oligonucleotide
ggcggagguugcagugag

SEQ ID NO: 41506 - RNA, 18 nt, Artificial Sequence
  Description of Artificial Sequence: Synthetic oligonucleotide
ugggaggcggagguugca

SEQ ID NO: 41507 - RNA, 18 nt, Artificial Sequence
  Description of Artificial Sequence: Synthetic oligonucleotide
gaaccugggaggcggagg

SEQ ID NO: 41508 - RNA, 18 nt, Artificial Sequence
  Description of Artificial Sequence: Synthetic oligonucleotide
ugcuugaaccugggaggc

SEQ ID NO: 41509 - RNA, 18 nt, Artificial Sequence
  Description of Artificial Sequence: Synthetic oligonucleotide
agaacugcuugaaccugg

SEQ ID NO: 41510 - RNA, 18 nt, Artificial Sequence
  Description of Artificial Sequence: Synthetic oligonucleotide
gcaggagaacugcuugaa

SEQ ID NO: 41511 - RNA, 18 nt, Artificial Sequence
  Description of Artificial Sequence: Synthetic oligonucleotide
cugaggcaggagaacugc

SEQ ID NO: 41512 - RNA, 18 nt, Artificial Sequence
  Description of Artificial Sequence: Synthetic oligonucleotide
ggaggcugaggcaggaga

SEQ ID NO: 41513 - RNA, 18 nt, Artificial Sequence
  Description of Artificial Sequence: Synthetic oligonucleotide
acuugggaggcugaggca

SEQ ID NO: 41514 - RNA, 18 nt, Artificial Sequence
  Description of Artificial Sequence: Synthetic oligonucleotide
cagcuacuugggaggcug

SEQ ID NO: 41515 - RNA, 18 nt, Artificial Sequence
  Description of Artificial Sequence: Synthetic oligonucleotide
aaucccagcuacuuggga

SEQ ID NO: 41516 - RNA, 18 nt, Artificial Sequence
  Description of Artificial Sequence: Synthetic oligonucleotide
ccuguaaucccagcuacu

SEQ ID NO: 41517 - RNA, 18 nt, Artificial Sequence
  Description of Artificial Sequence: Synthetic oligonucleotide
gggcaccuguaaucccag

SEQ ID NO: 41518 - RNA, 18 nt, Artificial Sequence
  Description of Artificial Sequence: Synthetic oligonucleotide
gugacgggcaccuguaau

SEQ ID NO: 41519 - RNA, 18 nt, Artificial Sequence
  Description of Artificial Sequence: Synthetic oligonucleotide
gcguggugacgggcaccu

SEQ ID NO: 41520 - RNA, 18 nt, Artificial Sequence
  Description of Artificial Sequence: Synthetic oligonucleotide
gccaggcguggugacggg

SEQ ID NO: 41521 - RNA, 18 nt, Artificial Sequence
  Description of Artificial Sequence: Synthetic oligonucleotide
aauuagccaggcguggug

SEQ ID NO: 41522 - RNA, 18 nt, Artificial Sequence
  Description of Artificial Sequence: Synthetic oligonucleotide
acaaaaauuagccaggcg

SEQ ID NO: 41523 - RNA, 18 nt, Artificial Sequence
  Description of Artificial Sequence: Synthetic oligonucleotide
aaaauacaaaaauuagcc

SEQ ID NO: 41524 - RNA, 18 nt, Artificial Sequence
  Description of Artificial Sequence: Synthetic oligonucleotide
uauuaaaaauacaaaaau

SEQ ID NO: 41525 - RNA, 18 nt, Artificial Sequence
  Description of Artificial Sequence: Synthetic oligonucleotide
gucuguauuaaaaauaca

SEQ ID NO: 41526 - RNA, 18 nt, Artificial Sequence
  Description of Artificial Sequence: Synthetic oligonucleotide
acccugucuguauuaaaa

SEQ ID NO: 41527 - RNA, 18 nt, Artificial Sequence
  Description of Artificial Sequence: Synthetic oligonucleotide
gugaaacccugucuguau

SEQ ID NO: 41528 - RNA, 18 nt, Artificial Sequence
  Description of Artificial Sequence: Synthetic oligonucleotide
acauggugaaacccuguc

SEQ ID NO: 41529 - RNA, 18 nt, Artificial Sequence
  Description of Artificial Sequence: Synthetic oligonucleotide
ggccaacauggugaaacc

SEQ ID NO: 41530 - RNA, 18 nt, Artificial Sequence
  Description of Artificial Sequence: Synthetic oligonucleotide
auccuggccaacauggug

SEQ ID NO: 41531 - RNA, 18 nt, Artificial Sequence
  Description of Artificial Sequence: Synthetic oligonucleotide
agaccauccuggccaaca

SEQ ID NO: 41532 - RNA, 18 nt, Artificial Sequence
  Description of Artificial Sequence: Synthetic oligonucleotide
gaucaagaccauccuggc

SEQ ID NO: 41533 - RNA, 18 nt, Artificial Sequence
  Description of Artificial Sequence: Synthetic oligonucleotide
caagagaucaagaccauc

SEQ ID NO: 41534 - RNA, 18 nt, Artificial Sequence
  Description of Artificial Sequence: Synthetic oligonucleotide
gaggucaagagaucaaga

SEQ ID NO: 41535 - RNA, 18 nt, Artificial Sequence
  Description of Artificial Sequence: Synthetic oligonucleotide
aucacgaggucaagagau

SEQ ID NO: 41536 - RNA, 18 nt, Artificial Sequence
  Description of Artificial Sequence: Synthetic oligonucleotide
ggaggaucacgaggucaa

SEQ ID NO: 41537 - RNA, 18 nt, Artificial Sequence
  Description of Artificial Sequence: Synthetic oligonucleotide
aggugggaggaucacgag

SEQ ID NO: 41538 - RNA, 18 nt, Artificial Sequence
  Description of Artificial Sequence: Synthetic oligonucleotide
ggccgaggugggaggauc

SEQ ID NO: 41539 - RNA, 18 nt, Artificial Sequence
  Description of Artificial Sequence: Synthetic oligonucleotide
ugggaggccgagguggga

SEQ ID NO: 41540 - RNA, 18 nt, Artificial Sequence
  Description of Artificial Sequence: Synthetic oligonucleotide
cacucugggaggccgagg

SEQ ID NO: 41541 - RNA, 18 nt, Artificial Sequence
  Description of Artificial Sequence: Synthetic oligonucleotide
cccagcacucugggaggc

SEQ ID NO: 41542 - RNA, 18 nt, Artificial Sequence
  Description of Artificial Sequence: Synthetic oligonucleotide
guaaucccagcacucugg

SEQ ID NO: 41543 - RNA, 18 nt, Artificial Sequence
  Description of Artificial Sequence: Synthetic oligonucleotide
uaucuguaaucccagcac

SEQ ID NO: 41544 - RNA, 18 nt, Artificial Sequence
  Description of Artificial Sequence: Synthetic oligonucleotide
gcucauaucuguaauccc

SEQ ID NO: 41545 - RNA, 18 nt, Artificial Sequence
  Description of Artificial Sequence: Synthetic oligonucleotide
caguggcucauaucugua

SEQ ID NO: 41546 - RNA, 18 nt, Artificial Sequence
  Description of Artificial Sequence: Synthetic oligonucleotide
gggcgcaguggcucauau

SEQ ID NO: 41547 - RNA, 18 nt, Artificial Sequence
  Description of Artificial Sequence: Synthetic oligonucleotide
cagcugggcgcaguggcu

SEQ ID NO: 41548 - RNA, 18 nt, Artificial Sequence
  Description of Artificial Sequence: Synthetic oligonucleotide
ucuugcagcugggcgcag

SEQ ID NO: 41549 - RNA, 18 nt, Artificial Sequence
  Description of Artificial Sequence: Synthetic oligonucleotide
auacaucuugcagcuggg

SEQ ID NO: 41550 - RNA, 18 nt, Artificial Sequence
  Description of Artificial Sequence: Synthetic oligonucleotide
uagaaauacaucuugcag

SEQ ID NO: 41551 - RNA, 18 nt, Artificial Sequence
  Description of Artificial Sequence: Synthetic oligonucleotide
acugauagaaauacaucu

SEQ ID NO: 41552 - RNA, 18 nt, Artificial Sequence
  Description of Artificial Sequence: Synthetic oligonucleotide
agaauacugauagaaaua

SEQ ID NO: 41553 - RNA, 18 nt, Artificial Sequence
  Description of Artificial Sequence: Synthetic oligonucleotide
uucguuuuagucaacagg

SEQ ID NO: 41554 - RNA, 18 nt, Artificial Sequence
  Description of Artificial Sequence: Synthetic oligonucleotide
uugaauucguuuuaguca

SEQ ID NO: 41555 - RNA, 18 nt, Artificial Sequence
  Description of Artificial Sequence: Synthetic oligonucleotide
ggcuguugaauucguuuu

SEQ ID NO: 41556 - RNA, 18 nt, Artificial Sequence
  Description of Artificial Sequence: Synthetic oligonucleotide
cuacuggcuguugaauuc

SEQ ID NO: 41557 - RNA, 18 nt, Artificial Sequence
  Description of Artificial Sequence: Synthetic oligonucleotide
cccugcuacuggcuguug

SEQ ID NO: 41558 - RNA, 18 nt, Artificial Sequence
  Description of Artificial Sequence: Synthetic oligonucleotide
uauuucccugcuacuggc

SEQ ID NO: 41559 - RNA, 18 nt, Artificial Sequence
  Description of Artificial Sequence: Synthetic oligonucleotide
gaccauauuucccugcua

SEQ ID NO: 41560 - RNA, 18 nt, Artificial Sequence
  Description of Artificial Sequence: Synthetic oligonucleotide
ugaaagaccauauuuccc

SEQ ID NO: 41561 - RNA, 18 nt, Artificial Sequence
  Description of Artificial Sequence: Synthetic oligonucleotide
ugccuugaaagaccauau

SEQ ID NO: 41562 - RNA, 18 nt, Artificial Sequence
  Description of Artificial Sequence: Synthetic oligonucleotide
ucugaugccuugaaagac

SEQ ID NO: 41563 - RNA, 18 nt, Artificial Sequence
  Description of Artificial Sequence: Synthetic oligonucleotide
gaguuucugaugccuuga

SEQ ID NO: 41564 - RNA, 18 nt, Artificial Sequence
  Description of Artificial Sequence: Synthetic oligonucleotide
uaaaugaguuucugaugc

SEQ ID NO: 41565 - RNA, 18 nt, Artificial Sequence
  Description of Artificial Sequence: Synthetic oligonucleotide
uuuuguaaaugaguuucu

SEQ ID NO: 41566 - RNA, 18 nt, Artificial Sequence
  Description of Artificial Sequence: Synthetic oligonucleotide
auaauuuuuguaaaugag

SEQ ID NO: 41567 - RNA, 18 nt, Artificial Sequence
  Description of Artificial Sequence: Synthetic oligonucleotide
gcucuauaauuuuuguaa

SEQ ID NO: 41568 - RNA, 18 nt, Artificial Sequence
  Description of Artificial Sequence: Synthetic oligonucleotide
uggcagcucuauaauuuu

SEQ ID NO: 41569 - RNA, 18 nt, Artificial Sequence
  Description of Artificial Sequence: Synthetic oligonucleotide
uuuccuggcagcucuaua

SEQ ID NO: 41570 - RNA, 18 nt, Artificial Sequence
  Description of Artificial Sequence: Synthetic oligonucleotide
gccuuuuuccuggcagcu

SEQ ID NO: 41571 - RNA, 18 nt, Artificial Sequence
  Description of Artificial Sequence: Synthetic oligonucleotide
gugcagccuuuuuccugg

SEQ ID NO: 41572 - RNA, 18 nt, Artificial Sequence
  Description of Artificial Sequence: Synthetic oligonucleotide
uuguugugcagccuuuuu

SEQ ID NO: 41573 - RNA, 18 nt, Artificial Sequence
  Description of Artificial Sequence: Synthetic oligonucleotide
uauuuuuguugugcagcc

SEQ ID NO: 41574 - RNA, 18 nt, Artificial Sequence
  Description of Artificial Sequence: Synthetic oligonucleotide
ucaacuauuuuuguugug

SEQ ID NO: 41575 - RNA, 18 nt, Artificial Sequence
  Description of Artificial Sequence: Synthetic oligonucleotide
uuuacucaacuauuuuug

SEQ ID NO: 41576 - RNA, 18 nt, Artificial Sequence
  Description of Artificial Sequence: Synthetic oligonucleotide
ucuaguuuacucaacuau

SEQ ID NO: 41577 - RNA, 18 nt, Artificial Sequence
  Description of Artificial Sequence: Synthetic oligonucleotide
auguuucuaguuuacuca

SEQ ID NO: 41578 - RNA, 18 nt, Artificial Sequence
  Description of Artificial Sequence: Synthetic oligonucleotide
aguguauguuucuaguuu

SEQ ID NO: 41579 - RNA, 18 nt, Artificial Sequence
  Description of Artificial Sequence: Synthetic oligonucleotide
uucccaguguauguuucu

SEQ ID NO: 41580 - RNA, 18 nt, Artificial Sequence
  Description of Artificial Sequence: Synthetic oligonucleotide
cucucuucccaguguaug

SEQ ID NO: 41581 - RNA, 18 nt, Artificial Sequence
  Description of Artificial Sequence: Synthetic oligonucleotide
ccauacucucuucccagu

SEQ ID NO: 41582 - RNA, 18 nt, Artificial Sequence
  Description of Artificial Sequence: Synthetic oligonucleotide
ugcccccauacucucuuc

SEQ ID NO: 41583 - RNA, 18 nt, Artificial Sequence
  Description of Artificial Sequence: Synthetic oligonucleotide
caacuugcccccauacuc

SEQ ID NO: 41584 - RNA, 18 nt, Artificial Sequence
  Description of Artificial Sequence: Synthetic oligonucleotide
gcuaacaacuugccccca

SEQ ID NO: 41585 - RNA, 18 nt, Artificial Sequence
  Description of Artificial Sequence: Synthetic oligonucleotide
auccagcuaacaacuugc

SEQ ID NO: 41586 - RNA, 18 nt, Artificial Sequence
  Description of Artificial Sequence: Synthetic oligonucleotide
uaucuauccagcuaacaa

SEQ ID NO: 41587 - RNA, 18 nt, Artificial Sequence
  Description of Artificial Sequence: Synthetic oligonucleotide
aguccuaucuauccagcu

SEQ ID NO: 41588 - RNA, 18 nt, Artificial Sequence
  Description of Artificial Sequence: Synthetic oligonucleotide
agcacaguccuaucuauc

SEQ ID NO: 41589 - RNA, 18 nt, Artificial Sequence
  Description of Artificial Sequence: Synthetic oligonucleotide
gucaaagcacaguccuau

SEQ ID NO: 41590 - RNA, 18 nt, Artificial Sequence
  Description of Artificial Sequence: Synthetic oligonucleotide
gaggugucaaagcacagu

SEQ ID NO: 41591 - RNA, 18 nt, Artificial Sequence
  Description of Artificial Sequence: Synthetic oligonucleotide
ccacagaggugucaaagc

SEQ ID NO: 41592 - RNA, 18 nt, Artificial Sequence
  Description of Artificial Sequence: Synthetic oligonucleotide
auagaccacagagguguc

SEQ ID NO: 41593 - RNA, 18 nt, Artificial Sequence
  Description of Artificial Sequence: Synthetic oligonucleotide
agaucauagaccacagag

SEQ ID NO: 41594 - RNA, 18 nt, Artificial Sequence
  Description of Artificial Sequence: Synthetic oligonucleotide
uucagagaucauagacca

SEQ ID NO: 41595 - RNA, 18 nt, Artificial Sequence
  Description of Artificial Sequence: Synthetic oligonucleotide
ccagguucagagaucaua

SEQ ID NO: 41596 - RNA, 18 nt, Artificial Sequence
  Description of Artificial Sequence: Synthetic oligonucleotide
cuauuccagguucagaga

SEQ ID NO: 41597 - RNA, 18 nt, Artificial Sequence
  Description of Artificial Sequence: Synthetic oligonucleotide
gaacccuauuccagguuc

SEQ ID NO: 41598 - RNA, 18 nt, Artificial Sequence
  Description of Artificial Sequence: Synthetic oligonucleotide
aaaaugaacccuauucca

SEQ ID NO: 41599 - RNA, 18 nt, Artificial Sequence
  Description of Artificial Sequence: Synthetic oligonucleotide
cuauuaaaaugaacccua

SEQ ID NO: 41600 - RNA, 18 nt, Artificial Sequence
  Description of Artificial Sequence: Synthetic oligonucleotide
uaucgcuauuaaaaugaa

SEQ ID NO: 41601 - RNA, 18 nt, Artificial Sequence
  Description of Artificial Sequence: Synthetic oligonucleotide
gacuuuaucgcuauuaaa

SEQ ID NO: 41602 - RNA, 18 nt, Artificial Sequence
  Description of Artificial Sequence: Synthetic oligonucleotide
auaaugacuuuaucgcua

SEQ ID NO: 41603 - RNA, 18 nt, Artificial Sequence
  Description of Artificial Sequence: Synthetic oligonucleotide
cugggauaaugacuuuau

SEQ ID NO: 41604 - RNA, 18 nt, Artificial Sequence
  Description of Artificial Sequence: Synthetic oligonucleotide
augcacugggauaaugac

SEQ ID NO: 41605 - RNA, 18 nt, Artificial Sequence
  Description of Artificial Sequence: Synthetic oligonucleotide
uuuggaugcacugggaua

SEQ ID NO: 41606 - RNA, 18 nt, Artificial Sequence
  Description of Artificial Sequence: Synthetic oligonucleotide
aucaauuuggaugcacug

SEQ ID NO: 41607 - RNA, 18 nt, Artificial Sequence
  Description of Artificial Sequence: Synthetic oligonucleotide
aacuaaucaauuuggaug

SEQ ID NO: 41608 - RNA, 18 nt, Artificial Sequence
  Description of Artificial Sequence: Synthetic oligonucleotide
gcaugaacuaaucaauuu

SEQ ID NO: 41609 - RNA, 18 nt, Artificial Sequence
  Description of Artificial Sequence: Synthetic oligonucleotide
auaaagcaugaacuaauc

SEQ ID NO: 41610 - RNA, 18 nt, Artificial Sequence
  Description of Artificial Sequence: Synthetic oligonucleotide
uccuaauaaagcaugaac

SEQ ID NO: 41611 - RNA, 18 nt, Artificial Sequence
  Description of Artificial Sequence: Synthetic oligonucleotide
cuguuuccuaauaaagca

SEQ ID NO: 41612 - RNA, 18 nt, Artificial Sequence
  Description of Artificial Sequence: Synthetic oligonucleotide
aacuucuguuuccuaaua

SEQ ID NO: 41613 - RNA, 18 nt, Artificial Sequence
  Description of Artificial Sequence: Synthetic oligonucleotide
uggguaacuucuguuucc

SEQ ID NO: 41614 - RNA, 18 nt, Artificial Sequence
  Description of Artificial Sequence: Synthetic oligonucleotide
aguuuuggguaacuucug

SEQ ID NO: 41615 - RNA, 18 nt, Artificial Sequence
  Description of Artificial Sequence: Synthetic oligonucleotide
ugcuaaguuuuggguaac

SEQ ID NO: 41616 - RNA, 18 nt, Artificial Sequence
  Description of Artificial Sequence: Synthetic oligonucleotide
agguuugcuaaguuuugg

SEQ ID NO: 41617 - RNA, 18 nt, Artificial Sequence
  Description of Artificial Sequence: Synthetic oligonucleotide
uacuuagguuugcuaagu

SEQ ID NO: 41618 - RNA, 18 nt, Artificial Sequence
  Description of Artificial Sequence: Synthetic oligonucleotide
cuugguacuuagguuugc

SEQ ID NO: 41619 - RNA, 18 nt, Artificial Sequence
  Description of Artificial Sequence: Synthetic oligonucleotide
ggauacuugguacuuagg

SEQ ID NO: 41620 - RNA, 18 nt, Artificial Sequence
  Description of Artificial Sequence: Synthetic oligonucleotide
guuuuggauacuugguac

SEQ ID NO: 41621 - RNA, 18 nt, Artificial Sequence
  Description of Artificial Sequence: Synthetic oligonucleotide
agaauguuuuggauacuu

SEQ ID NO: 41622 - RNA, 18 nt, Artificial Sequence
  Description of Artificial Sequence: Synthetic oligonucleotide
ggaaaagaauguuuugga

SEQ ID NO: 41623 - RNA, 18 nt, Artificial Sequence
  Description of Artificial Sequence: Synthetic oligonucleotide
guguaggaaaagaauguu

SEQ ID NO: 41624 - RNA, 18 nt, Artificial Sequence
  Description of Artificial Sequence: Synthetic oligonucleotide
acauuguguaggaaaaga

SEQ ID NO: 41625 - RNA, 18 nt, Artificial Sequence
  Description of Artificial Sequence: Synthetic oligonucleotide
cccaaacauuguguagga

SEQ ID NO: 41626 - RNA, 18 nt, Artificial Sequence
  Description of Artificial Sequence: Synthetic oligonucleotide
aauaccccaaacauugug

SEQ ID NO: 41627 - RNA, 18 nt, Artificial Sequence
  Description of Artificial Sequence: Synthetic oligonucleotide
uugacaauaccccaaaca

SEQ ID NO: 41628 - RNA, 18 nt, Artificial Sequence
  Description of Artificial Sequence: Synthetic oligonucleotide
caacuuugacaauacccc

SEQ ID NO: 41629 - RNA, 18 nt, Artificial Sequence
  Description of Artificial Sequence: Synthetic oligonucleotide
caauccaacuuugacaau

SEQ ID NO: 41630 - RNA, 18 nt, Artificial Sequence
  Description of Artificial Sequence: Synthetic oligonucleotide
ugaaucaauccaacuuug

SEQ ID NO: 41631 - RNA, 18 nt, Artificial Sequence
  Description of Artificial Sequence: Synthetic oligonucleotide
gcuggugaaucaauccaa

SEQ ID NO: 41632 - RNA, 18 nt, Artificial Sequence
  Description of Artificial Sequence: Synthetic oligonucleotide
gacuggcuggugaaucaa

SEQ ID NO: 41633 - RNA, 18 nt, Artificial Sequence
  Description of Artificial Sequence: Synthetic oligonucleotide
auuaagacuggcugguga

SEQ ID NO: 41634 - RNA, 18 nt, Artificial Sequence
  Description of Artificial Sequence: Synthetic oligonucleotide
agccaauuaagacuggcu

SEQ ID NO: 41635 - RNA, 18 nt, Artificial Sequence
  Description of Artificial Sequence: Synthetic oligonucleotide
uuaguagccaauuaagac

SEQ ID NO: 41636 - RNA, 18 nt, Artificial Sequence
  Description of Artificial Sequence: Synthetic oligonucleotide
aaccauuaguagccaauu

SEQ ID NO: 41637 - RNA, 18 nt, Artificial Sequence
  Description of Artificial Sequence: Synthetic oligonucleotide
ggcugaaccauuaguagc

SEQ ID NO: 41638 - RNA, 18 nt, Artificial Sequence
  Description of Artificial Sequence: Synthetic oligonucleotide
aaacaggcugaaccauua

SEQ ID NO: 41639 - RNA, 18 nt, Artificial Sequence
  Description of Artificial Sequence: Synthetic oligonucleotide
ggagaaaacaggcugaac

SEQ ID NO: 41640 - RNA, 18 nt, Artificial Sequence
  Description of Artificial Sequence: Synthetic oligonucleotide
cuuuaggagaaaacaggc

SEQ ID NO: 41641 - RNA, 18 nt, Artificial Sequence
  Description of Artificial Sequence: Synthetic oligonucleotide
aaccucuuuaggagaaaa

SEQ ID NO: 41642 - RNA, 18 nt, Artificial Sequence
  Description of Artificial Sequence: Synthetic oligonucleotide
aaacaaaccucuuuagga

SEQ ID NO: 41643 - RNA, 18 nt, Artificial Sequence
  Description of Artificial Sequence: Synthetic oligonucleotide
acauuaaacaaaccucuu

SEQ ID NO: 41644 - RNA, 18 nt, Artificial Sequence
  Description of Artificial Sequence: Synthetic oligonucleotide
aucugacauuaaacaaac

SEQ ID NO: 41645 - RNA, 18 nt, Artificial Sequence
  Description of Artificial Sequence: Synthetic oligonucleotide
uuaucaucugacauuaaa

SEQ ID NO: 41646 - RNA, 18 nt, Artificial Sequence
  Description of Artificial Sequence: Synthetic oligonucleotide
uacaauuaucaucugaca

SEQ ID NO: 41647 - RNA, 18 nt, Artificial Sequence
  Description of Artificial Sequence: Synthetic oligonucleotide
aucuguacaauuaucauc

SEQ ID NO: 41648 - RNA, 18 nt, Artificial Sequence
  Description of Artificial Sequence: Synthetic oligonucleotide
aacauaucuguacaauua

SEQ ID NO: 41649 - RNA, 18 nt, Artificial Sequence
  Description of Artificial Sequence: Synthetic oligonucleotide
ucccaaacauaucuguac

SEQ ID NO: 41650 - RNA, 18 nt, Artificial Sequence
  Description of Artificial Sequence: Synthetic oligonucleotide
cuuccacuucgcuuccaa

SEQ ID NO: 41651 - RNA, 18 nt, Artificial Sequence
  Description of Artificial Sequence: Synthetic oligonucleotide
cagugcuuccacuucgcu

SEQ ID NO: 41652 - RNA, 18 nt, Artificial Sequence
  Description of Artificial Sequence: Synthetic oligonucleotide
agguucagugcuuccacu

SEQ ID NO: 41653 - RNA, 18 nt, Artificial Sequence
  Description of Artificial Sequence: Synthetic oligonucleotide
ccuggagguucagugcuu

SEQ ID NO: 41654 - RNA, 18 nt, Artificial Sequence
  Description of Artificial Sequence: Synthetic oligonucleotide
ugucaccuggagguucag

SEQ ID NO: 41655 - RNA, 18 nt, Artificial Sequence
  Description of Artificial Sequence: Synthetic oligonucleotide
agagaugucaccuggagg

SEQ ID NO: 41656 - RNA, 18 nt, Artificial Sequence
  Description of Artificial Sequence: Synthetic oligonucleotide
uaaacagagaugucaccu

SEQ ID NO: 41657 - RNA, 18 nt, Artificial Sequence
  Description of Artificial Sequence: Synthetic oligonucleotide
cuccuuaaacagagaugu

SEQ ID NO: 41658 - RNA, 18 nt, Artificial Sequence
  Description of Artificial Sequence: Synthetic oligonucleotide
ugaagcuccuuaaacaga

SEQ ID NO: 41659 - RNA, 18 nt, Artificial Sequence
  Description of Artificial Sequence: Synthetic oligonucleotide
ccucuugaagcuccuuaa

SEQ ID NO: 41660 - RNA, 18 nt, Artificial Sequence
  Description of Artificial Sequence: Synthetic oligonucleotide
augagccucuugaagcuc

SEQ ID NO: 41661 - RNA, 18 nt, Artificial Sequence
  Description of Artificial Sequence: Synthetic oligonucleotide
uuuguaugagccucuuga

SEQ ID NO: 41662 - RNA, 18 nt, Artificial Sequence
  Description of Artificial Sequence: Synthetic oligonucleotide
ugaguuuuguaugagccu

SEQ ID NO: 41663 - RNA, 18 nt, Artificial Sequence
  Description of Artificial Sequence: Synthetic oligonucleotide
uuugcugaguuuuguaug

SEQ ID NO: 41664 - RNA, 18 nt, Artificial Sequence
  Description of Artificial Sequence: Synthetic oligonucleotide
ucagcuuugcugaguuuu

SEQ ID NO: 41665 - RNA, 18 nt, Artificial Sequence
  Description of Artificial Sequence: Synthetic oligonucleotide
uuagcucagcuuugcuga

SEQ ID NO: 41666 - RNA, 18 nt, Artificial Sequence
  Description of Artificial Sequence: Synthetic oligonucleotide
cuucauuagcucagcuuu

SEQ ID NO: 41667 - RNA, 18 nt, Artificial Sequence
  Description of Artificial Sequence: Synthetic oligonucleotide
cucuucuucauuagcuca

SEQ ID NO: 41668 - RNA, 18 nt, Artificial Sequence
  Description of Artificial Sequence: Synthetic oligonucleotide
gaagucucuucuucauua

SEQ ID NO: 41669 - RNA, 18 nt, Artificial Sequence
  Description of Artificial Sequence: Synthetic oligonucleotide
uucuugaagucucuucuu

SEQ ID NO: 41670 - RNA, 18 nt, Artificial Sequence
  Description of Artificial Sequence: Synthetic oligonucleotide
ucuuuucaaaaucugaaa

SEQ ID NO: 41671 - RNA, 18 nt, Artificial Sequence
  Description of Artificial Sequence: Synthetic oligonucleotide
uguuuucuuuucaaaauc

SEQ ID NO: 41672 - RNA, 18 nt, Artificial Sequence
  Description of Artificial Sequence: Synthetic oligonucleotide
uuacuuguuuucuuuuca

SEQ ID NO: 41673 - RNA, 18 nt, Artificial Sequence
  Description of Artificial Sequence: Synthetic oligonucleotide
aacgauuacuuguuuucu

SEQ ID NO: 41674 - RNA, 18 nt, Artificial Sequence
  Description of Artificial Sequence: Synthetic oligonucleotide
cucagaacgauuacuugu

SEQ ID NO: 41675 - RNA, 18 nt, Artificial Sequence
  Description of Artificial Sequence: Synthetic oligonucleotide
ucaaucucagaacgauua

SEQ ID NO: 41676 - RNA, 18 nt, Artificial Sequence
  Description of Artificial Sequence: Synthetic oligonucleotide
ggguuucaaucucagaac

SEQ ID NO: 41677 - RNA, 18 nt, Artificial Sequence
  Description of Artificial Sequence: Synthetic oligonucleotide
ugucuggguuucaaucuc

SEQ ID NO: 41678 - RNA, 18 nt, Artificial Sequence
  Description of Artificial Sequence: Synthetic oligonucleotide
cccucugucuggguuuca

SEQ ID NO: 41679 - RNA, 18 nt, Artificial Sequence
  Description of Artificial Sequence: Synthetic oligonucleotide
ugcuccccucugucuggg

SEQ ID NO: 41680 - RNA, 18 nt, Artificial Sequence
  Description of Artificial Sequence: Synthetic oligonucleotide
cucugugcuccccucugu

SEQ ID NO: 41681 - RNA, 18 nt, Artificial Sequence
  Description of Artificial Sequence: Synthetic oligonucleotide
ucuuucucugugcucccc

SEQ ID NO: 41682 - RNA, 18 nt, Artificial Sequence
  Description of Artificial Sequence: Synthetic oligonucleotide
cauucucuuucucugugc

SEQ ID NO: 41683 - RNA, 18 nt, Artificial Sequence
  Description of Artificial Sequence: Synthetic oligonucleotide
uucaucauucucuuucuc

SEQ ID NO: 41684 - RNA, 18 nt, Artificial Sequence
  Description of Artificial Sequence: Synthetic oligonucleotide
uucucuucaucauucucu

SEQ ID NO: 41685 - RNA, 18 nt, Artificial Sequence
  Description of Artificial Sequence: Synthetic oligonucleotide
ggccuuucucuucaucau

SEQ ID NO: 41686 - RNA, 18 nt, Artificial Sequence
  Description of Artificial Sequence: Synthetic oligonucleotide
cuccgggccuuucucuuc

SEQ ID NO: 41687 - RNA, 18 nt, Artificial Sequence
  Description of Artificial Sequence: Synthetic oligonucleotide
ggccguggaaucuuagga

SEQ ID NO: 41688 - RNA, 18 nt, Artificial Sequence
  Description of Artificial Sequence: Synthetic oligonucleotide
guaguggccguggaaucu

SEQ ID NO: 41689 - RNA, 18 nt, Artificial Sequence
  Description of Artificial Sequence: Synthetic oligonucleotide
gugugguaguggccgugg

SEQ ID NO: 41690 - RNA, 18 nt, Artificial Sequence
  Description of Artificial Sequence: Synthetic oligonucleotide
ugugggugugguaguggc

SEQ ID NO: 41691 - RNA, 18 nt, Artificial Sequence
  Description of Artificial Sequence: Synthetic oligonucleotide
guguguguggguguggua

SEQ ID NO: 41692 - RNA, 18 nt, Artificial Sequence
  Description of Artificial Sequence: Synthetic oligonucleotide
cucucgugugugugggug

SEQ ID NO: 41693 - RNA, 18 nt, Artificial Sequence
  Description of Artificial Sequence: Synthetic oligonucleotide
gacuacucucgugugugu

SEQ ID NO: 41694 - RNA, 18 nt, Artificial Sequence
  Description of Artificial Sequence: Synthetic oligonucleotide
ggcuggacuacucucgug

SEQ ID NO: 41695 - RNA, 18 nt, Artificial Sequence
  Description of Artificial Sequence: Synthetic oligonucleotide
ucaguggcuggacuacuc

SEQ ID NO: 41696 - RNA, 18 nt, Artificial Sequence
  Description of Artificial Sequence: Synthetic oligonucleotide
ugaauucaguggcuggac

SEQ ID NO: 41697 - RNA, 18 nt, Artificial Sequence
  Description of Artificial Sequence: Synthetic oligonucleotide
agauuugaauucaguggc

SEQ ID NO: 41698 - RNA, 18 nt, Artificial Sequence
  Description of Artificial Sequence: Synthetic oligonucleotide
ucacaagauuugaauuca

SEQ ID NO: 41699 - RNA, 18 nt, Artificial Sequence
  Description of Artificial Sequence: Synthetic oligonucleotide
acccaucacaagauuuga

SEQ ID NO: 41700 - RNA, 18 nt, Artificial Sequence
  Description of Artificial Sequence: Synthetic oligonucleotide
aaauaacccaucacaaga

SEQ ID NO: 41701 - RNA, 18 nt, Artificial Sequence
  Description of Artificial Sequence: Synthetic oligonucleotide
aaagcaaauaacccauca

SEQ ID NO: 41702 - RNA, 18 nt, Artificial Sequence
  Description of Artificial Sequence: Synthetic oligonucleotide
uuucuaaagcaaauaacc

SEQ ID NO: 41703 - RNA, 18 nt, Artificial Sequence
  Description of Artificial Sequence: Synthetic oligonucleotide
cuauauuucuaaagcaaa

SEQ ID NO: 41704 - RNA, 18 nt, Artificial Sequence
  Description of Artificial Sequence: Synthetic oligonucleotide
gauuucuauauuucuaaa

SEQ ID NO: 41705 - RNA, 18 nt, Artificial Sequence
  Description of Artificial Sequence: Synthetic oligonucleotide
aacaugauuucuauauuu

SEQ ID NO: 41706 - RNA, 18 nt, Artificial Sequence
  Description of Artificial Sequence: Synthetic oligonucleotide
auaucaacaugauuucua

SEQ ID NO: 41707 - RNA, 18 nt, Artificial Sequence
  Description of Artificial Sequence: Synthetic oligonucleotide
auucaauaucaacaugau

SEQ ID NO: 41708 - RNA, 18 nt, Artificial Sequence
  Description of Artificial Sequence: Synthetic oligonucleotide
auaauauucaauaucaac

SEQ ID NO: 41709 - RNA, 18 nt, Artificial Sequence
  Description of Artificial Sequence: Synthetic oligonucleotide
gauagauaauauucaaua

SEQ ID NO: 41710 - RNA, 18 nt, Artificial Sequence
  Description of Artificial Sequence: Synthetic oligonucleotide
gaauagauagauaauauu

SEQ ID NO: 41711 - RNA, 18 nt, Artificial Sequence
  Description of Artificial Sequence: Synthetic oligonucleotide
aaaaggaauagauagaua

SEQ ID NO: 41712 - RNA, 18 nt, Artificial Sequence
  Description of Artificial Sequence: Synthetic oligonucleotide
cauauaaaaggaauagau

SEQ ID NO: 41713 - RNA, 18 nt, Artificial Sequence
  Description of Artificial Sequence: Synthetic oligonucleotide
aaggacauauaaaaggaa

SEQ ID NO: 41714 - RNA, 18 nt, Artificial Sequence
  Description of Artificial Sequence: Synthetic oligonucleotide
aggacaaggacauauaaa

SEQ ID NO: 41715 - RNA, 18 nt, Artificial Sequence
  Description of Artificial Sequence: Synthetic oligonucleotide
agagcaggacaaggacau

SEQ ID NO: 41716 - RNA, 18 nt, Artificial Sequence
  Description of Artificial Sequence: Synthetic oligonucleotide
gacacagagcaggacaag

SEQ ID NO: 41717 - RNA, 18 nt, Artificial Sequence
  Description of Artificial Sequence: Synthetic oligonucleotide
caauugacacagagcagg

SEQ ID NO: 41718 - RNA, 18 nt, Artificial Sequence
  Description of Artificial Sequence: Synthetic oligonucleotide
cgcuacaauugacacaga

SEQ ID NO: 41719 - RNA, 18 nt, Artificial Sequence
  Description of Artificial Sequence: Synthetic oligonucleotide
caucucgcuacaauugac

SEQ ID NO: 41720 - RNA, 18 nt, Artificial Sequence
  Description of Artificial Sequence: Synthetic oligonucleotide
aaauacaucucgcuacaa

SEQ ID NO: 41721 - RNA, 18 nt, Artificial Sequence
  Description of Artificial Sequence: Synthetic oligonucleotide
aaaagaaauacaucucgc

SEQ ID NO: 41722 - RNA, 18 nt, Artificial Sequence
  Description of Artificial Sequence: Synthetic oligonucleotide
aacaaaaaagaaauacau

SEQ ID NO: 41723 - RNA, 18 nt, Artificial Sequence
  Description of Artificial Sequence: Synthetic oligonucleotide
acaacaacaaaaaagaaa

SEQ ID NO: 41724 - RNA, 18 nt, Artificial Sequence
  Description of Artificial Sequence: Synthetic oligonucleotide
caacaacaacaacaaaaa

SEQ ID NO: 41725 - RNA, 18 nt, Artificial Sequence
  Description of Artificial Sequence: Synthetic oligonucleotide
aucuccaacaacaacaac

SEQ ID NO: 41726 - RNA, 18 nt, Artificial Sequence
  Description of Artificial Sequence: Synthetic oligonucleotide
acuccaucuccaacaaca

SEQ ID NO: 41727 - RNA, 18 nt, Artificial Sequence
  Description of Artificial Sequence: Synthetic oligonucleotide
gugagacuccaucuccaa

SEQ ID NO: 41728 - RNA, 18 nt, Artificial Sequence
  Description of Artificial Sequence: Synthetic oligonucleotide
acagagugagacuccauc

SEQ ID NO: 41729 - RNA, 18 nt, Artificial Sequence
  Description of Artificial Sequence: Synthetic oligonucleotide
uggcgacagagugagacu

SEQ ID NO: 41730 - RNA, 18 nt, Artificial Sequence
  Description of Artificial Sequence: Synthetic oligonucleotide
cagccuggcgacagagug

SEQ ID NO: 41731 - RNA, 18 nt, Artificial Sequence
  Description of Artificial Sequence: Synthetic oligonucleotide
cacuccagccuggcgaca

SEQ ID NO: 41732 - RNA, 18 nt, Artificial Sequence
  Description of Artificial Sequence: Synthetic oligonucleotide
cacugcacuccagccugg

SEQ ID NO: 41733 - RNA, 18 nt, Artificial Sequence
  Description of Artificial Sequence: Synthetic oligonucleotide
cgugccacugcacuccag

SEQ ID NO: 41734 - RNA, 18 nt, Artificial Sequence
  Description of Artificial Sequence: Synthetic oligonucleotide
gagaucgugccacugcac

SEQ ID NO: 41735 - RNA, 18 nt, Artificial Sequence
  Description of Artificial Sequence: Synthetic oligonucleotide
gagcugagaucgugccac

SEQ ID NO: 41736 - RNA, 18 nt, Artificial Sequence
  Description of Artificial Sequence: Synthetic oligonucleotide
gcagugagcugagaucgu

SEQ ID NO: 41737 - RNA, 18 nt, Artificial Sequence
  Description of Artificial Sequence: Synthetic oligonucleotide
agguugcagugagcugag

SEQ ID NO: 41738 - RNA, 18 nt, Artificial Sequence
  Description of Artificial Sequence: Synthetic oligonucleotide
ggcggagguugcagugag

SEQ ID NO: 41739 - RNA, 18 nt, Artificial Sequence
  Description of Artificial Sequence: Synthetic oligonucleotide
ugggaggcggagguugca

SEQ ID NO: 41740 - RNA, 18 nt, Artificial Sequence
  Description of Artificial Sequence: Synthetic oligonucleotide
gaaccugggaggcggagg

SEQ ID NO: 41741 - RNA, 18 nt, Artificial Sequence
  Description of Artificial Sequence: Synthetic oligonucleotide
ugcuugaaccugggaggc

SEQ ID NO: 41742 - RNA, 18 nt, Artificial Sequence
  Description of Artificial Sequence: Synthetic oligonucleotide
agaacugcuugaaccugg

SEQ ID NO: 41743 - RNA, 18 nt, Artificial Sequence
  Description of Artificial Sequence: Synthetic oligonucleotide
gcaggagaacugcuugaa

SEQ ID NO: 41744 - RNA, 18 nt, Artificial Sequence
  Description of Artificial Sequence: Synthetic oligonucleotide
cugaggcaggagaacugc

SEQ ID NO: 41745 - RNA, 18 nt, Artificial Sequence
  Description of Artificial Sequence: Synthetic oligonucleotide
ggaggcugaggcaggaga

SEQ ID NO: 41746 - RNA, 18 nt, Artificial Sequence
  Description of Artificial Sequence: Synthetic oligonucleotide
acuugggaggcugaggca

SEQ ID NO: 41747 - RNA, 18 nt, Artificial Sequence
  Description of Artificial Sequence: Synthetic oligonucleotide
cagcuacuugggaggcug

SEQ ID NO: 41748 - RNA, 18 nt, Artificial Sequence
  Description of Artificial Sequence: Synthetic oligonucleotide
aaucccagcuacuuggga

SEQ ID NO: 41749 - RNA, 18 nt, Artificial Sequence
  Description of Artificial Sequence: Synthetic oligonucleotide
ccuguaaucccagcuacu

SEQ ID NO: 41750 - RNA, 18 nt, Artificial Sequence
  Description of Artificial Sequence: Synthetic oligonucleotide
gggcaccuguaaucccag

SEQ ID NO: 41751 - RNA, 18 nt, Artificial Sequence
  Description of Artificial Sequence: Synthetic oligonucleotide
gugacgggcaccuguaau

SEQ ID NO: 41752 - RNA, 18 nt, Artificial Sequence
  Description of Artificial Sequence: Synthetic oligonucleotide
gcguggugacgggcaccu

SEQ ID NO: 41753 - RNA, 18 nt, Artificial Sequence
  Description of Artificial Sequence: Synthetic oligonucleotide
gccaggcguggugacggg

SEQ ID NO: 41754 - RNA, 18 nt, Artificial Sequence
  Description of Artificial Sequence: Synthetic oligonucleotide
aauuagccaggcguggug

SEQ ID NO: 41755 - RNA, 18 nt, Artificial Sequence
  Description of Artificial Sequence: Synthetic oligonucleotide
acaaaaauuagccaggcg

SEQ ID NO: 41756 - RNA, 18 nt, Artificial Sequence
  Description of Artificial Sequence: Synthetic oligonucleotide
aaaauacaaaaauuagcc

SEQ ID NO: 41757 - RNA, 18 nt, Artificial Sequence
  Description of Artificial Sequence: Synthetic oligonucleotide
uauuaaaaauacaaaaau

SEQ ID NO: 41758 - RNA, 18 nt, Artificial Sequence
  Description of Artificial Sequence: Synthetic oligonucleotide
gucuguauuaaaaauaca

SEQ ID NO: 41759 - RNA, 18 nt, Artificial Sequence
  Description of Artificial Sequence: Synthetic oligonucleotide
acccugucuguauuaaaa

SEQ ID NO: 41760 - RNA, 18 nt, Artificial Sequence
  Description of Artificial Sequence: Synthetic oligonucleotide
gugaaacccugucuguau

SEQ ID NO: 41761 - RNA, 18 nt, Artificial Sequence
  Description of Artificial Sequence: Synthetic oligonucleotide
acauggugaaacccuguc

SEQ ID NO: 41762 - RNA, 18 nt, Artificial Sequence
  Description of Artificial Sequence: Synthetic oligonucleotide
ggccaacauggugaaacc

SEQ ID NO: 41763 - RNA, 18 nt, Artificial Sequence
  Description of Artificial Sequence: Synthetic oligonucleotide
auccuggccaacauggug

SEQ ID NO: 41764 - RNA, 18 nt, Artificial Sequence
  Description of Artificial Sequence: Synthetic oligonucleotide
agaccauccuggccaaca

SEQ ID NO: 41765 - RNA, 18 nt, Artificial Sequence
  Description of Artificial Sequence: Synthetic oligonucleotide
gaucaagaccauccuggc

SEQ ID NO: 41766 - RNA, 18 nt, Artificial Sequence
  Description of Artificial Sequence: Synthetic oligonucleotide
caagagaucaagaccauc

SEQ ID NO: 41767 - RNA, 18 nt, Artificial Sequence
  Description of Artificial Sequence: Synthetic oligonucleotide
gaggucaagagaucaaga

SEQ ID NO: 41768 - RNA, 18 nt, Artificial Sequence
  Description of Artificial Sequence: Synthetic oligonucleotide
aucacgaggucaagagau

SEQ ID NO: 41769 - RNA, 18 nt, Artificial Sequence
  Description of Artificial Sequence: Synthetic oligonucleotide
ggaggaucacgaggucaa

SEQ ID NO: 41770 - RNA, 18 nt, Artificial Sequence
  Description of Artificial Sequence: Synthetic oligonucleotide
aggugggaggaucacgag

SEQ ID NO: 41771 - RNA, 18 nt, Artificial Sequence
  Description of Artificial Sequence: Synthetic oligonucleotide
ggccgaggugggaggauc

SEQ ID NO: 41772 - RNA, 18 nt, Artificial Sequence
  Description of Artificial Sequence: Synthetic oligonucleotide
ugggaggccgagguggga

SEQ ID NO: 41773 - RNA, 18 nt, Artificial Sequence
  Description of Artificial Sequence: Synthetic oligonucleotide
cacucugggaggccgagg

SEQ ID NO: 41774 - RNA, 18 nt, Artificial Sequence
  Description of Artificial Sequence: Synthetic oligonucleotide
cccagcacucugggaggc

SEQ ID NO: 41775 - RNA, 18 nt, Artificial Sequence
  Description of Artificial Sequence: Synthetic oligonucleotide
guaaucccagcacucugg

SEQ ID NO: 41776 - RNA, 18 nt, Artificial Sequence
  Description of Artificial Sequence: Synthetic oligonucleotide
uaucuguaaucccagcac

SEQ ID NO: 41777 - RNA, 18 nt, Artificial Sequence
  Description of Artificial Sequence: Synthetic oligonucleotide
gcucauaucuguaauccc

SEQ ID NO: 41778 - RNA, 18 nt, Artificial Sequence
  Description of Artificial Sequence: Synthetic oligonucleotide
caguggcucauaucugua

SEQ ID NO: 41779 - RNA, 18 nt, Artificial Sequence
  Description of Artificial Sequence: Synthetic oligonucleotide
gggcgcaguggcucauau

SEQ ID NO: 41780 - RNA, 18 nt, Artificial Sequence
  Description of Artificial Sequence: Synthetic oligonucleotide
cagcugggcgcaguggcu

SEQ ID NO: 41781 - RNA, 18 nt, Artificial Sequence
  Description of Artificial Sequence: Synthetic oligonucleotide
ucuugcagcugggcgcag

SEQ ID NO: 41782 - RNA, 18 nt, Artificial Sequence
  Description of Artificial Sequence: Synthetic oligonucleotide
auacaucuugcagcuggg

SEQ ID NO: 41783 - RNA, 18 nt, Artificial Sequence
  Description of Artificial Sequence: Synthetic oligonucleotide
uagaaauacaucuugcag

SEQ ID NO: 41784 - RNA, 18 nt, Artificial Sequence
  Description of Artificial Sequence: Synthetic oligonucleotide
acugauagaaauacaucu

SEQ ID NO: 41785 - RNA, 18 nt, Artificial Sequence
  Description of Artificial Sequence: Synthetic oligonucleotide
agaauacugauagaaaua

SEQ ID NO: 41786 - RNA, 18 nt, Artificial Sequence
  Description of Artificial Sequence: Synthetic oligonucleotide
uucguuuuagucaacagg

SEQ ID NO: 41787 - RNA, 18 nt, Artificial Sequence
  Description of Artificial Sequence: Synthetic oligonucleotide
uugaauucguuuuaguca

SEQ ID NO: 41788 - RNA, 18 nt, Artificial Sequence
  Description of Artificial Sequence: Synthetic oligonucleotide
ggcuguugaauucguuuu

SEQ ID NO: 41789 - RNA, 18 nt, Artificial Sequence
  Description of Artificial Sequence: Synthetic oligonucleotide
cuacuggcuguugaauuc

SEQ ID NO: 41790 - RNA, 18 nt, Artificial Sequence
  Description of Artificial Sequence: Synthetic oligonucleotide
cccugcuacuggcuguug

SEQ ID NO: 41791 - RNA, 18 nt, Artificial Sequence
  Description of Artificial Sequence: Synthetic oligonucleotide
uauuucccugcuacuggc

SEQ ID NO: 41792 - RNA, 18 nt, Artificial Sequence
  Description of Artificial Sequence: Synthetic oligonucleotide
gaccauauuucccugcua

SEQ ID NO: 41793 - RNA, 18 nt, Artificial Sequence
  Description of Artificial Sequence: Synthetic oligonucleotide
ugaaagaccauauuuccc

SEQ ID NO: 41794 - RNA, 18 nt, Artificial Sequence
  Description of Artificial Sequence: Synthetic oligonucleotide
ugccuugaaagaccauau

SEQ ID NO: 41795 - RNA, 18 nt, Artificial Sequence
  Description of Artificial Sequence: Synthetic oligonucleotide
ucugaugccuugaaagac

SEQ ID NO: 41796 - RNA, 18 nt, Artificial Sequence
  Description of Artificial Sequence: Synthetic oligonucleotide
gaguuucugaugccuuga

SEQ ID NO: 41797 - RNA, 18 nt, Artificial Sequence
  Description of Artificial Sequence: Synthetic oligonucleotide
uaaaugaguuucugaugc

SEQ ID NO: 41798 - RNA, 18 nt, Artificial Sequence
  Description of Artificial Sequence: Synthetic oligonucleotide
uuuuguaaaugaguuucu

SEQ ID NO: 41799 - RNA, 18 nt, Artificial Sequence
  Description of Artificial Sequence: Synthetic oligonucleotide
auaauuuuuguaaaugag

SEQ ID NO: 41800 - RNA, 18 nt, Artificial Sequence
  Description of Artificial Sequence: Synthetic oligonucleotide
gcucuauaauuuuuguaa

SEQ ID NO: 41801 - RNA, 18 nt, Artificial Sequence
  Description of Artificial Sequence: Synthetic oligonucleotide
uggcagcucuauaauuuu

SEQ ID NO: 41802 - RNA, 18 nt, Artificial Sequence
  Description of Artificial Sequence: Synthetic oligonucleotide
uuuccuggcagcucuaua

SEQ ID NO: 41803 - RNA, 18 nt, Artificial Sequence
  Description of Artificial Sequence: Synthetic oligonucleotide
gccuuuuuccuggcagcu

SEQ ID NO: 41804 - RNA, 18 nt, Artificial Sequence
  Description of Artificial Sequence: Synthetic oligonucleotide
gugcagccuuuuuccugg

SEQ ID NO: 41805 - RNA, 18 nt, Artificial Sequence
  Description of Artificial Sequence: Synthetic oligonucleotide
uuguugugcagccuuuuu

SEQ ID NO: 41806 - RNA, 18 nt, Artificial Sequence
  Description of Artificial Sequence: Synthetic oligonucleotide
uauuuuuguugugcagcc

SEQ ID NO: 41807 - RNA, 18 nt, Artificial Sequence
  Description of Artificial Sequence: Synthetic oligonucleotide
ucaacuauuuuuguugug

SEQ ID NO: 41808 - RNA, 18 nt, Artificial Sequence
  Description of Artificial Sequence: Synthetic oligonucleotide
uuuacucaacuauuuuug

SEQ ID NO: 41809 - RNA, 18 nt, Artificial Sequence
  Description of Artificial Sequence: Synthetic oligonucleotide
ucuaguuuacucaacuau

SEQ ID NO: 41810 - RNA, 18 nt, Artificial Sequence
  Description of Artificial Sequence: Synthetic oligonucleotide
auguuucuaguuuacuca

SEQ ID NO: 41811 - RNA, 18 nt, Artificial Sequence
  Description of Artificial Sequence: Synthetic oligonucleotide
aguguauguuucuaguuu

SEQ ID NO: 41812 - RNA, 18 nt, Artificial Sequence
  Description of Artificial Sequence: Synthetic oligonucleotide
uucccaguguauguuucu

SEQ ID NO: 41813 - RNA, 18 nt, Artificial Sequence
  Description of Artificial Sequence: Synthetic oligonucleotide
cucucuucccaguguaug

SEQ ID NO: 41814 - RNA, 18 nt, Artificial Sequence
  Description of Artificial Sequence: Synthetic oligonucleotide
ccauacucucuucccagu

SEQ ID NO: 41815 - RNA, 18 nt, Artificial Sequence
  Description of Artificial Sequence: Synthetic oligonucleotide
ugcccccauacucucuuc

SEQ ID NO: 41816 - RNA, 18 nt, Artificial Sequence
  Description of Artificial Sequence: Synthetic oligonucleotide
caacuugcccccauacuc

SEQ ID NO: 41817 - RNA, 18 nt, Artificial Sequence
  Description of Artificial Sequence: Synthetic oligonucleotide
gcuaacaacuugccccca

SEQ ID NO: 41818 - RNA, 18 nt, Artificial Sequence
  Description of Artificial Sequence: Synthetic oligonucleotide
auccagcuaacaacuugc

SEQ ID NO: 41819 - RNA, 18 nt, Artificial Sequence
  Description of Artificial Sequence: Synthetic oligonucleotide
uaucuauccagcuaacaa

SEQ ID NO: 41820 - RNA, 18 nt, Artificial Sequence
  Description of Artificial Sequence: Synthetic oligonucleotide
aguccuaucuauccagcu

SEQ ID NO: 41821 - RNA, 18 nt, Artificial Sequence
  Description of Artificial Sequence: Synthetic oligonucleotide
agcacaguccuaucuauc

SEQ ID NO: 41822 - RNA, 18 nt, Artificial Sequence
  Description of Artificial Sequence: Synthetic oligonucleotide
gucaaagcacaguccuau

SEQ ID NO: 41823 - RNA, 18 nt, Artificial Sequence
  Description of Artificial Sequence: Synthetic oligonucleotide
gaggugucaaagcacagu

SEQ ID NO: 41824 - RNA, 18 nt, Artificial Sequence
  Description of Artificial Sequence: Synthetic oligonucleotide
ccacagaggugucaaagc

SEQ ID NO: 41825 - RNA, 18 nt, Artificial Sequence
  Description of Artificial Sequence: Synthetic oligonucleotide
auagaccacagagguguc

SEQ ID NO: 41826 - RNA, 18 nt, Artificial Sequence
  Description of Artificial Sequence: Synthetic oligonucleotide
agaucauagaccacagag

SEQ ID NO: 41827 - RNA, 18 nt, Artificial Sequence
  Description of Artificial Sequence: Synthetic oligonucleotide
uucagagaucauagacca

SEQ ID NO: 41828 - RNA, 18 nt, Artificial Sequence
  Description of Artificial Sequence: Synthetic oligonucleotide
ccagguucagagaucaua

SEQ ID NO: 41829 - RNA, 18 nt, Artificial Sequence
  Description of Artificial Sequence: Synthetic oligonucleotide
cuauuccagguucagaga

SEQ ID NO: 41830 - RNA, 18 nt, Artificial Sequence
  Description of Artificial Sequence: Synthetic oligonucleotide
gaacccuauuccagguuc

SEQ ID NO: 41831 - RNA, 18 nt, Artificial Sequence
  Description of Artificial Sequence: Synthetic oligonucleotide
aaaaugaacccuauucca

SEQ ID NO: 41832 - RNA, 18 nt, Artificial Sequence
  Description of Artificial Sequence: Synthetic oligonucleotide
cuauuaaaaugaacccua

SEQ ID NO: 41833 - RNA, 18 nt, Artificial Sequence
  Description of Artificial Sequence: Synthetic oligonucleotide
uaucgcuauuaaaaugaa

SEQ ID NO: 41834 - RNA, 18 nt, Artificial Sequence
  Description of Artificial Sequence: Synthetic oligonucleotide
gacuuuaucgcuauuaaa

SEQ ID NO: 41835 - RNA, 18 nt, Artificial Sequence
  Description of Artificial Sequence: Synthetic oligonucleotide
auaaugacuuuaucgcua

SEQ ID NO: 41836 - RNA, 18 nt, Artificial Sequence
  Description of Artificial Sequence: Synthetic oligonucleotide
cugggauaaugacuuuau

SEQ ID NO: 41837 - RNA, 18 nt, Artificial Sequence
  Description of Artificial Sequence: Synthetic oligonucleotide
augcacugggauaaugac

SEQ ID NO: 41838 - RNA, 18 nt, Artificial Sequence
  Description of Artificial Sequence: Synthetic oligonucleotide
uuuggaugcacugggaua

SEQ ID NO: 41839 - RNA, 18 nt, Artificial Sequence
  Description of Artificial Sequence: Synthetic oligonucleotide
aucaauuuggaugcacug

SEQ ID NO: 41840 - RNA, 18 nt, Artificial Sequence
  Description of Artificial Sequence: Synthetic oligonucleotide
aacuaaucaauuuggaug

SEQ ID NO: 41841 - RNA, 18 nt, Artificial Sequence
  Description of Artificial Sequence: Synthetic oligonucleotide
gcaugaacuaaucaauuu

SEQ ID NO: 41842 - RNA, 18 nt, Artificial Sequence
  Description of Artificial Sequence: Synthetic oligonucleotide
auaaagcaugaacuaauc

SEQ ID NO: 41843 - RNA, 18 nt, Artificial Sequence
  Description of Artificial Sequence: Synthetic oligonucleotide
uccuaauaaagcaugaac

SEQ ID NO: 41844 - RNA, 18 nt, Artificial Sequence
  Description of Artificial Sequence: Synthetic oligonucleotide
cuguuuccuaauaaagca

SEQ ID NO: 41845 - RNA, 18 nt, Artificial Sequence
  Description of Artificial Sequence: Synthetic oligonucleotide
aacuucuguuuccuaaua

SEQ ID NO: 41846 - RNA, 18 nt, Artificial Sequence
  Description of Artificial Sequence: Synthetic oligonucleotide
uggguaacuucuguuucc

SEQ ID NO: 41847 - RNA, 18 nt, Artificial Sequence
  Description of Artificial Sequence: Synthetic oligonucleotide
aguuuuggguaacuucug

SEQ ID NO: 41848 - RNA, 18 nt, Artificial Sequence
  Description of Artificial Sequence: Synthetic oligonucleotide
ugcuaaguuuuggguaac

SEQ ID NO: 41849 - RNA, 18 nt, Artificial Sequence
  Description of Artificial Sequence: Synthetic oligonucleotide
agguuugcuaaguuuugg

SEQ ID NO: 41850 - RNA, 18 nt, Artificial Sequence
  Description of Artificial Sequence: Synthetic oligonucleotide
uacuuagguuugcuaagu

SEQ ID NO: 41851 - RNA, 18 nt, Artificial Sequence
  Description of Artificial Sequence: Synthetic oligonucleotide
cuugguacuuagguuugc

SEQ ID NO: 41852 - RNA, 18 nt, Artificial Sequence
  Description of Artificial Sequence: Synthetic oligonucleotide
ggauacuugguacuuagg

SEQ ID NO: 41853 - RNA, 18 nt, Artificial Sequence
  Description of Artificial Sequence: Synthetic oligonucleotide
guuuuggauacuugguac

SEQ ID NO: 41854 - RNA, 18 nt, Artificial Sequence
  Description of Artificial Sequence: Synthetic oligonucleotide
agaauguuuuggauacuu

SEQ ID NO: 41855 - RNA, 18 nt, Artificial Sequence
  Description of Artificial Sequence: Synthetic oligonucleotide
ggaaaagaauguuuugga

SEQ ID NO: 41856 - RNA, 18 nt, Artificial Sequence
  Description of Artificial Sequence: Synthetic oligonucleotide
guguaggaaaagaauguu

SEQ ID NO: 41857 - RNA, 18 nt, Artificial Sequence
  Description of Artificial Sequence: Synthetic oligonucleotide
acauuguguaggaaaaga

SEQ ID NO: 41858 - RNA, 18 nt, Artificial Sequence
  Description of Artificial Sequence: Synthetic oligonucleotide
cccaaacauuguguagga

SEQ ID NO: 41859 - RNA, 18 nt, Artificial Sequence
  Description of Artificial Sequence: Synthetic oligonucleotide
aauaccccaaacauugug

SEQ ID NO: 41860 - RNA, 18 nt, Artificial Sequence
  Description of Artificial Sequence: Synthetic oligonucleotide
uugacaauaccccaaaca

SEQ ID NO: 41861 - RNA, 18 nt, Artificial Sequence
  Description of Artificial Sequence: Synthetic oligonucleotide
caacuuugacaauacccc

SEQ ID NO: 41862 - RNA, 18 nt, Artificial Sequence
  Description of Artificial Sequence: Synthetic oligonucleotide
caauccaacuuugacaau

SEQ ID NO: 41863 - RNA, 18 nt, Artificial Sequence
  Description of Artificial Sequence: Synthetic oligonucleotide
ugaaucaauccaacuuug

SEQ ID NO: 41864 - RNA, 18 nt, Artificial Sequence
  Description of Artificial Sequence: Synthetic oligonucleotide
gcuggugaaucaauccaa

SEQ ID NO: 41865 - RNA, 18 nt, Artificial Sequence
  Description of Artificial Sequence: Synthetic oligonucleotide
gacuggcuggugaaucaa

SEQ ID NO: 41866 - RNA, 18 nt, Artificial Sequence
  Description of Artificial Sequence: Synthetic oligonucleotide
auuaagacuggcugguga

SEQ ID NO: 41867 - RNA, 18 nt, Artificial Sequence
  Description of Artificial Sequence: Synthetic oligonucleotide
agccaauuaagacuggcu

SEQ ID NO: 41868 - RNA, 18 nt, Artificial Sequence
  Description of Artificial Sequence: Synthetic oligonucleotide
uuaguagccaauuaagac

SEQ ID NO: 41869 - RNA, 18 nt, Artificial Sequence
  Description of Artificial Sequence: Synthetic oligonucleotide
aaccauuaguagccaauu

SEQ ID NO: 41870 - RNA, 18 nt, Artificial Sequence
  Description of Artificial Sequence: Synthetic oligonucleotide
ggcugaaccauuaguagc

SEQ ID NO: 41871 - RNA, 18 nt, Artificial Sequence
  Description of Artificial Sequence: Synthetic oligonucleotide
aaacaggcugaaccauua

SEQ ID NO: 41872 - RNA, 18 nt, Artificial Sequence
  Description of Artificial Sequence: Synthetic oligonucleotide
ggagaaaacaggcugaac

SEQ ID NO: 41873 - RNA, 18 nt, Artificial Sequence
  Description of Artificial Sequence: Synthetic oligonucleotide
cuuuaggagaaaacaggc

SEQ ID NO: 41874 - RNA, 18 nt, Artificial Sequence
  Description of Artificial Sequence: Synthetic oligonucleotide
aaccucuuuaggagaaaa

SEQ ID NO: 41875 - RNA, 18 nt, Artificial Sequence
  Description of Artificial Sequence: Synthetic oligonucleotide
aaacaaaccucuuuagga

SEQ ID NO: 41876 - RNA, 18 nt, Artificial Sequence
  Description of Artificial Sequence: Synthetic oligonucleotide
acauuaaacaaaccucuu

SEQ ID NO: 41877 - RNA, 18 nt, Artificial Sequence
  Description of Artificial Sequence: Synthetic oligonucleotide
aucugacauuaaacaaac

SEQ ID NO: 41878 - RNA, 18 nt, Artificial Sequence
  Description of Artificial Sequence: Synthetic oligonucleotide
uuaucaucugacauuaaa

SEQ ID NO: 41879 - RNA, 18 nt, Artificial Sequence
  Description of Artificial Sequence: Synthetic oligonucleotide
uacaauuaucaucugaca

SEQ ID NO: 41880 - RNA, 18 nt, Artificial Sequence
  Description of Artificial Sequence: Synthetic oligonucleotide
aucuguacaauuaucauc

SEQ ID NO: 41881 - RNA, 18 nt, Artificial Sequence
  Description of Artificial Sequence: Synthetic oligonucleotide
aacauaucuguacaauua

SEQ ID NO: 41882 - RNA, 18 nt, Artificial Sequence
  Description of Artificial Sequence: Synthetic oligonucleotide
ucccaaacauaucuguac

SEQ ID NO: 41883 - RNA, 18 nt, Artificial Sequence
  Description of Artificial Sequence: Synthetic oligonucleotide
cuuccacuucgcuuccaa

SEQ ID NO: 41884 - RNA, 18 nt, Artificial Sequence
  Description of Artificial Sequence: Synthetic oligonucleotide
cagugcuuccacuucgcu

SEQ ID NO: 41885 - RNA, 18 nt, Artificial Sequence
  Description of Artificial Sequence: Synthetic oligonucleotide
agguucagugcuuccacu

SEQ ID NO: 41886 - RNA, 18 nt, Artificial Sequence
  Description of Artificial Sequence: Synthetic oligonucleotide
ccuggagguucagugcuu

SEQ ID NO: 41887 - RNA, 18 nt, Artificial Sequence
  Description of Artificial Sequence: Synthetic oligonucleotide
ugucaccuggagguucag

SEQ ID NO: 41888 - RNA, 18 nt, Artificial Sequence
  Description of Artificial Sequence: Synthetic oligonucleotide
agagaugucaccuggagg

SEQ ID NO: 41889 - RNA, 18 nt, Artificial Sequence
  Description of Artificial Sequence: Synthetic oligonucleotide
uaaacagagaugucaccu

SEQ ID NO: 41890 - RNA, 18 nt, Artificial Sequence
  Description of Artificial Sequence: Synthetic oligonucleotide
cuccuuaaacagagaugu

SEQ ID NO: 41891 - RNA, 18 nt, Artificial Sequence
  Description of Artificial Sequence: Synthetic oligonucleotide
ugaagcuccuuaaacaga

SEQ ID NO: 41892 - RNA, 18 nt, Artificial Sequence
  Description of Artificial Sequence: Synthetic oligonucleotide
ccucuugaagcuccuuaa

SEQ ID NO: 41893 - RNA, 18 nt, Artificial Sequence
  Description of Artificial Sequence: Synthetic oligonucleotide
augagccucuugaagcuc

SEQ ID NO: 41894 - RNA, 18 nt, Artificial Sequence
  Description of Artificial Sequence: Synthetic oligonucleotide
uuuguaugagccucuuga

SEQ ID NO: 41895 - RNA, 18 nt, Artificial Sequence
  Description of Artificial Sequence: Synthetic oligonucleotide
ugaguuuuguaugagccu

SEQ ID NO: 41896 - RNA, 18 nt, Artificial Sequence
  Description of Artificial Sequence: Synthetic oligonucleotide
uuugcugaguuuuguaug

SEQ ID NO: 41897 - RNA, 18 nt, Artificial Sequence
  Description of Artificial Sequence: Synthetic oligonucleotide
ucagcuuugcugaguuuu

SEQ ID NO: 41898 - RNA, 18 nt, Artificial Sequence
  Description of Artificial Sequence: Synthetic oligonucleotide
uuagcucagcuuugcuga

SEQ ID NO: 41899 - RNA, 18 nt, Artificial Sequence
  Description of Artificial Sequence: Synthetic oligonucleotide
cuucauuagcucagcuuu

SEQ ID NO: 41900 - RNA, 18 nt, Artificial Sequence
  Description of Artificial Sequence: Synthetic oligonucleotide
cucuucuucauuagcuca

SEQ ID NO: 41901 - RNA, 18 nt, Artificial Sequence
  Description of Artificial Sequence: Synthetic oligonucleotide
gaagucucuucuucauua

SEQ ID NO: 41902 - RNA, 18 nt, Artificial Sequence
  Description of Artificial Sequence: Synthetic oligonucleotide
uucuugaagucucuucuu

SEQ ID NO: 41903 - RNA, 18 nt, Artificial Sequence
  Description of Artificial Sequence: Synthetic oligonucleotide
ucuuuucaaaaucugaaa

SEQ ID NO: 41904 - RNA, 18 nt, Artificial Sequence
  Description of Artificial Sequence: Synthetic oligonucleotide
uguuuucuuuucaaaauc

SEQ ID NO: 41905 - RNA, 18 nt, Artificial Sequence
  Description of Artificial Sequence: Synthetic oligonucleotide
uuacuuguuuucuuuuca

SEQ ID NO: 41906 - RNA, 18 nt, Artificial Sequence
  Description of Artificial Sequence: Synthetic oligonucleotide
aacgauuacuuguuuucu

SEQ ID NO: 41907 - RNA, 18 nt, Artificial Sequence
  Description of Artificial Sequence: Synthetic oligonucleotide
cucagaacgauuacuugu

SEQ ID NO: 41908 - RNA, 18 nt, Artificial Sequence
  Description of Artificial Sequence: Synthetic oligonucleotide
ucaaucucagaacgauua

SEQ ID NO: 41909 - RNA, 18 nt, Artificial Sequence
  Description of Artificial Sequence: Synthetic oligonucleotide
ggguuucaaucucagaac

SEQ ID NO: 41910 - RNA, 18 nt, Artificial Sequence
  Description of Artificial Sequence: Synthetic oligonucleotide
ugucuggguuucaaucuc

SEQ ID NO: 41911 - RNA, 18 nt, Artificial Sequence
  Description of Artificial Sequence: Synthetic oligonucleotide
cccucugucuggguuuca

SEQ ID NO: 41912 - RNA, 18 nt, Artificial Sequence
  Description of Artificial Sequence: Synthetic oligonucleotide
ugcuccccucugucuggg

SEQ ID NO: 41913 - RNA, 18 nt, Artificial Sequence
  Description of Artificial Sequence: Synthetic oligonucleotide
cucugugcuccccucugu

SEQ ID NO: 41914 - RNA, 18 nt, Artificial Sequence
  Description of Artificial Sequence: Synthetic oligonucleotide
ucuuucucugugcucccc

SEQ ID NO: 41915 - RNA, 18 nt, Artificial Sequence
  Description of Artificial Sequence: Synthetic oligonucleotide
cauucucuuucucugugc

SEQ ID NO: 41916 - RNA, 18 nt, Artificial Sequence
  Description of Artificial Sequence: Synthetic oligonucleotide
uucaucauucucuuucuc

SEQ ID NO: 41917 - RNA, 18 nt, Artificial Sequence
  Description of Artificial Sequence: Synthetic oligonucleotide
uucucuucaucauucucu

SEQ ID NO: 41918 - RNA, 18 nt, Artificial Sequence
  Description of Artificial Sequence: Synthetic oligonucleotide
ggccuuucucuucaucau

SEQ ID NO: 41919 - RNA, 18 nt, Artificial Sequence
  Description of Artificial Sequence: Synthetic oligonucleotide
cuccgggccuuucucuuc

SEQ ID NO: 41920 - RNA, 18 nt, Artificial Sequence
  Description of Artificial Sequence: Synthetic oligonucleotide
ggccguggaaucuuagga

SEQ ID NO: 41921 - RNA, 18 nt, Artificial Sequence
  Description of Artificial Sequence: Synthetic oligonucleotide
guaguggccguggaaucu

SEQ ID NO: 41922 - RNA, 18 nt, Artificial Sequence
  Description of Artificial Sequence: Synthetic oligonucleotide
gugugguaguggccgugg

SEQ ID NO: 41923 - RNA, 18 nt, Artificial Sequence
  Description of Artificial Sequence: Synthetic oligonucleotide
ugugggugugguaguggc

SEQ ID NO: 41924 - RNA, 18 nt, Artificial Sequence
  Description of Artificial Sequence: Synthetic oligonucleotide
guguguguggguguggua

SEQ ID NO: 41925 - RNA, 18 nt, Artificial Sequence
  Description of Artificial Sequence: Synthetic oligonucleotide
cucucgugugugugggug

SEQ ID NO: 41926 - RNA, 18 nt, Artificial Sequence
  Description of Artificial Sequence: Synthetic oligonucleotide
gacuacucucgugugugu

SEQ ID NO: 41927 - RNA, 18 nt, Artificial Sequence
  Description of Artificial Sequence: Synthetic oligonucleotide
ggcuggacuacucucgug

SEQ ID NO: 41928 - RNA, 18 nt, Artificial Sequence
  Description of Artificial Sequence: Synthetic oligonucleotide
ucaguggcuggacuacuc

SEQ ID NO: 41929 - RNA, 18 nt, Artificial Sequence
  Description of Artificial Sequence: Synthetic oligonucleotide
ugaauucaguggcuggac

SEQ ID NO: 41930 - RNA, 18 nt, Artificial Sequence
  Description of Artificial Sequence: Synthetic oligonucleotide
agauuugaauucaguggc

SEQ ID NO: 41931 - RNA, 18 nt, Artificial Sequence
  Description of Artificial Sequence: Synthetic oligonucleotide
ucacaagauuugaauuca

SEQ ID NO: 41932 - RNA, 18 nt, Artificial Sequence
  Description of Artificial Sequence: Synthetic oligonucleotide
acccaucacaagauuuga

SEQ ID NO: 41933 - RNA, 18 nt, Artificial Sequence
  Description of Artificial Sequence: Synthetic oligonucleotide
aaauaacccaucacaaga

SEQ ID NO: 41934 - RNA, 18 nt, Artificial Sequence
  Description of Artificial Sequence: Synthetic oligonucleotide
aaagcaaauaacccauca

SEQ ID NO: 41935 - RNA, 18 nt, Artificial Sequence
  Description of Artificial Sequence: Synthetic oligonucleotide
uuucuaaagcaaauaacc

SEQ ID NO: 41936 - RNA, 18 nt, Artificial Sequence
  Description of Artificial Sequence: Synthetic oligonucleotide
cuauauuucuaaagcaaa

SEQ ID NO: 41937 - RNA, 18 nt, Artificial Sequence
  Description of Artificial Sequence: Synthetic oligonucleotide
gauuucuauauuucuaaa

SEQ ID NO: 41938 - RNA, 18 nt, Artificial Sequence
  Description of Artificial Sequence: Synthetic oligonucleotide
aacaugauuucuauauuu

SEQ ID NO: 41939 - RNA, 18 nt, Artificial Sequence
  Description of Artificial Sequence: Synthetic oligonucleotide
auaucaacaugauuucua

SEQ ID NO: 41940 - RNA, 18 nt, Artificial Sequence
  Description of Artificial Sequence: Synthetic oligonucleotide
auucaauaucaacaugau

SEQ ID NO: 41941 - RNA, 18 nt, Artificial Sequence
  Description of Artificial Sequence: Synthetic oligonucleotide
auaauauucaauaucaac

SEQ ID NO: 41942 - RNA, 18 nt, Artificial Sequence
  Description of Artificial Sequence: Synthetic oligonucleotide
gauagauaauauucaaua

SEQ ID NO: 41943 - RNA, 18 nt, Artificial Sequence
  Description of Artificial Sequence: Synthetic oligonucleotide
gaauagauagauaauauu

SEQ ID NO: 41944 - RNA, 18 nt, Artificial Sequence
  Description of Artificial Sequence: Synthetic oligonucleotide
aaaaggaauagauagaua

SEQ ID NO: 41945 - RNA, 18 nt, Artificial Sequence
  Description of Artificial Sequence: Synthetic oligonucleotide
cauauaaaaggaauagau

SEQ ID NO: 41946 - RNA, 18 nt, Artificial Sequence
  Description of Artificial Sequence: Synthetic oligonucleotide
aaggacauauaaaaggaa

SEQ ID NO: 41947 - RNA, 18 nt, Artificial Sequence
  Description of Artificial Sequence: Synthetic oligonucleotide
aggacaaggacauauaaa

SEQ ID NO: 41948 - RNA, 18 nt, Artificial Sequence
  Description of Artificial Sequence: Synthetic oligonucleotide
agagcaggacaaggacau

SEQ ID NO: 41949 - RNA, 18 nt, Artificial Sequence
  Description of Artificial Sequence: Synthetic oligonucleotide
gacacagagcaggacaag

SEQ ID NO: 41950 - RNA, 18 nt, Artificial Sequence
  Description of Artificial Sequence: Synthetic oligonucleotide
caauugacacagagcagg

SEQ ID NO: 41951 - RNA, 18 nt, Artificial Sequence
  Description of Artificial Sequence: Synthetic oligonucleotide
cgcuacaauugacacaga

SEQ ID NO: 41952 - RNA, 18 nt, Artificial Sequence
  Description of Artificial Sequence: Synthetic oligonucleotide
caucucgcuacaauugac

SEQ ID NO: 41953 - RNA, 18 nt, Artificial Sequence
  Description of Artificial Sequence: Synthetic oligonucleotide
aaauacaucucgcuacaa

SEQ ID NO: 41954 - RNA, 18 nt, Artificial Sequence
  Description of Artificial Sequence: Synthetic oligonucleotide
aaaagaaauacaucucgc

SEQ ID NO: 41955 - RNA, 18 nt, Artificial Sequence
  Description of Artificial Sequence: Synthetic oligonucleotide
aacaaaaaagaaauacau

SEQ ID NO: 41956 - RNA, 18 nt, Artificial Sequence
  Description of Artificial Sequence: Synthetic oligonucleotide
acaacaacaaaaaagaaa

SEQ ID NO: 41957 - RNA, 18 nt, Artificial Sequence
  Description of Artificial Sequence: Synthetic oligonucleotide
caacaacaacaacaaaaa

SEQ ID NO: 41958 - RNA, 18 nt, Artificial Sequence
  Description of Artificial Sequence: Synthetic oligonucleotide
aucuccaacaacaacaac

SEQ ID NO: 41959 - RNA, 18 nt, Artificial Sequence
  Description of Artificial Sequence: Synthetic oligonucleotide
acuccaucuccaacaaca

SEQ ID NO: 41960 - RNA, 18 nt, Artificial Sequence
  Description of Artificial Sequence: Synthetic oligonucleotide
gugagacuccaucuccaa

SEQ ID NO: 41961 - RNA, 18 nt, Artificial Sequence
  Description of Artificial Sequence: Synthetic oligonucleotide
acagagugagacuccauc

SEQ ID NO: 41962 - RNA, 18 nt, Artificial Sequence
  Description of Artificial Sequence: Synthetic oligonucleotide
uggcgacagagugagacu

SEQ ID NO: 41963 - RNA, 18 nt, Artificial Sequence
  Description of Artificial Sequence: Synthetic oligonucleotide
cagccuggcgacagagug

SEQ ID NO: 41964 - RNA, 18 nt, Artificial Sequence
  Description of Artificial Sequence: Synthetic oligonucleotide
cacuccagccuggcgaca

SEQ ID NO: 41965 - RNA, 18 nt, Artificial Sequence
  Description of Artificial Sequence: Synthetic oligonucleotide
cacugcacuccagccugg

SEQ ID NO: 41966 - RNA, 18 nt, Artificial Sequence
  Description of Artificial Sequence: Synthetic oligonucleotide
cgugccacugcacuccag

SEQ ID NO: 41967 - RNA, 18 nt, Artificial Sequence
  Description of Artificial Sequence: Synthetic oligonucleotide
gagaucgugccacugcac

SEQ ID NO: 41968 - RNA, 18 nt, Artificial Sequence
  Description of Artificial Sequence: Synthetic oligonucleotide
gagcugagaucgugccac

SEQ ID NO: 41969 - RNA, 18 nt, Artificial Sequence
  Description of Artificial Sequence: Synthetic oligonucleotide
gcagugagcugagaucgu

SEQ ID NO: 41970 - RNA, 18 nt, Artificial Sequence
  Description of Artificial Sequence: Synthetic oligonucleotide
agguugcagugagcugag

SEQ ID NO: 41971 - RNA, 18 nt, Artificial Sequence
  Description of Artificial Sequence: Synthetic oligonucleotide
ggcggagguugcagugag

SEQ ID NO: 41972 - RNA, 18 nt, Artificial Sequence
  Description of Artificial Sequence: Synthetic oligonucleotide
ugggaggcggagguugca

SEQ ID NO: 41973 - RNA, 18 nt, Artificial Sequence
  Description of Artificial Sequence: Synthetic oligonucleotide
gaaccugggaggcggagg

SEQ ID NO: 41974 - RNA, 18 nt, Artificial Sequence
  Description of Artificial Sequence: Synthetic oligonucleotide
ugcuugaaccugggaggc

SEQ ID NO: 41975 - RNA, 18 nt, Artificial Sequence
  Description of Artificial Sequence: Synthetic oligonucleotide
agaacugcuugaaccugg

SEQ ID NO: 41976 - RNA, 18 nt, Artificial Sequence
  Description of Artificial Sequence: Synthetic oligonucleotide
gcaggagaacugcuugaa

SEQ ID NO: 41977 - RNA, 18 nt, Artificial Sequence
  Description of Artificial Sequence: Synthetic oligonucleotide
cugaggcaggagaacugc

SEQ ID NO: 41978 - RNA, 18 nt, Artificial Sequence
  Description of Artificial Sequence: Synthetic oligonucleotide
ggaggcugaggcaggaga

SEQ ID NO: 41979 - RNA, 18 nt, Artificial Sequence
  Description of Artificial Sequence: Synthetic oligonucleotide
acuugggaggcugaggca

SEQ ID NO: 41980 - RNA, 18 nt, Artificial Sequence
  Description of Artificial Sequence: Synthetic oligonucleotide
cagcuacuugggaggcug

SEQ ID NO: 41981 - RNA, 18 nt, Artificial Sequence
  Description of Artificial Sequence: Synthetic oligonucleotide
aaucccagcuacuuggga

SEQ ID NO: 41982 - RNA, 18 nt, Artificial Sequence
  Description of Artificial Sequence: Synthetic oligonucleotide
ccuguaaucccagcuacu

SEQ ID NO: 41983 - RNA, 18 nt, Artificial Sequence
  Description of Artificial Sequence: Synthetic oligonucleotide
gggcaccuguaaucccag

SEQ ID NO: 41984 - RNA, 18 nt, Artificial Sequence
  Description of Artificial Sequence: Synthetic oligonucleotide
gugacgggcaccuguaau

SEQ ID NO: 41985 - RNA, 18 nt, Artificial Sequence
  Description of Artificial Sequence: Synthetic oligonucleotide
gcguggugacgggcaccu

SEQ ID NO: 41986 - RNA, 18 nt, Artificial Sequence
  Description of Artificial Sequence: Synthetic oligonucleotide
gccaggcguggugacggg

SEQ ID NO: 41987 - RNA, 18 nt, Artificial Sequence
  Description of Artificial Sequence: Synthetic oligonucleotide
aauuagccaggcguggug

SEQ ID NO: 41988 - RNA, 18 nt, Artificial Sequence
  Description of Artificial Sequence: Synthetic oligonucleotide
acaaaaauuagccaggcg

SEQ ID NO: 41989 - RNA, 18 nt, Artificial Sequence
  Description of Artificial Sequence: Synthetic oligonucleotide
aaaauacaaaaauuagcc

SEQ ID NO: 41990 - RNA, 18 nt, Artificial Sequence
  Description of Artificial Sequence: Synthetic oligonucleotide
uauuaaaaauacaaaaau

SEQ ID NO: 41991 - RNA, 18 nt, Artificial Sequence
  Description of Artificial Sequence: Synthetic oligonucleotide
gucuguauuaaaaauaca

SEQ ID NO: 41992 - RNA, 18 nt, Artificial Sequence
  Description of Artificial Sequence: Synthetic oligonucleotide
acccugucuguauuaaaa

SEQ ID NO: 41993 - RNA, 18 nt, Artificial Sequence
  Description of Artificial Sequence: Synthetic oligonucleotide
gugaaacccugucuguau

SEQ ID NO: 41994 - RNA, 18 nt, Artificial Sequence
  Description of Artificial Sequence: Synthetic oligonucleotide
acauggugaaacccuguc

SEQ ID NO: 41995 - RNA, 18 nt, Artificial Sequence
  Description of Artificial Sequence: Synthetic oligonucleotide
ggccaacauggugaaacc

SEQ ID NO: 41996 - RNA, 18 nt, Artificial Sequence
  Description of Artificial Sequence: Synthetic oligonucleotide
auccuggccaacauggug

SEQ ID NO: 41997 - RNA, 18 nt, Artificial Sequence
  Description of Artificial Sequence: Synthetic oligonucleotide
agaccauccuggccaaca

SEQ ID NO: 41998 - RNA, 18 nt, Artificial Sequence
  Description of Artificial Sequence: Synthetic oligonucleotide
gaucaagaccauccuggc

SEQ ID NO: 41999 - RNA, 18 nt, Artificial Sequence
  Description of Artificial Sequence: Synthetic oligonucleotide
caagagaucaagaccauc

SEQ ID NO: 42000 - RNA, 18 nt, Artificial Sequence
  Description of Artificial Sequence: Synthetic oligonucleotide
gaggucaagagaucaaga

SEQ ID NO: 42001 - RNA, 18 nt, Artificial Sequence
  Description of Artificial Sequence: Synthetic oligonucleotide
aucacgaggucaagagau

SEQ ID NO: 42002 - RNA, 18 nt, Artificial Sequence
  Description of Artificial Sequence: Synthetic oligonucleotide
ggaggaucacgaggucaa

SEQ ID NO: 42003 - RNA, 18 nt, Artificial Sequence
  Description of Artificial Sequence: Synthetic oligonucleotide
aggugggaggaucacgag

SEQ ID NO: 42004 - RNA, 18 nt, Artificial Sequence
  Description of Artificial Sequence: Synthetic oligonucleotide
ggccgaggugggaggauc

SEQ ID NO: 42005 - RNA, 18 nt, Artificial Sequence
  Description of Artificial Sequence: Synthetic oligonucleotide
ugggaggccgagguggga

SEQ ID NO: 42006 - RNA, 18 nt, Artificial Sequence
  Description of Artificial Sequence: Synthetic oligonucleotide
cacucugggaggccgagg

SEQ ID NO: 42007 - RNA, 18 nt, Artificial Sequence
  Description of Artificial Sequence: Synthetic oligonucleotide
cccagcacucugggaggc

SEQ ID NO: 42008 - RNA, 18 nt, Artificial Sequence
  Description of Artificial Sequence: Synthetic oligonucleotide
guaaucccagcacucugg

SEQ ID NO: 42009 - RNA, 18 nt, Artificial Sequence
  Description of Artificial Sequence: Synthetic oligonucleotide
uaucuguaaucccagcac

SEQ ID NO: 42010 - RNA, 18 nt, Artificial Sequence
  Description of Artificial Sequence: Synthetic oligonucleotide
gcucauaucuguaauccc

SEQ ID NO: 42011 - RNA, 18 nt, Artificial Sequence
  Description of Artificial Sequence: Synthetic oligonucleotide
caguggcucauaucugua

SEQ ID NO: 42012 - RNA, 18 nt, Artificial Sequence
  Description of Artificial Sequence: Synthetic oligonucleotide
gggcgcaguggcucauau

SEQ ID NO: 42013 - RNA, 18 nt, Artificial Sequence
  Description of Artificial Sequence: Synthetic oligonucleotide
cagcugggcgcaguggcu

SEQ ID NO: 42014 - RNA, 18 nt, Artificial Sequence
  Description of Artificial Sequence: Synthetic oligonucleotide
ucuugcagcugggcgcag

SEQ ID NO: 42015 - RNA, 18 nt, Artificial Sequence
  Description of Artificial Sequence: Synthetic oligonucleotide
auacaucuugcagcuggg

SEQ ID NO: 42016 - RNA, 18 nt, Artificial Sequence
  Description of Artificial Sequence: Synthetic oligonucleotide
uagaaauacaucuugcag

SEQ ID NO: 42017 - RNA, 18 nt, Artificial Sequence
  Description of Artificial Sequence: Synthetic oligonucleotide
acugauagaaauacaucu

SEQ ID NO: 42018 - RNA, 18 nt, Artificial Sequence
  Description of Artificial Sequence: Synthetic oligonucleotide
agaauacugauagaaaua

SEQ ID NO: 42019 - RNA, 18 nt, Artificial Sequence
  Description of Artificial Sequence: Synthetic oligonucleotide
uucguuuuagucaacagg

SEQ ID NO: 42020 - RNA, 18 nt, Artificial Sequence
  Description of Artificial Sequence: Synthetic oligonucleotide
uugaauucguuuuaguca

SEQ ID NO: 42021 - RNA, 18 nt, Artificial Sequence
  Description of Artificial Sequence: Synthetic oligonucleotide
ggcuguugaauucguuuu

SEQ ID NO: 42022 - RNA, 18 nt, Artificial Sequence
  Description of Artificial Sequence: Synthetic oligonucleotide
cuacuggcuguugaauuc

SEQ ID NO: 42023 - RNA, 18 nt, Artificial Sequence
  Description of Artificial Sequence: Synthetic oligonucleotide
cccugcuacuggcuguug

SEQ ID NO: 42024 - RNA, 18 nt, Artificial Sequence
  Description of Artificial Sequence: Synthetic oligonucleotide
uauuucccugcuacuggc

SEQ ID NO: 42025 - RNA, 18 nt, Artificial Sequence
  Description of Artificial Sequence: Synthetic oligonucleotide
gaccauauuucccugcua

SEQ ID NO: 42026 - RNA, 18 nt, Artificial Sequence
  Description of Artificial Sequence: Synthetic oligonucleotide
ugaaagaccauauuuccc

SEQ ID NO: 42027 - RNA, 18 nt, Artificial Sequence
  Description of Artificial Sequence: Synthetic oligonucleotide
ugccuugaaagaccauau

SEQ ID NO: 42028 - RNA, 18 nt, Artificial Sequence
  Description of Artificial Sequence: Synthetic oligonucleotide
ucugaugccuugaaagac

SEQ ID NO: 42029 - RNA, 18 nt, Artificial Sequence
  Description of Artificial Sequence: Synthetic oligonucleotide
gaguuucugaugccuuga

SEQ ID NO: 42030 - RNA, 18 nt, Artificial Sequence
  Description of Artificial Sequence: Synthetic oligonucleotide
uaaaugaguuucugaugc

SEQ ID NO: 42031 - RNA, 18 nt, Artificial Sequence
  Description of Artificial Sequence: Synthetic oligonucleotide
uuuuguaaaugaguuucu

SEQ ID NO: 42032 - RNA, 18 nt, Artificial Sequence
  Description of Artificial Sequence: Synthetic oligonucleotide
auaauuuuuguaaaugag

SEQ ID NO: 42033 - RNA, 18 nt, Artificial Sequence
  Description of Artificial Sequence: Synthetic oligonucleotide
gcucuauaauuuuuguaa

SEQ ID NO: 42034 - RNA, 18 nt, Artificial Sequence
  Description of Artificial Sequence: Synthetic oligonucleotide
uggcagcucuauaauuuu

SEQ ID NO: 42035 - RNA, 18 nt, Artificial Sequence
  Description of Artificial Sequence: Synthetic oligonucleotide
uuuccuggcagcucuaua

SEQ ID NO: 42036 - RNA, 18 nt, Artificial Sequence
  Description of Artificial Sequence: Synthetic oligonucleotide
gccuuuuuccuggcagcu

SEQ ID NO: 42037 - RNA, 18 nt, Artificial Sequence
  Description of Artificial Sequence: Synthetic oligonucleotide
gugcagccuuuuuccugg

SEQ ID NO: 42038 - RNA, 18 nt, Artificial Sequence
  Description of Artificial Sequence: Synthetic oligonucleotide
uuguugugcagccuuuuu

SEQ ID NO: 42039 - RNA, 18 nt, Artificial Sequence
  Description of Artificial Sequence: Synthetic oligonucleotide
uauuuuuguugugcagcc

SEQ ID NO: 42040 - RNA, 18 nt, Artificial Sequence
  Description of Artificial Sequence: Synthetic oligonucleotide
ucaacuauuuuuguugug

SEQ ID NO: 42041 - RNA, 18 nt, Artificial Sequence
  Description of Artificial Sequence: Synthetic oligonucleotide
uuuacucaacuauuuuug

SEQ ID NO: 42042 - RNA, 18 nt, Artificial Sequence
  Description of Artificial Sequence: Synthetic oligonucleotide
ucuaguuuacucaacuau

SEQ ID NO: 42043 - RNA, 18 nt, Artificial Sequence
  Description of Artificial Sequence: Synthetic oligonucleotide
auguuucuaguuuacuca

SEQ ID NO: 42044 - RNA, 18 nt, Artificial Sequence
  Description of Artificial Sequence: Synthetic oligonucleotide
aguguauguuucuaguuu

SEQ ID NO: 42045 - RNA, 18 nt, Artificial Sequence
  Description of Artificial Sequence: Synthetic oligonucleotide
uucccaguguauguuucu

SEQ ID NO: 42046 - RNA, 18 nt, Artificial Sequence
  Description of Artificial Sequence: Synthetic oligonucleotide
cucucuucccaguguaug

SEQ ID NO: 42047 - RNA, 18 nt, Artificial Sequence
  Description of Artificial Sequence: Synthetic oligonucleotide
ccauacucucuucccagu

SEQ ID NO: 42048 - RNA, 18 nt, Artificial Sequence
  Description of Artificial Sequence: Synthetic oligonucleotide
ugcccccauacucucuuc

SEQ ID NO: 42049 - RNA, 18 nt, Artificial Sequence
  Description of Artificial Sequence: Synthetic oligonucleotide
caacuugcccccauacuc

SEQ ID NO: 42050 - RNA, 18 nt, Artificial Sequence
  Description of Artificial Sequence: Synthetic oligonucleotide
gcuaacaacuugccccca

SEQ ID NO: 42051 - RNA, 18 nt, Artificial Sequence
  Description of Artificial Sequence: Synthetic oligonucleotide
auccagcuaacaacuugc

SEQ ID NO: 42052 - RNA, 18 nt, Artificial Sequence
  Description of Artificial Sequence: Synthetic oligonucleotide
uaucuauccagcuaacaa

SEQ ID NO: 42053 - RNA, 18 nt, Artificial Sequence
  Description of Artificial Sequence: Synthetic oligonucleotide
aguccuaucuauccagcu

SEQ ID NO: 42054 - RNA, 18 nt, Artificial Sequence
  Description of Artificial Sequence: Synthetic oligonucleotide
agcacaguccuaucuauc

SEQ ID NO: 42055 - RNA, 18 nt, Artificial Sequence
  Description of Artificial Sequence: Synthetic oligonucleotide
gucaaagcacaguccuau

SEQ ID NO: 42056 - RNA, 18 nt, Artificial Sequence
  Description of Artificial Sequence: Synthetic oligonucleotide
gaggugucaaagcacagu

SEQ ID NO: 42057 - RNA, 18 nt, Artificial Sequence
  Description of Artificial Sequence: Synthetic oligonucleotide
ccacagaggugucaaagc

SEQ ID NO: 42058 - RNA, 18 nt, Artificial Sequence
  Description of Artificial Sequence: Synthetic oligonucleotide
auagaccacagagguguc

SEQ ID NO: 42059 - RNA, 18 nt, Artificial Sequence
  Description of Artificial Sequence: Synthetic oligonucleotide
agaucauagaccacagag

SEQ ID NO: 42060 - RNA, 18 nt, Artificial Sequence
  Description of Artificial Sequence: Synthetic oligonucleotide
uucagagaucauagacca

SEQ ID NO: 42061 - RNA, 18 nt, Artificial Sequence
  Description of Artificial Sequence: Synthetic oligonucleotide
ccagguucagagaucaua

SEQ ID NO: 42062 - RNA, 18 nt, Artificial Sequence
  Description of Artificial Sequence: Synthetic oligonucleotide
cuauuccagguucagaga

SEQ ID NO: 42063 - RNA, 18 nt, Artificial Sequence
  Description of Artificial Sequence: Synthetic oligonucleotide
gaacccuauuccagguuc

SEQ ID NO: 42064 - RNA, 18 nt, Artificial Sequence
  Description of Artificial Sequence: Synthetic oligonucleotide
aaaaugaacccuauucca

SEQ ID NO: 42065 - RNA, 18 nt, Artificial Sequence
  Description of Artificial Sequence: Synthetic oligonucleotide
cuauuaaaaugaacccua

SEQ ID NO: 42066 - RNA, 18 nt, Artificial Sequence
  Description of Artificial Sequence: Synthetic oligonucleotide
uaucgcuauuaaaaugaa

SEQ ID NO: 42067 - RNA, 18 nt, Artificial Sequence
  Description of Artificial Sequence: Synthetic oligonucleotide
gacuuuaucgcuauuaaa

SEQ ID NO: 42068 - RNA, 18 nt, Artificial Sequence
  Description of Artificial Sequence: Synthetic oligonucleotide
auaaugacuuuaucgcua

SEQ ID NO: 42069 - RNA, 18 nt, Artificial Sequence
  Description of Artificial Sequence: Synthetic oligonucleotide
cugggauaaugacuuuau

SEQ ID NO: 42070 - RNA, 18 nt, Artificial Sequence
  Description of Artificial Sequence: Synthetic oligonucleotide
augcacugggauaaugac

SEQ ID NO: 42071 - RNA, 18 nt, Artificial Sequence
  Description of Artificial Sequence: Synthetic oligonucleotide
uuuggaugcacugggaua

SEQ ID NO: 42072 - RNA, 18 nt, Artificial Sequence
  Description of Artificial Sequence: Synthetic oligonucleotide
aucaauuuggaugcacug

SEQ ID NO: 42073 - RNA, 18 nt, Artificial Sequence
  Description of Artificial Sequence: Synthetic oligonucleotide
aacuaaucaauuuggaug

SEQ ID NO: 42074 - RNA, 18 nt, Artificial Sequence
  Description of Artificial Sequence: Synthetic oligonucleotide
gcaugaacuaaucaauuu

SEQ ID NO: 42075 - RNA, 18 nt, Artificial Sequence
  Description of Artificial Sequence: Synthetic oligonucleotide
auaaagcaugaacuaauc

SEQ ID NO: 42076 - RNA, 18 nt, Artificial Sequence
  Description of Artificial Sequence: Synthetic oligonucleotide
uccuaauaaagcaugaac

SEQ ID NO: 42077 - RNA, 18 nt, Artificial Sequence
  Description of Artificial Sequence: Synthetic oligonucleotide
cuguuuccuaauaaagca

SEQ ID NO: 42078 - RNA, 18 nt, Artificial Sequence
  Description of Artificial Sequence: Synthetic oligonucleotide
aacuucuguuuccuaaua

SEQ ID NO: 42079 - RNA, 18 nt, Artificial Sequence
  Description of Artificial Sequence: Synthetic oligonucleotide
uggguaacuucuguuucc

SEQ ID NO: 42080 - RNA, 18 nt, Artificial Sequence
  Description of Artificial Sequence: Synthetic oligonucleotide
aguuuuggguaacuucug

SEQ ID NO: 42081 - RNA, 18 nt, Artificial Sequence
  Description of Artificial Sequence: Synthetic oligonucleotide
ugcuaaguuuuggguaac

SEQ ID NO: 42082 - RNA, 18 nt, Artificial Sequence
  Description of Artificial Sequence: Synthetic oligonucleotide
agguuugcuaaguuuugg

SEQ ID NO: 42083 - RNA, 18 nt, Artificial Sequence
  Description of Artificial Sequence: Synthetic oligonucleotide
uacuuagguuugcuaagu

SEQ ID NO: 42084 - RNA, 18 nt, Artificial Sequence
  Description of Artificial Sequence: Synthetic oligonucleotide
cuugguacuuagguuugc

SEQ ID NO: 42085 - RNA, 18 nt, Artificial Sequence
  Description of Artificial Sequence: Synthetic oligonucleotide
ggauacuugguacuuagg

SEQ ID NO: 42086 - RNA, 18 nt, Artificial Sequence
  Description of Artificial Sequence: Synthetic oligonucleotide
guuuuggauacuugguac

SEQ ID NO: 42087 - RNA, 18 nt, Artificial Sequence
  Description of Artificial Sequence: Synthetic oligonucleotide
agaauguuuuggauacuu

SEQ ID NO: 42088 - RNA, 18 nt, Artificial Sequence
  Description of Artificial Sequence: Synthetic oligonucleotide
ggaaaagaauguuuugga

SEQ ID NO: 42089 - RNA, 18 nt, Artificial Sequence
  Description of Artificial Sequence: Synthetic oligonucleotide
guguaggaaaagaauguu

SEQ ID NO: 42090 - RNA, 18 nt, Artificial Sequence
  Description of Artificial Sequence: Synthetic oligonucleotide
acauuguguaggaaaaga

SEQ ID NO: 42091 - RNA, 18 nt, Artificial Sequence
  Description of Artificial Sequence: Synthetic oligonucleotide
cccaaacauuguguagga

SEQ ID NO: 42092 - RNA, 18 nt, Artificial Sequence
  Description of Artificial Sequence: Synthetic oligonucleotide
aauaccccaaacauugug

SEQ ID NO: 42093 - RNA, 18 nt, Artificial Sequence
  Description of Artificial Sequence: Synthetic oligonucleotide
uugacaauaccccaaaca

SEQ ID NO: 42094 - RNA, 18 nt, Artificial Sequence
  Description of Artificial Sequence: Synthetic oligonucleotide
caacuuugacaauacccc

SEQ ID NO: 42095 - RNA, 18 nt, Artificial Sequence
  Description of Artificial Sequence: Synthetic oligonucleotide
caauccaacuuugacaau

SEQ ID NO: 42096 - RNA, 18 nt, Artificial Sequence
  Description of Artificial Sequence: Synthetic oligonucleotide
ugaaucaauccaacuuug

SEQ ID NO: 42097 - RNA, 18 nt, Artificial Sequence
  Description of Artificial Sequence: Synthetic oligonucleotide
gcuggugaaucaauccaa

SEQ ID NO: 42098 - RNA, 18 nt, Artificial Sequence
  Description of Artificial Sequence: Synthetic oligonucleotide
gacuggcuggugaaucaa

SEQ ID NO: 42099 - RNA, 18 nt, Artificial Sequence
  Description of Artificial Sequence: Synthetic oligonucleotide
auuaagacuggcugguga

SEQ ID NO: 42100 - RNA, 18 nt, Artificial Sequence
  Description of Artificial Sequence: Synthetic oligonucleotide
agccaauuaagacuggcu

SEQ ID NO: 42101 - RNA, 18 nt, Artificial Sequence
  Description of Artificial Sequence: Synthetic oligonucleotide
uuaguagccaauuaagac

SEQ ID NO: 42102 - RNA, 18 nt, Artificial Sequence
  Description of Artificial Sequence: Synthetic oligonucleotide
aaccauuaguagccaauu

SEQ ID NO: 42103 - RNA, 18 nt, Artificial Sequence
  Description of Artificial Sequence: Synthetic oligonucleotide
ggcugaaccauuaguagc

SEQ ID NO: 42104 - RNA, 18 nt, Artificial Sequence
  Description of Artificial Sequence: Synthetic oligonucleotide
aaacaggcugaaccauua

SEQ ID NO: 42105 - RNA, 18 nt, Artificial Sequence
  Description of Artificial Sequence: Synthetic oligonucleotide
ggagaaaacaggcugaac

SEQ ID NO: 42106 - RNA, 18 nt, Artificial Sequence
  Description of Artificial Sequence: Synthetic oligonucleotide
cuuuaggagaaaacaggc

SEQ ID NO: 42107 - RNA, 18 nt, Artificial Sequence
  Description of Artificial Sequence: Synthetic oligonucleotide
aaccucuuuaggagaaaa

SEQ ID NO: 42108 - RNA, 18 nt, Artificial Sequence
  Description of Artificial Sequence: Synthetic oligonucleotide
aaacaaaccucuuuagga

SEQ ID NO: 42109 - RNA, 18 nt, Artificial Sequence
  Description of Artificial Sequence: Synthetic oligonucleotide
acauuaaacaaaccucuu

SEQ ID NO: 42110 - RNA, 18 nt, Artificial Sequence
  Description of Artificial Sequence: Synthetic oligonucleotide
aucugacauuaaacaaac

SEQ ID NO: 42111 - RNA, 18 nt, Artificial Sequence
  Description of Artificial Sequence: Synthetic oligonucleotide
uuaucaucugacauuaaa

SEQ ID NO: 42112 - RNA, 18 nt, Artificial Sequence
  Description of Artificial Sequence: Synthetic oligonucleotide
uacaauuaucaucugaca

SEQ ID NO: 42113 - RNA, 18 nt, Artificial Sequence
  Description of Artificial Sequence: Synthetic oligonucleotide
aucuguacaauuaucauc

SEQ ID NO: 42114 - RNA, 18 nt, Artificial Sequence
  Description of Artificial Sequence: Synthetic oligonucleotide
aacauaucuguacaauua

SEQ ID NO: 42115 - RNA, 18 nt, Artificial Sequence
  Description of Artificial Sequence: Synthetic oligonucleotide
ucccaaacauaucuguac

SEQ ID NO: 42116 - RNA, 18 nt, Artificial Sequence
  Description of Artificial Sequence: Synthetic oligonucleotide
cuuccacuucgcuuccaa

SEQ ID NO: 42117 - RNA, 18 nt, Artificial Sequence
  Description of Artificial Sequence: Synthetic oligonucleotide
cagugcuuccacuucgcu

SEQ ID NO: 42118 - RNA, 18 nt, Artificial Sequence
  Description of Artificial Sequence: Synthetic oligonucleotide
agguucagugcuuccacu

SEQ ID NO: 42119 - RNA, 18 nt, Artificial Sequence
  Description of Artificial Sequence: Synthetic oligonucleotide
ccuggagguucagugcuu

SEQ ID NO: 42120 - RNA, 18 nt, Artificial Sequence
  Description of Artificial Sequence: Synthetic oligonucleotide
ugucaccuggagguucag

SEQ ID NO: 42121 - RNA, 18 nt, Artificial Sequence
  Description of Artificial Sequence: Synthetic oligonucleotide
agagaugucaccuggagg

SEQ ID NO: 42122 - RNA, 18 nt, Artificial Sequence
  Description of Artificial Sequence: Synthetic oligonucleotide
uaaacagagaugucaccu

SEQ ID NO: 42123 - RNA, 18 nt, Artificial Sequence
  Description of Artificial Sequence: Synthetic oligonucleotide
cuccuuaaacagagaugu

SEQ ID NO: 42124 - RNA, 18 nt, Artificial Sequence
  Description of Artificial Sequence: Synthetic oligonucleotide
ugaagcuccuuaaacaga

SEQ ID NO: 42125 - RNA, 18 nt, Artificial Sequence
  Description of Artificial Sequence: Synthetic oligonucleotide
ccucuugaagcuccuuaa

SEQ ID NO: 42126 - RNA, 18 nt, Artificial Sequence
  Description of Artificial Sequence: Synthetic oligonucleotide
augagccucuugaagcuc

SEQ ID NO: 42127 - RNA, 18 nt, Artificial Sequence
  Description of Artificial Sequence: Synthetic oligonucleotide
uuuguaugagccucuuga

SEQ ID NO: 42128 - RNA, 18 nt, Artificial Sequence
  Description of Artificial Sequence: Synthetic oligonucleotide
ugaguuuuguaugagccu

SEQ ID NO: 42129 - RNA, 18 nt, Artificial Sequence
  Description of Artificial Sequence: Synthetic oligonucleotide
uuugcugaguuuuguaug

SEQ ID NO: 42130 - RNA, 18 nt, Artificial Sequence
  Description of Artificial Sequence: Synthetic oligonucleotide
ucagcuuugcugaguuuu

SEQ ID NO: 42131 - RNA, 18 nt, Artificial Sequence
  Description of Artificial Sequence: Synthetic oligonucleotide
uuagcucagcuuugcuga

SEQ ID NO: 42132 - RNA, 18 nt, Artificial Sequence
  Description of Artificial Sequence: Synthetic oligonucleotide
cuucauuagcucagcuuu

SEQ ID NO: 42133 - RNA, 18 nt, Artificial Sequence
  Description of Artificial Sequence: Synthetic oligonucleotide
cucuucuucauuagcuca

SEQ ID NO: 42134 - RNA, 18 nt, Artificial Sequence
  Description of Artificial Sequence: Synthetic oligonucleotide
gaagucucuucuucauua

SEQ ID NO: 42135 - RNA, 18 nt, Artificial Sequence
  Description of Artificial Sequence: Synthetic oligonucleotide
uucuugaagucucuucuu

SEQ ID NO: 42136 - RNA, 18 nt, Artificial Sequence
  Description of Artificial Sequence: Synthetic oligonucleotide
ucuuuucaaaaucugaaa

SEQ ID NO: 42137 - RNA, 18 nt, Artificial Sequence
  Description of Artificial Sequence: Synthetic oligonucleotide
uguuuucuuuucaaaauc

SEQ ID NO: 42138 - RNA, 18 nt, Artificial Sequence
  Description of Artificial Sequence: Synthetic oligonucleotide
uuacuuguuuucuuuuca

SEQ ID NO: 42139 - RNA, 18 nt, Artificial Sequence
  Description of Artificial Sequence: Synthetic oligonucleotide
aacgauuacuuguuuucu

SEQ ID NO: 42140 - RNA, 18 nt, Artificial Sequence
  Description of Artificial Sequence: Synthetic oligonucleotide
cucagaacgauuacuugu

SEQ ID NO: 42141 - RNA, 18 nt, Artificial Sequence
  Description of Artificial Sequence: Synthetic oligonucleotide
ucaaucucagaacgauua

SEQ ID NO: 42142 - RNA, 18 nt, Artificial Sequence
  Description of Artificial Sequence: Synthetic oligonucleotide
ggguuucaaucucagaac

SEQ ID NO: 42143 - RNA, 18 nt, Artificial Sequence
  Description of Artificial Sequence: Synthetic oligonucleotide
ugucuggguuucaaucuc

SEQ ID NO: 42144 - RNA, 18 nt, Artificial Sequence
  Description of Artificial Sequence: Synthetic oligonucleotide
cccucugucuggguuuca

SEQ ID NO: 42145 - RNA, 18 nt, Artificial Sequence
  Description of Artificial Sequence: Synthetic oligonucleotide
ugcuccccucugucuggg

SEQ ID NO: 42146 - RNA, 18 nt, Artificial Sequence
  Description of Artificial Sequence: Synthetic oligonucleotide
cucugugcuccccucugu

SEQ ID NO: 42147 - RNA, 18 nt, Artificial Sequence
  Description of Artificial Sequence: Synthetic oligonucleotide
ucuuucucugugcucccc

SEQ ID NO: 42148 - RNA, 18 nt, Artificial Sequence
  Description of Artificial Sequence: Synthetic oligonucleotide
cauucucuuucucugugc

SEQ ID NO: 42149 - RNA, 18 nt, Artificial Sequence
  Description of Artificial Sequence: Synthetic oligonucleotide
uucaucauucucuuucuc

SEQ ID NO: 42150 - RNA, 18 nt, Artificial Sequence
  Description of Artificial Sequence: Synthetic oligonucleotide
uucucuucaucauucucu

SEQ ID NO: 42151 - RNA, 18 nt, Artificial Sequence
  Description of Artificial Sequence: Synthetic oligonucleotide
ggccuuucucuucaucau

SEQ ID NO: 42152 - RNA, 18 nt, Artificial Sequence
  Description of Artificial Sequence: Synthetic oligonucleotide
cuccgggccuuucucuuc

SEQ ID NO: 42153 - RNA, 18 nt, Artificial Sequence
  Description of Artificial Sequence: Synthetic oligonucleotide
ggccguggaaucuuagga

SEQ ID NO: 42154 - RNA, 18 nt, Artificial Sequence
  Description of Artificial Sequence: Synthetic oligonucleotide
guaguggccguggaaucu

SEQ ID NO: 42155 - RNA, 18 nt, Artificial Sequence
  Description of Artificial Sequence: Synthetic oligonucleotide
gugugguaguggccgugg

SEQ ID NO: 42156 - RNA, 18 nt, Artificial Sequence
  Description of Artificial Sequence: Synthetic oligonucleotide
ugugggugugguaguggc

SEQ ID NO: 42157 - RNA, 18 nt, Artificial Sequence
  Description of Artificial Sequence: Synthetic oligonucleotide
guguguguggguguggua

SEQ ID NO: 42158 - RNA, 18 nt, Artificial Sequence
  Description of Artificial Sequence: Synthetic oligonucleotide
cucucgugugugugggug

SEQ ID NO: 42159 - RNA, 18 nt, Artificial Sequence
  Description of Artificial Sequence: Synthetic oligonucleotide
gacuacucucgugugugu

SEQ ID NO: 42160 - RNA, 18 nt, Artificial Sequence
  Description of Artificial Sequence: Synthetic oligonucleotide
ggcuggacuacucucgug

SEQ ID NO: 42161 - RNA, 18 nt, Artificial Sequence
  Description of Artificial Sequence: Synthetic oligonucleotide
ucaguggcuggacuacuc

SEQ ID NO: 42162 - RNA, 18 nt, Artificial Sequence
  Description of Artificial Sequence: Synthetic oligonucleotide
ugaauucaguggcuggac

SEQ ID NO: 42163 - RNA, 18 nt, Artificial Sequence
  Description of Artificial Sequence: Synthetic oligonucleotide
agauuugaauucaguggc

SEQ ID NO: 42164 - RNA, 18 nt, Artificial Sequence
  Description of Artificial Sequence: Synthetic oligonucleotide
ucacaagauuugaauuca

SEQ ID NO: 42165 - RNA, 18 nt, Artificial Sequence
  Description of Artificial Sequence: Synthetic oligonucleotide
acccaucacaagauuuga

SEQ ID NO: 42166 - RNA, 18 nt, Artificial Sequence
  Description of Artificial Sequence: Synthetic oligonucleotide
aaauaacccaucacaaga

SEQ ID NO: 42167 - RNA, 18 nt, Artificial Sequence
  Description of Artificial Sequence: Synthetic oligonucleotide
aaagcaaauaacccauca

SEQ ID NO: 42168 - RNA, 18 nt, Artificial Sequence
  Description of Artificial Sequence: Synthetic oligonucleotide
uuucuaaagcaaauaacc

SEQ ID NO: 42169 - RNA, 18 nt, Artificial Sequence
  Description of Artificial Sequence: Synthetic oligonucleotide
cuauauuucuaaagcaaa

SEQ ID NO: 42170 - RNA, 18 nt, Artificial Sequence
  Description of Artificial Sequence: Synthetic oligonucleotide
gauuucuauauuucuaaa

SEQ ID NO: 42171 - RNA, 18 nt, Artificial Sequence
  Description of Artificial Sequence: Synthetic oligonucleotide
aacaugauuucuauauuu

SEQ ID NO: 42172 - RNA, 18 nt, Artificial Sequence
  Description of Artificial Sequence: Synthetic oligonucleotide
auaucaacaugauuucua

SEQ ID NO: 42173 - RNA, 18 nt, Artificial Sequence
  Description of Artificial Sequence: Synthetic oligonucleotide
auucaauaucaacaugau

SEQ ID NO: 42174 - RNA, 18 nt, Artificial Sequence
  Description of Artificial Sequence: Synthetic oligonucleotide
auaauauucaauaucaac

SEQ ID NO: 42175 - RNA, 18 nt, Artificial Sequence
  Description of Artificial Sequence: Synthetic oligonucleotide
gauagauaauauucaaua

SEQ ID NO: 42176 - RNA, 18 nt, Artificial Sequence
  Description of Artificial Sequence: Synthetic oligonucleotide
gaauagauagauaauauu

SEQ ID NO: 42177 - RNA, 18 nt, Artificial Sequence
  Description of Artificial Sequence: Synthetic oligonucleotide
aaaaggaauagauagaua

SEQ ID NO: 42178 - RNA, 18 nt, Artificial Sequence
  Description of Artificial Sequence: Synthetic oligonucleotide
cauauaaaaggaauagau

SEQ ID NO: 42179 - RNA, 18 nt, Artificial Sequence
  Description of Artificial Sequence: Synthetic oligonucleotide
aaggacauauaaaaggaa

SEQ ID NO: 42180 - RNA, 18 nt, Artificial Sequence
  Description of Artificial Sequence: Synthetic oligonucleotide
aggacaaggacauauaaa

SEQ ID NO: 42181 - RNA, 18 nt, Artificial Sequence
  Description of Artificial Sequence: Synthetic oligonucleotide
agagcaggacaaggacau

SEQ ID NO: 42182 - RNA, 18 nt, Artificial Sequence
  Description of Artificial Sequence: Synthetic oligonucleotide
gacacagagcaggacaag

SEQ ID NO: 42183 - RNA, 18 nt, Artificial Sequence
  Description of Artificial Sequence: Synthetic oligonucleotide
caauugacacagagcagg

SEQ ID NO: 42184 - RNA, 18 nt, Artificial Sequence
  Description of Artificial Sequence: Synthetic oligonucleotide
cgcuacaauugacacaga

SEQ ID NO: 42185 - RNA, 18 nt, Artificial Sequence
  Description of Artificial Sequence: Synthetic oligonucleotide
caucucgcuacaauugac

SEQ ID NO: 42186 - RNA, 18 nt, Artificial Sequence
  Description of Artificial Sequence: Synthetic oligonucleotide
aaauacaucucgcuacaa

SEQ ID NO: 42187 - RNA, 18 nt, Artificial Sequence
  Description of Artificial Sequence: Synthetic oligonucleotide
aaaagaaauacaucucgc

SEQ ID NO: 42188 - RNA, 18 nt, Artificial Sequence
  Description of Artificial Sequence: Synthetic oligonucleotide
aacaaaaaagaaauacau

SEQ ID NO: 42189 - RNA, 18 nt, Artificial Sequence
  Description of Artificial Sequence: Synthetic oligonucleotide
acaacaacaaaaaagaaa

SEQ ID NO: 42190 - RNA, 18 nt, Artificial Sequence
  Description of Artificial Sequence: Synthetic oligonucleotide
caacaacaacaacaaaaa

SEQ ID NO: 42191 - RNA, 18 nt, Artificial Sequence
  Description of Artificial Sequence: Synthetic oligonucleotide
aucuccaacaacaacaac

SEQ ID NO: 42192 - RNA, 18 nt, Artificial Sequence
  Description of Artificial Sequence: Synthetic oligonucleotide
acuccaucuccaacaaca

SEQ ID NO: 42193 - RNA, 18 nt, Artificial Sequence
  Description of Artificial Sequence: Synthetic oligonucleotide
gugagacuccaucuccaa

SEQ ID NO: 42194 - RNA, 18 nt, Artificial Sequence
  Description of Artificial Sequence: Synthetic oligonucleotide
acagagugagacuccauc

SEQ ID NO: 42195 - RNA, 18 nt, Artificial Sequence
  Description of Artificial Sequence: Synthetic oligonucleotide
uggcgacagagugagacu

SEQ ID NO: 42196 - RNA, 18 nt, Artificial Sequence
  Description of Artificial Sequence: Synthetic oligonucleotide
cagccuggcgacagagug

SEQ ID NO: 42197 - RNA, 18 nt, Artificial Sequence
  Description of Artificial Sequence: Synthetic oligonucleotide
cacuccagccuggcgaca

SEQ ID NO: 42198 - RNA, 18 nt, Artificial Sequence
  Description of Artificial Sequence: Synthetic oligonucleotide
cacugcacuccagccugg

SEQ ID NO: 42199 - RNA, 18 nt, Artificial Sequence
  Description of Artificial Sequence: Synthetic oligonucleotide
cgugccacugcacuccag

SEQ ID NO: 42200 - RNA, 18 nt, Artificial Sequence
  Description of Artificial Sequence: Synthetic oligonucleotide
gagaucgugccacugcac

SEQ ID NO: 42201 - RNA, 18 nt, Artificial Sequence
  Description of Artificial Sequence: Synthetic oligonucleotide
gagcugagaucgugccac

SEQ ID NO: 42202 - RNA, 18 nt, Artificial Sequence
  Description of Artificial Sequence: Synthetic oligonucleotide
gcagugagcugagaucgu

SEQ ID NO: 42203 - RNA, 18 nt, Artificial Sequence
  Description of Artificial Sequence: Synthetic oligonucleotide
agguugcagugagcugag

SEQ ID NO: 42204 - RNA, 18 nt, Artificial Sequence
  Description of Artificial Sequence: Synthetic oligonucleotide
ggcggagguugcagugag

SEQ ID NO: 42205 - RNA, 18 nt, Artificial Sequence
  Description of Artificial Sequence: Synthetic oligonucleotide
ugggaggcggagguugca

SEQ ID NO: 42206 - RNA, 18 nt, Artificial Sequence
  Description of Artificial Sequence: Synthetic oligonucleotide
gaaccugggaggcggagg

SEQ ID NO: 42207 - RNA, 18 nt, Artificial Sequence
  Description of Artificial Sequence: Synthetic oligonucleotide
ugcuugaaccugggaggc

SEQ ID NO: 42208 - RNA, 18 nt, Artificial Sequence
  Description of Artificial Sequence: Synthetic oligonucleotide
agaacugcuugaaccugg

SEQ ID NO: 42209 - RNA, 18 nt, Artificial Sequence
  Description of Artificial Sequence: Synthetic oligonucleotide
gcaggagaacugcuugaa

SEQ ID NO: 42210 - RNA, 18 nt, Artificial Sequence
  Description of Artificial Sequence: Synthetic oligonucleotide
cugaggcaggagaacugc

SEQ ID NO: 42211 - RNA, 18 nt, Artificial Sequence
  Description of Artificial Sequence: Synthetic oligonucleotide
ggaggcugaggcaggaga

SEQ ID NO: 42212 - RNA, 18 nt, Artificial Sequence
  Description of Artificial Sequence: Synthetic oligonucleotide
acuugggaggcugaggca

SEQ ID NO: 42213 - RNA, 18 nt, Artificial Sequence
  Description of Artificial Sequence: Synthetic oligonucleotide
cagcuacuugggaggcug

SEQ ID NO: 42214 - RNA, 18 nt, Artificial Sequence
  Description of Artificial Sequence: Synthetic oligonucleotide
aaucccagcuacuuggga

SEQ ID NO: 42215 - RNA, 18 nt, Artificial Sequence
  Description of Artificial Sequence: Synthetic oligonucleotide
ccuguaaucccagcuacu

SEQ ID NO: 42216 - RNA, 18 nt, Artificial Sequence
  Description of Artificial Sequence: Synthetic oligonucleotide
gggcaccuguaaucccag

SEQ ID NO: 42217 - RNA, 18 nt, Artificial Sequence
  Description of Artificial Sequence: Synthetic oligonucleotide
gugacgggcaccuguaau

SEQ ID NO: 42218 - RNA, 18 nt, Artificial Sequence
  Description of Artificial Sequence: Synthetic oligonucleotide
gcguggugacgggcaccu

SEQ ID NO: 42219 - RNA, 18 nt, Artificial Sequence
  Description of Artificial Sequence: Synthetic oligonucleotide
gccaggcguggugacggg

SEQ ID NO: 42220 - RNA, 18 nt, Artificial Sequence
  Description of Artificial Sequence: Synthetic oligonucleotide
aauuagccaggcguggug

SEQ ID NO: 42221 - RNA, 18 nt, Artificial Sequence
  Description of Artificial Sequence: Synthetic oligonucleotide
acaaaaauuagccaggcg

SEQ ID NO: 42222 - RNA, 18 nt, Artificial Sequence
  Description of Artificial Sequence: Synthetic oligonucleotide
aaaauacaaaaauuagcc

SEQ ID NO: 42223 - RNA, 18 nt, Artificial Sequence
  Description of Artificial Sequence: Synthetic oligonucleotide
uauuaaaaauacaaaaau

SEQ ID NO: 42224 - RNA, 18 nt, Artificial Sequence
  Description of Artificial Sequence: Synthetic oligonucleotide
gucuguauuaaaaauaca

SEQ ID NO: 42225 - RNA, 18 nt, Artificial Sequence
  Description of Artificial Sequence: Synthetic oligonucleotide
acccugucuguauuaaaa

SEQ ID NO: 42226 - RNA, 18 nt, Artificial Sequence
  Description of Artificial Sequence: Synthetic oligonucleotide
gugaaacccugucuguau

SEQ ID NO: 42227 - RNA, 18 nt, Artificial Sequence
  Description of Artificial Sequence: Synthetic oligonucleotide
acauggugaaacccuguc

SEQ ID NO: 42228 - RNA, 18 nt, Artificial Sequence
  Description of Artificial Sequence: Synthetic oligonucleotide
ggccaacauggugaaacc

SEQ ID NO: 42229 - RNA, 18 nt, Artificial Sequence
  Description of Artificial Sequence: Synthetic oligonucleotide
auccuggccaacauggug

SEQ ID NO: 42230 - RNA, 18 nt, Artificial Sequence
  Description of Artificial Sequence: Synthetic oligonucleotide
agaccauccuggccaaca

SEQ ID NO: 42231 - RNA, 18 nt, Artificial Sequence
  Description of Artificial Sequence: Synthetic oligonucleotide
gaucaagaccauccuggc

SEQ ID NO: 42232 - RNA, 18 nt, Artificial Sequence
  Description of Artificial Sequence: Synthetic oligonucleotide
caagagaucaagaccauc

SEQ ID NO: 42233 - RNA, 18 nt, Artificial Sequence
  Description of Artificial Sequence: Synthetic oligonucleotide
gaggucaagagaucaaga

SEQ ID NO: 42234 - RNA, 18 nt, Artificial Sequence
  Description of Artificial Sequence: Synthetic oligonucleotide
aucacgaggucaagagau

SEQ ID NO: 42235 - RNA, 18 nt, Artificial Sequence
  Description of Artificial Sequence: Synthetic oligonucleotide
ggaggaucacgaggucaa

SEQ ID NO: 42236 - RNA, 18 nt, Artificial Sequence
  Description of Artificial Sequence: Synthetic oligonucleotide
aggugggaggaucacgag

SEQ ID NO: 42237 - RNA, 18 nt, Artificial Sequence
  Description of Artificial Sequence: Synthetic oligonucleotide
ggccgaggugggaggauc

SEQ ID NO: 42238 - RNA, 18 nt, Artificial Sequence
  Description of Artificial Sequence: Synthetic oligonucleotide
ugggaggccgagguggga

SEQ ID NO: 42239 - RNA, 18 nt, Artificial Sequence
  Description of Artificial Sequence: Synthetic oligonucleotide
cacucugggaggccgagg

SEQ ID NO: 42240 - RNA, 18 nt, Artificial Sequence
  Description of Artificial Sequence: Synthetic oligonucleotide
cccagcacucugggaggc

SEQ ID NO: 42241 - RNA, 18 nt, Artificial Sequence
  Description of Artificial Sequence: Synthetic oligonucleotide
guaaucccagcacucugg

SEQ ID NO: 42242 - RNA, 18 nt, Artificial Sequence
  Description of Artificial Sequence: Synthetic oligonucleotide
uaucuguaaucccagcac

SEQ ID NO: 42243 - RNA, 18 nt, Artificial Sequence
  Description of Artificial Sequence: Synthetic oligonucleotide
gcucauaucuguaauccc

SEQ ID NO: 42244 - RNA, 18 nt, Artificial Sequence
  Description of Artificial Sequence: Synthetic oligonucleotide
caguggcucauaucugua

SEQ ID NO: 42245 - RNA, 18 nt, Artificial Sequence
  Description of Artificial Sequence: Synthetic oligonucleotide
gggcgcaguggcucauau

SEQ ID NO: 42246 - RNA, 18 nt, Artificial Sequence
  Description of Artificial Sequence: Synthetic oligonucleotide
cagcugggcgcaguggcu

SEQ ID NO: 42247 - RNA, 18 nt, Artificial Sequence
  Description of Artificial Sequence: Synthetic oligonucleotide
ucuugcagcugggcgcag

SEQ ID NO: 42248 - RNA, 18 nt, Artificial Sequence
  Description of Artificial Sequence: Synthetic oligonucleotide
auacaucuugcagcuggg

SEQ ID NO: 42249 - RNA, 18 nt, Artificial Sequence
  Description of Artificial Sequence: Synthetic oligonucleotide
uagaaauacaucuugcag

SEQ ID NO: 42250 - RNA, 18 nt, Artificial Sequence
  Description of Artificial Sequence: Synthetic oligonucleotide
acugauagaaauacaucu

SEQ ID NO: 42251 - RNA, 18 nt, Artificial Sequence
  Description of Artificial Sequence: Synthetic oligonucleotide
agaauacugauagaaaua

SEQ ID NO: 42252 - RNA, 18 nt, Artificial Sequence
  Description of Artificial Sequence: Synthetic oligonucleotide
uucguuuuagucaacagg

SEQ ID NO: 42253 - RNA, 18 nt, Artificial Sequence
  Description of Artificial Sequence: Synthetic oligonucleotide
uugaauucguuuuaguca

SEQ ID NO: 42254 - RNA, 18 nt, Artificial Sequence
  Description of Artificial Sequence: Synthetic oligonucleotide
ggcuguugaauucguuuu

SEQ ID NO: 42255 - RNA, 18 nt, Artificial Sequence
  Description of Artificial Sequence: Synthetic oligonucleotide
cuacuggcuguugaauuc

SEQ ID NO: 42256 - RNA, 18 nt, Artificial Sequence
  Description of Artificial Sequence: Synthetic oligonucleotide
cccugcuacuggcuguug

SEQ ID NO: 42257 - RNA, 18 nt, Artificial Sequence
  Description of Artificial Sequence: Synthetic oligonucleotide
uauuucccugcuacuggc

SEQ ID NO: 42258 - RNA, 18 nt, Artificial Sequence
  Description of Artificial Sequence: Synthetic oligonucleotide
gaccauauuucccugcua

SEQ ID NO: 42259 - RNA, 18 nt, Artificial Sequence
  Description of Artificial Sequence: Synthetic oligonucleotide
ugaaagaccauauuuccc

SEQ ID NO: 42260 - RNA, 18 nt, Artificial Sequence
  Description of Artificial Sequence: Synthetic oligonucleotide
ugccuugaaagaccauau

SEQ ID NO: 42261 - RNA, 18 nt, Artificial Sequence
  Description of Artificial Sequence: Synthetic oligonucleotide
ucugaugccuugaaagac

SEQ ID NO: 42262 - RNA, 18 nt, Artificial Sequence
  Description of Artificial Sequence: Synthetic oligonucleotide
gaguuucugaugccuuga

SEQ ID NO: 42263 - RNA, 18 nt, Artificial Sequence
  Description of Artificial Sequence: Synthetic oligonucleotide
uaaaugaguuucugaugc

SEQ ID NO: 42264 - RNA, 18 nt, Artificial Sequence
  Description of Artificial Sequence: Synthetic oligonucleotide
uuuuguaaaugaguuucu

SEQ ID NO: 42265 - RNA, 18 nt, Artificial Sequence
  Description of Artificial Sequence: Synthetic oligonucleotide
auaauuuuuguaaaugag

SEQ ID NO: 42266 - RNA, 18 nt, Artificial Sequence
  Description of Artificial Sequence: Synthetic oligonucleotide
gcucuauaauuuuuguaa

SEQ ID NO: 42267 - RNA, 18 nt, Artificial Sequence
  Description of Artificial Sequence: Synthetic oligonucleotide
uggcagcucuauaauuuu

SEQ ID NO: 42268 - RNA, 18 nt, Artificial Sequence
  Description of Artificial Sequence: Synthetic oligonucleotide
uuuccuggcagcucuaua

SEQ ID NO: 42269 - RNA, 18 nt, Artificial Sequence
  Description of Artificial Sequence: Synthetic oligonucleotide
gccuuuuuccuggcagcu

SEQ ID NO: 42270 - RNA, 18 nt, Artificial Sequence
  Description of Artificial Sequence: Synthetic oligonucleotide
gugcagccuuuuuccugg

SEQ ID NO: 42271 - RNA, 18 nt, Artificial Sequence
  Description of Artificial Sequence: Synthetic oligonucleotide
uuguugugcagccuuuuu

SEQ ID NO: 42272 - RNA, 18 nt, Artificial Sequence
  Description of Artificial Sequence: Synthetic oligonucleotide
uauuuuuguugugcagcc

SEQ ID NO: 42273 - RNA, 18 nt, Artificial Sequence
  Description of Artificial Sequence: Synthetic oligonucleotide
ucaacuauuuuuguugug

SEQ ID NO: 42274 - RNA, 18 nt, Artificial Sequence
  Description of Artificial Sequence: Synthetic oligonucleotide
uuuacucaacuauuuuug

SEQ ID NO: 42275 - RNA, 18 nt, Artificial Sequence
  Description of Artificial Sequence: Synthetic oligonucleotide
ucuaguuuacucaacuau

SEQ ID NO: 42276 - RNA, 18 nt, Artificial Sequence
  Description of Artificial Sequence: Synthetic oligonucleotide
auguuucuaguuuacuca

SEQ ID NO: 42277 - RNA, 18 nt, Artificial Sequence
  Description of Artificial Sequence: Synthetic oligonucleotide
aguguauguuucuaguuu

SEQ ID NO: 42278 - RNA, 18 nt, Artificial Sequence
  Description of Artificial Sequence: Synthetic oligonucleotide
uucccaguguauguuucu

SEQ ID NO: 42279 - RNA, 18 nt, Artificial Sequence
  Description of Artificial Sequence: Synthetic oligonucleotide
cucucuucccaguguaug

SEQ ID NO: 42280 - RNA, 18 nt, Artificial Sequence
  Description of Artificial Sequence: Synthetic oligonucleotide
ccauacucucuucccagu

SEQ ID NO: 42281 - RNA, 18 nt, Artificial Sequence
  Description of Artificial Sequence: Synthetic oligonucleotide
ugcccccauacucucuuc

SEQ ID NO: 42282 - RNA, 18 nt, Artificial Sequence
  Description of Artificial Sequence: Synthetic oligonucleotide
caacuugcccccauacuc

SEQ ID NO: 42283 - RNA, 18 nt, Artificial Sequence
  Description of Artificial Sequence: Synthetic oligonucleotide
gcuaacaacuugccccca

SEQ ID NO: 42284 - RNA, 18 nt, Artificial Sequence
  Description of Artificial Sequence: Synthetic oligonucleotide
auccagcuaacaacuugc

SEQ ID NO: 42285 - RNA, 18 nt, Artificial Sequence
  Description of Artificial Sequence: Synthetic oligonucleotide
uaucuauccagcuaacaa

SEQ ID NO: 42286 - RNA, 18 nt, Artificial Sequence
  Description of Artificial Sequence: Synthetic oligonucleotide
aguccuaucuauccagcu

SEQ ID NO: 42287 - RNA, 18 nt, Artificial Sequence
  Description of Artificial Sequence: Synthetic oligonucleotide
agcacaguccuaucuauc

SEQ ID NO: 42288 - RNA, 18 nt, Artificial Sequence
  Description of Artificial Sequence: Synthetic oligonucleotide
gucaaagcacaguccuau

SEQ ID NO: 42289 - RNA, 18 nt, Artificial Sequence
  Description of Artificial Sequence: Synthetic oligonucleotide
gaggugucaaagcacagu

SEQ ID NO: 42290 - RNA, 18 nt, Artificial Sequence
  Description of Artificial Sequence: Synthetic oligonucleotide
ccacagaggugucaaagc

SEQ ID NO: 42291 - RNA, 18 nt, Artificial Sequence
  Description of Artificial Sequence: Synthetic oligonucleotide
auagaccacagagguguc

SEQ ID NO: 42292 - RNA, 18 nt, Artificial Sequence
  Description of Artificial Sequence: Synthetic oligonucleotide
agaucauagaccacagag

SEQ ID NO: 42293 - RNA, 18 nt, Artificial Sequence
  Description of Artificial Sequence: Synthetic oligonucleotide
uucagagaucauagacca

SEQ ID NO: 42294 - RNA, 18 nt, Artificial Sequence
  Description of Artificial Sequence: Synthetic oligonucleotide
ccagguucagagaucaua

SEQ ID NO: 42295 - RNA, 18 nt, Artificial Sequence
  Description of Artificial Sequence: Synthetic oligonucleotide
cuauuccagguucagaga

SEQ ID NO: 42296 - RNA, 18 nt, Artificial Sequence
  Description of Artificial Sequence: Synthetic oligonucleotide
gaacccuauuccagguuc

SEQ ID NO: 42297 - RNA, 18 nt, Artificial Sequence
  Description of Artificial Sequence: Synthetic oligonucleotide
aaaaugaacccuauucca

SEQ ID NO: 42298 - RNA, 18 nt, Artificial Sequence
  Description of Artificial Sequence: Synthetic oligonucleotide
cuauuaaaaugaacccua

SEQ ID NO: 42299 - RNA, 18 nt, Artificial Sequence
  Description of Artificial Sequence: Synthetic oligonucleotide
uaucgcuauuaaaaugaa

SEQ ID NO: 42300 - RNA, 18 nt, Artificial Sequence
  Description of Artificial Sequence: Synthetic oligonucleotide
gacuuuaucgcuauuaaa

SEQ ID NO: 42301 - RNA, 18 nt, Artificial Sequence
  Description of Artificial Sequence: Synthetic oligonucleotide
auaaugacuuuaucgcua

SEQ ID NO: 42302 - RNA, 18 nt, Artificial Sequence
  Description of Artificial Sequence: Synthetic oligonucleotide
cugggauaaugacuuuau

SEQ ID NO: 42303 - RNA, 18 nt, Artificial Sequence
  Description of Artificial Sequence: Synthetic oligonucleotide
augcacugggauaaugac

SEQ ID NO: 42304 - RNA, 18 nt, Artificial Sequence
  Description of Artificial Sequence: Synthetic oligonucleotide
uuuggaugcacugggaua

SEQ ID NO: 42305 - RNA, 18 nt, Artificial Sequence
  Description of Artificial Sequence: Synthetic oligonucleotide
aucaauuuggaugcacug

SEQ ID NO: 42306 - RNA, 18 nt, Artificial Sequence
  Description of Artificial Sequence: Synthetic oligonucleotide
aacuaaucaauuuggaug

SEQ ID NO: 42307 - RNA, 18 nt, Artificial Sequence
  Description of Artificial Sequence: Synthetic oligonucleotide
gcaugaacuaaucaauuu

SEQ ID NO: 42308 - RNA, 18 nt, Artificial Sequence
  Description of Artificial Sequence: Synthetic oligonucleotide
auaaagcaugaacuaauc

SEQ ID NO: 42309 - RNA, 18 nt, Artificial Sequence
  Description of Artificial Sequence: Synthetic oligonucleotide
uccuaauaaagcaugaac

SEQ ID NO: 42310 - RNA, 18 nt, Artificial Sequence
  Description of Artificial Sequence: Synthetic oligonucleotide
cuguuuccuaauaaagca

SEQ ID NO: 42311 - RNA, 18 nt, Artificial Sequence
  Description of Artificial Sequence: Synthetic oligonucleotide
aacuucuguuuccuaaua

SEQ ID NO: 42312 - RNA, 18 nt, Artificial Sequence
  Description of Artificial Sequence: Synthetic oligonucleotide
uggguaacuucuguuucc

SEQ ID NO: 42313 - RNA, 18 nt, Artificial Sequence
  Description of Artificial Sequence: Synthetic oligonucleotide
aguuuuggguaacuucug

SEQ ID NO: 42314 - RNA, 18 nt, Artificial Sequence
  Description of Artificial Sequence: Synthetic oligonucleotide
ugcuaaguuuuggguaac

SEQ ID NO: 42315 - RNA, 18 nt, Artificial Sequence
  Description of Artificial Sequence: Synthetic oligonucleotide
agguuugcuaaguuuugg

SEQ ID NO: 42316 - RNA, 18 nt, Artificial Sequence
  Description of Artificial Sequence: Synthetic oligonucleotide
uacuuagguuugcuaagu

SEQ ID NO: 42317 - RNA, 18 nt, Artificial Sequence
  Description of Artificial Sequence: Synthetic oligonucleotide
cuugguacuuagguuugc

SEQ ID NO: 42318 - RNA, 18 nt, Artificial Sequence
  Description of Artificial Sequence: Synthetic oligonucleotide
ggauacuugguacuuagg

SEQ ID NO: 42319 - RNA, 18 nt, Artificial Sequence
  Description of Artificial Sequence: Synthetic oligonucleotide
guuuuggauacuugguac

SEQ ID NO: 42320 - RNA, 18 nt, Artificial Sequence
  Description of Artificial Sequence: Synthetic oligonucleotide
agaauguuuuggauacuu

SEQ ID NO: 42321 - RNA, 18 nt, Artificial Sequence
  Description of Artificial Sequence: Synthetic oligonucleotide
ggaaaagaauguuuugga

SEQ ID NO: 42322 - RNA, 18 nt, Artificial Sequence
  Description of Artificial Sequence: Synthetic oligonucleotide
guguaggaaaagaauguu

SEQ ID NO: 42323 - RNA, 18 nt, Artificial Sequence
  Description of Artificial Sequence: Synthetic oligonucleotide
acauuguguaggaaaaga

SEQ ID NO: 42324 - RNA, 18 nt, Artificial Sequence
  Description of Artificial Sequence: Synthetic oligonucleotide
cccaaacauuguguagga

SEQ ID NO: 42325 - RNA, 18 nt, Artificial Sequence
  Description of Artificial Sequence: Synthetic oligonucleotide
aauaccccaaacauugug

SEQ ID NO: 42326 - RNA, 18 nt, Artificial Sequence
  Description of Artificial Sequence: Synthetic oligonucleotide
uugacaauaccccaaaca

SEQ ID NO: 42327 - RNA, 18 nt, Artificial Sequence
  Description of Artificial Sequence: Synthetic oligonucleotide
caacuuugacaauacccc

SEQ ID NO: 42328 - RNA, 18 nt, Artificial Sequence
  Description of Artificial Sequence: Synthetic oligonucleotide
caauccaacuuugacaau

SEQ ID NO: 42329 - RNA, 18 nt, Artificial Sequence
  Description of Artificial Sequence: Synthetic oligonucleotide
ugaaucaauccaacuuug

SEQ ID NO: 42330 - RNA, 18 nt, Artificial Sequence
  Description of Artificial Sequence: Synthetic oligonucleotide
gcuggugaaucaauccaa

SEQ ID NO: 42331 - RNA, 18 nt, Artificial Sequence
  Description of Artificial Sequence: Synthetic oligonucleotide
gacuggcuggugaaucaa

SEQ ID NO: 42332 - RNA, 18 nt, Artificial Sequence
  Description of Artificial Sequence: Synthetic oligonucleotide
auuaagacuggcugguga

SEQ ID NO: 42333 - RNA, 18 nt, Artificial Sequence
  Description of Artificial Sequence: Synthetic oligonucleotide
agccaauuaagacuggcu

SEQ ID NO: 42334 - RNA, 18 nt, Artificial Sequence
  Description of Artificial Sequence: Synthetic oligonucleotide
uuaguagccaauuaagac

SEQ ID NO: 42335 - RNA, 18 nt, Artificial Sequence
  Description of Artificial Sequence: Synthetic oligonucleotide
aaccauuaguagccaauu

SEQ ID NO: 42336 - RNA, 18 nt, Artificial Sequence
  Description of Artificial Sequence: Synthetic oligonucleotide
ggcugaaccauuaguagc

SEQ ID NO: 42337 - RNA, 18 nt, Artificial Sequence
  Description of Artificial Sequence: Synthetic oligonucleotide
aaacaggcugaaccauua

SEQ ID NO: 42338 - RNA, 18 nt, Artificial Sequence
  Description of Artificial Sequence: Synthetic oligonucleotide
ggagaaaacaggcugaac

SEQ ID NO: 42339 - RNA, 18 nt, Artificial Sequence
  Description of Artificial Sequence: Synthetic oligonucleotide
cuuuaggagaaaacaggc

SEQ ID NO: 42340 - RNA, 18 nt, Artificial Sequence
  Description of Artificial Sequence: Synthetic oligonucleotide
aaccucuuuaggagaaaa

SEQ ID NO: 42341 - RNA, 18 nt, Artificial Sequence
  Description of Artificial Sequence: Synthetic oligonucleotide
aaacaaaccucuuuagga

SEQ ID NO: 42342 - RNA, 18 nt, Artificial Sequence
  Description of Artificial Sequence: Synthetic oligonucleotide
acauuaaacaaaccucuu

SEQ ID NO: 42343 - RNA, 18 nt, Artificial Sequence
  Description of Artificial Sequence: Synthetic oligonucleotide
aucugacauuaaacaaac

SEQ ID NO: 42344 - RNA, 18 nt, Artificial Sequence
  Description of Artificial Sequence: Synthetic oligonucleotide
uuaucaucugacauuaaa

SEQ ID NO: 42345 - RNA, 18 nt, Artificial Sequence
  Description of Artificial Sequence: Synthetic oligonucleotide
uacaauuaucaucugaca

SEQ ID NO: 42346 - RNA, 18 nt, Artificial Sequence
  Description of Artificial Sequence: Synthetic oligonucleotide
aucuguacaauuaucauc

SEQ ID NO: 42347 - RNA, 18 nt, Artificial Sequence
  Description of Artificial Sequence: Synthetic oligonucleotide
aacauaucuguacaauua

SEQ ID NO: 42348 - RNA, 18 nt, Artificial Sequence
  Description of Artificial Sequence: Synthetic oligonucleotide
ucccaaacauaucuguac

SEQ ID NO: 42349 - RNA, 18 nt, Artificial Sequence
  Description of Artificial Sequence: Synthetic oligonucleotide
cuuccacuucgcuuccaa

SEQ ID NO: 42350 - RNA, 18 nt, Artificial Sequence
  Description of Artificial Sequence: Synthetic oligonucleotide
cagugcuuccacuucgcu

SEQ ID NO: 42351 - RNA, 18 nt, Artificial Sequence
  Description of Artificial Sequence: Synthetic oligonucleotide
agguucagugcuuccacu

SEQ ID NO: 42352 - RNA, 18 nt, Artificial Sequence
  Description of Artificial Sequence: Synthetic oligonucleotide
ccuggagguucagugcuu

SEQ ID NO: 42353 - RNA, 18 nt, Artificial Sequence
  Description of Artificial Sequence: Synthetic oligonucleotide
ugucaccuggagguucag

SEQ ID NO: 42354 - RNA, 18 nt, Artificial Sequence
  Description of Artificial Sequence: Synthetic oligonucleotide
agagaugucaccuggagg

SEQ ID NO: 42355 - RNA, 18 nt, Artificial Sequence
  Description of Artificial Sequence: Synthetic oligonucleotide
uaaacagagaugucaccu

SEQ ID NO: 42356 - RNA, 18 nt, Artificial Sequence
  Description of Artificial Sequence: Synthetic oligonucleotide
cuccuuaaacagagaugu

SEQ ID NO: 42357 - RNA, 18 nt, Artificial Sequence
  Description of Artificial Sequence: Synthetic oligonucleotide
ugaagcuccuuaaacaga

SEQ ID NO: 42358 - RNA, 18 nt, Artificial Sequence
  Description of Artificial Sequence: Synthetic oligonucleotide
ccucuugaagcuccuuaa

SEQ ID NO: 42359 - RNA, 18 nt, Artificial Sequence
  Description of Artificial Sequence: Synthetic oligonucleotide
augagccucuugaagcuc

SEQ ID NO: 42360 - RNA, 18 nt, Artificial Sequence
  Description of Artificial Sequence: Synthetic oligonucleotide
uuuguaugagccucuuga

SEQ ID NO: 42361 - RNA, 18 nt, Artificial Sequence
  Description of Artificial Sequence: Synthetic oligonucleotide
ugaguuuuguaugagccu

SEQ ID NO: 42362 - RNA, 18 nt, Artificial Sequence
  Description of Artificial Sequence: Synthetic oligonucleotide
uuugcugaguuuuguaug

SEQ ID NO: 42363 - RNA, 18 nt, Artificial Sequence
  Description of Artificial Sequence: Synthetic oligonucleotide
ucagcuuugcugaguuuu

SEQ ID NO: 42364 - RNA, 18 nt, Artificial Sequence
  Description of Artificial Sequence: Synthetic oligonucleotide
uuagcucagcuuugcuga

SEQ ID NO: 42365 - RNA, 18 nt, Artificial Sequence
  Description of Artificial Sequence: Synthetic oligonucleotide
cuucauuagcucagcuuu

SEQ ID NO: 42366 - RNA, 18 nt, Artificial Sequence
  Description of Artificial Sequence: Synthetic oligonucleotide
cucuucuucauuagcuca

SEQ ID NO: 42367 - RNA, 18 nt, Artificial Sequence
  Description of Artificial Sequence: Synthetic oligonucleotide
gaagucucuucuucauua

SEQ ID NO: 42368 - RNA, 18 nt, Artificial Sequence
  Description of Artificial Sequence: Synthetic oligonucleotide
uucuugaagucucuucuu

SEQ ID NO: 42369 - RNA, 18 nt, Artificial Sequence
  Description of Artificial Sequence: Synthetic oligonucleotide
caguggcccagcugucuc

SEQ ID NO: 42370 - RNA, 18 nt, Artificial Sequence
  Description of Artificial Sequence: Synthetic oligonucleotide
acugccaguggcccagcu

SEQ ID NO: 42371 - RNA, 18 nt, Artificial Sequence
  Description of Artificial Sequence: Synthetic oligonucleotide
cccucacugccaguggcc

SEQ ID NO: 42372 - RNA, 18 nt, Artificial Sequence
  Description of Artificial Sequence: Synthetic oligonucleotide
acucucccucacugccag

SEQ ID NO: 42373 - RNA, 18 nt, Artificial Sequence
  Description of Artificial Sequence: Synthetic oligonucleotide
uccucacucucccucacu

SEQ ID NO: 42374 - RNA, 18 nt, Artificial Sequence
  Description of Artificial Sequence: Synthetic oligonucleotide
ugccauccucacucuccc

SEQ ID NO: 42375 - RNA, 18 nt, Artificial Sequence
  Description of Artificial Sequence: Synthetic oligonucleotide
gucucugccauccucacu

SEQ ID NO: 42376 - RNA, 18 nt, Artificial Sequence
  Description of Artificial Sequence: Synthetic oligonucleotide
cacuggucucugccaucc

SEQ ID NO: 42377 - RNA, 18 nt, Artificial Sequence
  Description of Artificial Sequence: Synthetic oligonucleotide
cagggcacuggucucugc

SEQ ID NO: 42378 - RNA, 18 nt, Artificial Sequence
  Description of Artificial Sequence: Synthetic oligonucleotide
gugggcagggcacugguc

SEQ ID NO: 42379 - RNA, 18 nt, Artificial Sequence
  Description of Artificial Sequence: Synthetic oligonucleotide
agccagugggcagggcac

SEQ ID NO: 42380 - RNA, 18 nt, Artificial Sequence
  Description of Artificial Sequence: Synthetic oligonucleotide
cccgaagccagugggcag

SEQ ID NO: 42381 - RNA, 18 nt, Artificial Sequence
  Description of Artificial Sequence: Synthetic oligonucleotide
agcuccccgaagccagug

SEQ ID NO: 42382 - RNA, 18 nt, Artificial Sequence
  Description of Artificial Sequence: Synthetic oligonucleotide
ccucgagcuccccgaagc

SEQ ID NO: 42383 - RNA, 18 nt, Artificial Sequence
  Description of Artificial Sequence: Synthetic oligonucleotide
cagcaccucgagcucccc

SEQ ID NO: 42384 - RNA, 18 nt, Artificial Sequence
  Description of Artificial Sequence: Synthetic oligonucleotide
acagccagcaccucgagc

SEQ ID NO: 42385 - RNA, 18 nt, Artificial Sequence
  Description of Artificial Sequence: Synthetic oligonucleotide
uccccacagccagcaccu

SEQ ID NO: 42386 - RNA, 18 nt, Artificial Sequence
  Description of Artificial Sequence: Synthetic oligonucleotide
caccauccccacagccag

SEQ ID NO: 42387 - RNA, 18 nt, Artificial Sequence
  Description of Artificial Sequence: Synthetic oligonucleotide
aguagcaccauccccaca

SEQ ID NO: 42388 - RNA, 18 nt, Artificial Sequence
  Description of Artificial Sequence: Synthetic oligonucleotide
ccaccaguagcaccaucc

SEQ ID NO: 42389 - RNA, 18 nt, Artificial Sequence
  Description of Artificial Sequence: Synthetic oligonucleotide
accccagguucugccugg

SEQ ID NO: 42390 - RNA, 18 nt, Artificial Sequence
  Description of Artificial Sequence: Synthetic oligonucleotide
gcugcaccccagguucug

SEQ ID NO: 42391 - RNA, 18 nt, Artificial Sequence
  Description of Artificial Sequence: Synthetic oligonucleotide
cccccgcugcaccccagg

SEQ ID NO: 42392 - RNA, 18 nt, Artificial Sequence
  Description of Artificial Sequence: Synthetic oligonucleotide
cugggcccccgcugcacc

SEQ ID NO: 42393 - RNA, 18 nt, Artificial Sequence
  Description of Artificial Sequence: Synthetic oligonucleotide
acccacugggcccccgcu

SEQ ID NO: 42394 - RNA, 18 nt, Artificial Sequence
  Description of Artificial Sequence: Synthetic oligonucleotide
ucagaacccacugggccc

SEQ ID NO: 42395 - RNA, 18 nt, Artificial Sequence
  Description of Artificial Sequence: Synthetic oligonucleotide
gguccucagaacccacug

SEQ ID NO: 42396 - RNA, 18 nt, Artificial Sequence
  Description of Artificial Sequence: Synthetic oligonucleotide
gccuggguccucagaacc

SEQ ID NO: 42397 - RNA, 18 nt, Artificial Sequence
  Description of Artificial Sequence: Synthetic oligonucleotide
ugguggccuggguccuca

SEQ ID NO: 42398 - RNA, 18 nt, Artificial Sequence
  Description of Artificial Sequence: Synthetic oligonucleotide
cacacugguggccugggu

SEQ ID NO: 42399 - RNA, 18 nt, Artificial Sequence
  Description of Artificial Sequence: Synthetic oligonucleotide
agcuccacacugguggcc

SEQ ID NO: 42400 - RNA, 18 nt, Artificial Sequence
  Description of Artificial Sequence: Synthetic oligonucleotide
uugccagcuccacacugg

SEQ ID NO: 42401 - RNA, 18 nt, Artificial Sequence
  Description of Artificial Sequence: Synthetic oligonucleotide
ucuccuugccagcuccac

SEQ ID NO: 42402 - RNA, 18 nt, Artificial Sequence
  Description of Artificial Sequence: Synthetic oligonucleotide
ucuccucuccuugccagc

SEQ ID NO: 42403 - RNA, 18 nt, Artificial Sequence
  Description of Artificial Sequence: Synthetic oligonucleotide
ggaccucuccucuccuug

SEQ ID NO: 42404 - RNA, 18 nt, Artificial Sequence
  Description of Artificial Sequence: Synthetic oligonucleotide
gggaccucuccucuccuu

SEQ ID NO: 42405 - RNA, 18 nt, Artificial Sequence
  Description of Artificial Sequence: Synthetic oligonucleotide
cacccagcuggguuuggg

SEQ ID NO: 42406 - RNA, 18 nt, Artificial Sequence
  Description of Artificial Sequence: Synthetic oligonucleotide
ccggacacccagcugggu

SEQ ID NO: 42407 - RNA, 18 nt, Artificial Sequence
  Description of Artificial Sequence: Synthetic oligonucleotide
ugggaccggacacccagc

SEQ ID NO: 42408 - RNA, 18 nt, Artificial Sequence
  Description of Artificial Sequence: Synthetic oligonucleotide
gccaaugggaccggacac

SEQ ID NO: 42409 - RNA, 18 nt, Artificial Sequence
  Description of Artificial Sequence: Synthetic oligonucleotide
aggcagccaaugggaccg

SEQ ID NO: 42410 - RNA, 18 nt, Artificial Sequence
  Description of Artificial Sequence: Synthetic oligonucleotide
gggaaggcagccaauggg

SEQ ID NO: 42411 - RNA, 18 nt, Artificial Sequence
  Description of Artificial Sequence: Synthetic oligonucleotide
gaguccgggcacagaggg

SEQ ID NO: 42412 - RNA, 18 nt, Artificial Sequence
  Description of Artificial Sequence: Synthetic oligonucleotide
cccccgaguccgggcaca

SEQ ID NO: 42413 - RNA, 18 nt, Artificial Sequence
  Description of Artificial Sequence: Synthetic oligonucleotide
aacaccccccgaguccgg

SEQ ID NO: 42414 - RNA, 18 nt, Artificial Sequence
  Description of Artificial Sequence: Synthetic oligonucleotide
gucagaacaccccccgag

SEQ ID NO: 42415 - RNA, 18 nt, Artificial Sequence
  Description of Artificial Sequence: Synthetic oligonucleotide
caauugucagaacacccc

SEQ ID NO: 42416 - RNA, 18 nt, Artificial Sequence
  Description of Artificial Sequence: Synthetic oligonucleotide
agguucaauugucagaac

SEQ ID NO: 42417 - RNA, 18 nt, Artificial Sequence
  Description of Artificial Sequence: Synthetic oligonucleotide
cucacagguucaauuguc

SEQ ID NO: 42418 - RNA, 18 nt, Artificial Sequence
  Description of Artificial Sequence: Synthetic oligonucleotide
ugcaccucacagguucaa

SEQ ID NO: 42419 - RNA, 18 nt, Artificial Sequence
  Description of Artificial Sequence: Synthetic oligonucleotide
ugugcugcaccucacagg

SEQ ID NO: 42420 - RNA, 18 nt, Artificial Sequence
  Description of Artificial Sequence: Synthetic oligonucleotide
ggcagugugcugcaccuc

SEQ ID NO: 42421 - RNA, 18 nt, Artificial Sequence
  Description of Artificial Sequence: Synthetic oligonucleotide
cagcgggcagugugcugc

SEQ ID NO: 42422 - RNA, 18 nt, Artificial Sequence
  Description of Artificial Sequence: Synthetic oligonucleotide
gcucccagcgggcagugu

SEQ ID NO: 42423 - RNA, 18 nt, Artificial Sequence
  Description of Artificial Sequence: Synthetic oligonucleotide
ucucugcucccagcgggc

SEQ ID NO: 42424 - RNA, 18 nt, Artificial Sequence
  Description of Artificial Sequence: Synthetic oligonucleotide
cuuccucucugcucccag

SEQ ID NO: 42425 - RNA, 18 nt, Artificial Sequence
  Description of Artificial Sequence: Synthetic oligonucleotide
ccuggcuuccucucugcu

SEQ ID NO: 42426 - RNA, 18 nt, Artificial Sequence
  Description of Artificial Sequence: Synthetic oligonucleotide
ccuugccuggcuuccucu

SEQ ID NO: 42427 - RNA, 18 nt, Artificial Sequence
  Description of Artificial Sequence: Synthetic oligonucleotide
cugacccuugccuggcuu

SEQ ID NO: 42428 - RNA, 18 nt, Artificial Sequence
  Description of Artificial Sequence: Synthetic oligonucleotide
ccucccugacccuugccu

SEQ ID NO: 42429 - RNA, 18 nt, Artificial Sequence
  Description of Artificial Sequence: Synthetic oligonucleotide
cccucccucccugacccu

SEQ ID NO: 42430 - RNA, 18 nt, Artificial Sequence
  Description of Artificial Sequence: Synthetic oligonucleotide
aaagucccucccucccug

SEQ ID NO: 42431 - RNA, 18 nt, Artificial Sequence
  Description of Artificial Sequence: Synthetic oligonucleotide
cuuucaaagucccucccu

SEQ ID NO: 42432 - RNA, 18 nt, Artificial Sequence
  Description of Artificial Sequence: Synthetic oligonucleotide
guccccuuucaaaguccc

SEQ ID NO: 42433 - RNA, 18 nt, Artificial Sequence
  Description of Artificial Sequence: Synthetic oligonucleotide
cagauguccccuuucaaa

SEQ ID NO: 42434 - RNA, 18 nt, Artificial Sequence
  Description of Artificial Sequence: Synthetic oligonucleotide
cugggcagauguccccuu

SEQ ID NO: 42435 - RNA, 18 nt, Artificial Sequence
  Description of Artificial Sequence: Synthetic oligonucleotide
aucuccugggcagauguc

SEQ ID NO: 42436 - RNA, 18 nt, Artificial Sequence
  Description of Artificial Sequence: Synthetic oligonucleotide
ugaucaucuccugggcag

SEQ ID NO: 42437 - RNA, 18 nt, Artificial Sequence
  Description of Artificial Sequence: Synthetic oligonucleotide
gcucuugaucaucuccug

SEQ ID NO: 42438 - RNA, 18 nt, Artificial Sequence
  Description of Artificial Sequence: Synthetic oligonucleotide
gccuggcucuugaucauc

SEQ ID NO: 42439 - RNA, 18 nt, Artificial Sequence
  Description of Artificial Sequence: Synthetic oligonucleotide
cuaaagccuggcucuuga

SEQ ID NO: 42440 - RNA, 18 nt, Artificial Sequence
  Description of Artificial Sequence: Synthetic oligonucleotide
aaguccuaaagccuggcu

SEQ ID NO: 42441 - RNA, 18 nt, Artificial Sequence
  Description of Artificial Sequence: Synthetic oligonucleotide
augaaaaguccuaaagcc

SEQ ID NO: 42442 - RNA, 18 nt, Artificial Sequence
  Description of Artificial Sequence: Synthetic oligonucleotide
gggacaugaaaaguccua

SEQ ID NO: 42443 - RNA, 18 nt, Artificial Sequence
  Description of Artificial Sequence: Synthetic oligonucleotide
cuggagggacaugaaaag

SEQ ID NO: 42444 - RNA, 18 nt, Artificial Sequence
  Description of Artificial Sequence: Synthetic oligonucleotide
cccggcuggagggacaug

SEQ ID NO: 42445 - RNA, 18 nt, Artificial Sequence
  Description of Artificial Sequence: Synthetic oligonucleotide
uuucucccggcuggaggg

SEQ ID NO: 42446 - RNA, 18 nt, Artificial Sequence
  Description of Artificial Sequence: Synthetic oligonucleotide
uaaauuuucucccggcug

SEQ ID NO: 42447 - RNA, 18 nt, Artificial Sequence
  Description of Artificial Sequence: Synthetic oligonucleotide
uggauuaaauuuucuccc

SEQ ID NO: 42448 - RNA, 18 nt, Artificial Sequence
  Description of Artificial Sequence: Synthetic oligonucleotide
aggaguggauuaaauuuu

SEQ ID NO: 42449 - RNA, 18 nt, Artificial Sequence
  Description of Artificial Sequence: Synthetic oligonucleotide
uuccaaggaguggauuaa

SEQ ID NO: 42450 - RNA, 18 nt, Artificial Sequence
  Description of Artificial Sequence: Synthetic oligonucleotide
aggauuuccaaggagugg

SEQ ID NO: 42451 - RNA, 18 nt, Artificial Sequence
  Description of Artificial Sequence: Synthetic oligonucleotide
ucagcaggauuuccaagg

SEQ ID NO: 42452 - RNA, 18 nt, Artificial Sequence
  Description of Artificial Sequence: Synthetic oligonucleotide
gauucucagcaggauuuc

SEQ ID NO: 42453 - RNA, 18 nt, Artificial Sequence
  Description of Artificial Sequence: Synthetic oligonucleotide
ugugggauucucagcagg

SEQ ID NO: 42454 - RNA, 18 nt, Artificial Sequence
  Description of Artificial Sequence: Synthetic oligonucleotide
ucuuaugugggauucuca

SEQ ID NO: 42455 - RNA, 18 nt, Artificial Sequence
  Description of Artificial Sequence: Synthetic oligonucleotide
acugaucuuaugugggau

SEQ ID NO: 42456 - RNA, 18 nt, Artificial Sequence
  Description of Artificial Sequence: Synthetic oligonucleotide
gggacugaucuuaugugg

SEQ ID NO: 42457 - RNA, 18 nt, Artificial Sequence
  Description of Artificial Sequence: Synthetic oligonucleotide
uccccagagccuuuuggg

SEQ ID NO: 42458 - RNA, 18 nt, Artificial Sequence
  Description of Artificial Sequence: Synthetic oligonucleotide
gucuguccccagagccuu

SEQ ID NO: 42459 - RNA, 18 nt, Artificial Sequence
  Description of Artificial Sequence: Synthetic oligonucleotide
gagcugucuguccccaga

SEQ ID NO: 42460 - RNA, 18 nt, Artificial Sequence
  Description of Artificial Sequence: Synthetic oligonucleotide
aggcagagcugucugucc

SEQ ID NO: 42461 - RNA, 18 nt, Artificial Sequence
  Description of Artificial Sequence: Synthetic oligonucleotide
gcaggaggcagagcuguc

SEQ ID NO: 42462 - RNA, 18 nt, Artificial Sequence
  Description of Artificial Sequence: Synthetic oligonucleotide
caagagcaggaggcagag

SEQ ID NO: 42463 - RNA, 18 nt, Artificial Sequence
  Description of Artificial Sequence: Synthetic oligonucleotide
ccacacaagagcaggagg

SEQ ID NO: 42464 - RNA, 18 nt, Artificial Sequence
  Description of Artificial Sequence: Synthetic oligonucleotide
uccagccacacaagagca

SEQ ID NO: 42465 - RNA, 18 nt, Artificial Sequence
  Description of Artificial Sequence: Synthetic oligonucleotide
uugguuccagccacacaa

SEQ ID NO: 42466 - RNA, 18 nt, Artificial Sequence
  Description of Artificial Sequence: Synthetic oligonucleotide
gggacuugguuccagcca

SEQ ID NO: 42467 - RNA, 18 nt, Artificial Sequence
  Description of Artificial Sequence: Synthetic oligonucleotide
cugaagggacuugguucc

SEQ ID NO: 42468 - RNA, 18 nt, Artificial Sequence
  Description of Artificial Sequence: Synthetic oligonucleotide
gagagcugaagggacuug

SEQ ID NO: 42469 - RNA, 18 nt, Artificial Sequence
  Description of Artificial Sequence: Synthetic oligonucleotide
gggcagagagcugaaggg

SEQ ID NO: 42470 - RNA, 18 nt, Artificial Sequence
  Description of Artificial Sequence: Synthetic oligonucleotide
auugagggcagagagcug

SEQ ID NO: 42471 - RNA, 18 nt, Artificial Sequence
  Description of Artificial Sequence: Synthetic oligonucleotide
aaggcauugagggcagag

SEQ ID NO: 42472 - RNA, 18 nt, Artificial Sequence
  Description of Artificial Sequence: Synthetic oligonucleotide
augucaaggcauugaggg

SEQ ID NO: 42473 - RNA, 18 nt, Artificial Sequence
  Description of Artificial Sequence: Synthetic oligonucleotide
ucggaaugucaaggcauu

SEQ ID NO: 42474 - RNA, 18 nt, Artificial Sequence
  Description of Artificial Sequence: Synthetic oligonucleotide
cccauucggaaugucaag

SEQ ID NO: 42475 - RNA, 18 nt, Artificial Sequence
  Description of Artificial Sequence: Synthetic oligonucleotide
aaccacccauucggaaug

SEQ ID NO: 42476 - RNA, 18 nt, Artificial Sequence
  Description of Artificial Sequence: Synthetic oligonucleotide
uuuacaaccacccauucg

SEQ ID NO: 42477 - RNA, 18 nt, Artificial Sequence
  Description of Artificial Sequence: Synthetic oligonucleotide
uaaucuuuacaaccaccc

SEQ ID NO: 42478 - RNA, 18 nt, Artificial Sequence
  Description of Artificial Sequence: Synthetic oligonucleotide
ccauuuaaucuuuacaac

SEQ ID NO: 42479 - RNA, 18 nt, Artificial Sequence
  Description of Artificial Sequence: Synthetic oligonucleotide
uuaucccauuuaaucuuu

SEQ ID NO: 42480 - RNA, 18 nt, Artificial Sequence
  Description of Artificial Sequence: Synthetic oligonucleotide
acccauuaucccauuuaa

SEQ ID NO: 42481 - RNA, 18 nt, Artificial Sequence
  Description of Artificial Sequence: Synthetic oligonucleotide
uuuauacccauuauccca

SEQ ID NO: 42482 - RNA, 18 nt, Artificial Sequence
  Description of Artificial Sequence: Synthetic oligonucleotide
agcacuuuauacccauua

SEQ ID NO: 42483 - RNA, 18 nt, Artificial Sequence
  Description of Artificial Sequence: Synthetic oligonucleotide
accuugaauuuuggcuug

SEQ ID NO: 42484 - RNA, 18 nt, Artificial Sequence
  Description of Artificial Sequence: Synthetic oligonucleotide
acccgaccuugaauuuug

SEQ ID NO: 42485 - RNA, 18 nt, Artificial Sequence
  Description of Artificial Sequence: Synthetic oligonucleotide
gagagacccgaccuugaa

SEQ ID NO: 42486 - RNA, 18 nt, Artificial Sequence
  Description of Artificial Sequence: Synthetic oligonucleotide
caacagagagacccgacc

SEQ ID NO: 42487 - RNA, 18 nt, Artificial Sequence
  Description of Artificial Sequence: Synthetic oligonucleotide
ucuggcaacagagagacc

SEQ ID NO: 42488 - RNA, 18 nt, Artificial Sequence
  Description of Artificial Sequence: Synthetic oligonucleotide
cguacucuggcaacagag

SEQ ID NO: 42489 - RNA, 18 nt, Artificial Sequence
  Description of Artificial Sequence: Synthetic oligonucleotide
ggaagugaacaugaaggg

SEQ ID NO: 42490 - RNA, 18 nt, Artificial Sequence
  Description of Artificial Sequence: Synthetic oligonucleotide
ggcauggaagugaacaug

SEQ ID NO: 42491 - RNA, 18 nt, Artificial Sequence
  Description of Artificial Sequence: Synthetic oligonucleotide
cgccaggcauggaaguga

SEQ ID NO: 42492 - RNA, 18 nt, Artificial Sequence
  Description of Artificial Sequence: Synthetic oligonucleotide
caggacgccaggcaugga

SEQ ID NO: 42493 - RNA, 18 nt, Artificial Sequence
  Description of Artificial Sequence: Synthetic oligonucleotide
cugcccaggacgccaggc

SEQ ID NO: 42494 - RNA, 18 nt, Artificial Sequence
  Description of Artificial Sequence: Synthetic oligonucleotide
gggagcugcccaggacgc

SEQ ID NO: 42495 - RNA, 18 nt, Artificial Sequence
  Description of Artificial Sequence: Synthetic oligonucleotide
gagcugggagcugcccag

SEQ ID NO: 42496 - RNA, 18 nt, Artificial Sequence
  Description of Artificial Sequence: Synthetic oligonucleotide
uguuagagcugggagcug

SEQ ID NO: 42497 - RNA, 18 nt, Artificial Sequence
  Description of Artificial Sequence: Synthetic oligonucleotide
gucgauguuagagcuggg

SEQ ID NO: 42498 - RNA, 18 nt, Artificial Sequence
  Description of Artificial Sequence: Synthetic oligonucleotide
gaagagucgauguuagag

SEQ ID NO: 42499 - RNA, 18 nt, Artificial Sequence
  Description of Artificial Sequence: Synthetic oligonucleotide
aaggagaagagucgaugu

SEQ ID NO: 42500 - RNA, 18 nt, Artificial Sequence
  Description of Artificial Sequence: Synthetic oligonucleotide
gcuccaaggagaagaguc

SEQ ID NO: 42501 - RNA, 18 nt, Artificial Sequence
  Description of Artificial Sequence: Synthetic oligonucleotide
gagaggcuccaaggagaa

SEQ ID NO: 42502 - RNA, 18 nt, Artificial Sequence
  Description of Artificial Sequence: Synthetic oligonucleotide
agucagagaggcuccaag

SEQ ID NO: 42503 - RNA, 18 nt, Artificial Sequence
  Description of Artificial Sequence: Synthetic oligonucleotide
agcaaagucagagaggcu

SEQ ID NO: 42504 - RNA, 18 nt, Artificial Sequence
  Description of Artificial Sequence: Synthetic oligonucleotide
uguagagcaaagucagag

SEQ ID NO: 42505 - RNA, 18 nt, Artificial Sequence
  Description of Artificial Sequence: Synthetic oligonucleotide
aggacuguagagcaaagu

SEQ ID NO: 42506 - RNA, 18 nt, Artificial Sequence
  Description of Artificial Sequence: Synthetic oligonucleotide
cuccaaggacuguagagc

SEQ ID NO: 42507 - RNA, 18 nt, Artificial Sequence
  Description of Artificial Sequence: Synthetic oligonucleotide
gccuucuccaaggacugu

SEQ ID NO: 42508 - RNA, 18 nt, Artificial Sequence
  Description of Artificial Sequence: Synthetic oligonucleotide
aaaaugccuucuccaagg

SEQ ID NO: 42509 - RNA, 18 nt, Artificial Sequence
  Description of Artificial Sequence: Synthetic oligonucleotide
auuucaaaaugccuucuc

SEQ ID NO: 42510 - RNA, 18 nt, Artificial Sequence
  Description of Artificial Sequence: Synthetic oligonucleotide
uuuggauuucaaaaugcc

SEQ ID NO: 42511 - RNA, 18 nt, Artificial Sequence
  Description of Artificial Sequence: Synthetic oligonucleotide
ggccuuuuggauuucaaa

SEQ ID NO: 42512 - RNA, 18 nt, Artificial Sequence
  Description of Artificial Sequence: Synthetic oligonucleotide
auucaggccuuuuggauu

SEQ ID NO: 42513 - RNA, 18 nt, Artificial Sequence
  Description of Artificial Sequence: Synthetic oligonucleotide
cuugaauucaggccuuuu

SEQ ID NO: 42514 - RNA, 18 nt, Artificial Sequence
  Description of Artificial Sequence: Synthetic oligonucleotide
uggaacuugaauucaggc

SEQ ID NO: 42515 - RNA, 18 nt, Artificial Sequence
  Description of Artificial Sequence: Synthetic oligonucleotide
ggagcuggaacuugaauu

SEQ ID NO: 42516 - RNA, 18 nt, Artificial Sequence
  Description of Artificial Sequence: Synthetic oligonucleotide
gcgguggagcuggaacuu

SEQ ID NO: 42517 - RNA, 18 nt, Artificial Sequence
  Description of Artificial Sequence: Synthetic oligonucleotide
aguaagcgguggagcugg

SEQ ID NO: 42518 - RNA, 18 nt, Artificial Sequence
  Description of Artificial Sequence: Synthetic oligonucleotide
cagcuaguaagcggugga

SEQ ID NO: 42519 - RNA, 18 nt, Artificial Sequence
  Description of Artificial Sequence: Synthetic oligonucleotide
guacacagcuaguaagcg

SEQ ID NO: 42520 - RNA, 18 nt, Artificial Sequence
  Description of Artificial Sequence: Synthetic oligonucleotide
ccuaaguacacagcuagu

SEQ ID NO: 42521 - RNA, 18 nt, Artificial Sequence
  Description of Artificial Sequence: Synthetic oligonucleotide
cuugcccuaaguacacag

SEQ ID NO: 42522 - RNA, 18 nt, Artificial Sequence
  Description of Artificial Sequence: Synthetic oligonucleotide
gcuaacuugcccuaagua

SEQ ID NO: 42523 - RNA, 18 nt, Artificial Sequence
  Description of Artificial Sequence: Synthetic oligonucleotide
cacuagcuaacuugcccu

SEQ ID NO: 42524 - RNA, 18 nt, Artificial Sequence
  Description of Artificial Sequence: Synthetic oligonucleotide
agagacacuagcuaacuu

SEQ ID NO: 42525 - RNA, 18 nt, Artificial Sequence
  Description of Artificial Sequence: Synthetic oligonucleotide
ggcucagagacacuagcu

SEQ ID NO: 42526 - RNA, 18 nt, Artificial Sequence
  Description of Artificial Sequence: Synthetic oligonucleotide
acugaggcucagagacac

SEQ ID NO: 42527 - RNA, 18 nt, Artificial Sequence
  Description of Artificial Sequence: Synthetic oligonucleotide
gggaaacugaggcucaga

SEQ ID NO: 42528 - RNA, 18 nt, Artificial Sequence
  Description of Artificial Sequence: Synthetic oligonucleotide
uagcugggaaacugaggc

SEQ ID NO: 42529 - RNA, 18 nt, Artificial Sequence
  Description of Artificial Sequence: Synthetic oligonucleotide
auuuauagcugggaaacu

SEQ ID NO: 42530 - RNA, 18 nt, Artificial Sequence
  Description of Artificial Sequence: Synthetic oligonucleotide
ucuccauuuauagcuggg

SEQ ID NO: 42531 - RNA, 18 nt, Artificial Sequence
  Description of Artificial Sequence: Synthetic oligonucleotide
ucucuucuccauuuauag

SEQ ID NO: 42532 - RNA, 18 nt, Artificial Sequence
  Description of Artificial Sequence: Synthetic oligonucleotide
gauacucucuucuccauu

SEQ ID NO: 42533 - RNA, 18 nt, Artificial Sequence
  Description of Artificial Sequence: Synthetic oligonucleotide
acuuggauacucucuucu

SEQ ID NO: 42534 - RNA, 18 nt, Artificial Sequence
  Description of Artificial Sequence: Synthetic oligonucleotide
ucuuuacuuggauacucu

SEQ ID NO: 42535 - RNA, 18 nt, Artificial Sequence
  Description of Artificial Sequence: Synthetic oligonucleotide
uucaaucuuuacuuggau

SEQ ID NO: 42536 - RNA, 18 nt, Artificial Sequence
  Description of Artificial Sequence: Synthetic oligonucleotide
ucucauucaaucuuuacu

SEQ ID NO: 42537 - RNA, 18 nt, Artificial Sequence
  Description of Artificial Sequence: Synthetic oligonucleotide
agucaucucauucaaucu

SEQ ID NO: 42538 - RNA, 18 nt, Artificial Sequence
  Description of Artificial Sequence: Synthetic oligonucleotide
auaugagucaucucauuc

SEQ ID NO: 42539 - RNA, 18 nt, Artificial Sequence
  Description of Artificial Sequence: Synthetic oligonucleotide
acuuuauaugagucaucu

SEQ ID NO: 42540 - RNA, 18 nt, Artificial Sequence
  Description of Artificial Sequence: Synthetic oligonucleotide
uaagcacuuuauaugagu

SEQ ID NO: 42541 - RNA, 18 nt, Artificial Sequence
  Description of Artificial Sequence: Synthetic oligonucleotide
caggauaagcacuuuaua

SEQ ID NO: 42542 - RNA, 18 nt, Artificial Sequence
  Description of Artificial Sequence: Synthetic oligonucleotide
ggcaccaggauaagcacu

SEQ ID NO: 42543 - RNA, 18 nt, Artificial Sequence
  Description of Artificial Sequence: Synthetic oligonucleotide
caccaggcaccaggauaa

SEQ ID NO: 42544 - RNA, 18 nt, Artificial Sequence
  Description of Artificial Sequence: Synthetic oligonucleotide
gcacacaccaggcaccag

SEQ ID NO: 42545 - RNA, 18 nt, Artificial Sequence
  Description of Artificial Sequence: Synthetic oligonucleotide
acuuagcacacaccaggc

SEQ ID NO: 42546 - RNA, 18 nt, Artificial Sequence
  Description of Artificial Sequence: Synthetic oligonucleotide
caggcacuuagcacacac

SEQ ID NO: 42547 - RNA, 18 nt, Artificial Sequence
  Description of Artificial Sequence: Synthetic oligonucleotide
gcugccaggcacuuagca

SEQ ID NO: 42548 - RNA, 18 nt, Artificial Sequence
  Description of Artificial Sequence: Synthetic oligonucleotide
ugacagcugccaggcacu

SEQ ID NO: 42549 - RNA, 18 nt, Artificial Sequence
  Description of Artificial Sequence: Synthetic oligonucleotide
aucacugacagcugccag

SEQ ID NO: 42550 - RNA, 18 nt, Artificial Sequence
  Description of Artificial Sequence: Synthetic oligonucleotide
ucauaaucacugacagcu

SEQ ID NO: 42551 - RNA, 18 nt, Artificial Sequence
  Description of Artificial Sequence: Synthetic oligonucleotide
aacagucauaaucacuga

SEQ ID NO: 42552 - RNA, 18 nt, Artificial Sequence
  Description of Artificial Sequence: Synthetic oligonucleotide
gcuauaacagucauaauc

SEQ ID NO: 42553 - RNA, 18 nt, Artificial Sequence
  Description of Artificial Sequence: Synthetic oligonucleotide
uucaugcuauaacaguca

SEQ ID NO: 42554 - RNA, 18 nt, Artificial Sequence
  Description of Artificial Sequence: Synthetic oligonucleotide
caugcuucaugcuauaac

SEQ ID NO: 42555 - RNA, 18 nt, Artificial Sequence
  Description of Artificial Sequence: Synthetic oligonucleotide
gguagcaugcuucaugcu

SEQ ID NO: 42556 - RNA, 18 nt, Artificial Sequence
  Description of Artificial Sequence: Synthetic oligonucleotide
uauaggguagcaugcuuc

SEQ ID NO: 42557 - RNA, 18 nt, Artificial Sequence
  Description of Artificial Sequence: Synthetic oligonucleotide
aucaauauaggguagcau

SEQ ID NO: 42558 - RNA, 18 nt, Artificial Sequence
  Description of Artificial Sequence: Synthetic oligonucleotide
agacaaucaauauagggu

SEQ ID NO: 42559 - RNA, 18 nt, Artificial Sequence
  Description of Artificial Sequence: Synthetic oligonucleotide
aaggaagacaaucaauau

SEQ ID NO: 42560 - RNA, 18 nt, Artificial Sequence
  Description of Artificial Sequence: Synthetic oligonucleotide
cagacaaggaagacaauc

SEQ ID NO: 42561 - RNA, 18 nt, Artificial Sequence
  Description of Artificial Sequence: Synthetic oligonucleotide
cuggacagacaaggaaga

SEQ ID NO: 42562 - RNA, 18 nt, Artificial Sequence
  Description of Artificial Sequence: Synthetic oligonucleotide
accuccuggacagacaag

SEQ ID NO: 42563 - RNA, 18 nt, Artificial Sequence
  Description of Artificial Sequence: Synthetic oligonucleotide
cagcaaccuccuggacag

SEQ ID NO: 42564 - RNA, 18 nt, Artificial Sequence
  Description of Artificial Sequence: Synthetic oligonucleotide
aacaucagcaaccuccug

SEQ ID NO: 42565 - RNA, 18 nt, Artificial Sequence
  Description of Artificial Sequence: Synthetic oligonucleotide
gauggaacaucagcaacc

SEQ ID NO: 42566 - RNA, 18 nt, Artificial Sequence
  Description of Artificial Sequence: Synthetic oligonucleotide
ggguggauggaacaucag

SEQ ID NO: 42567 - RNA, 18 nt, Artificial Sequence
  Description of Artificial Sequence: Synthetic oligonucleotide
cagaacaguguguguggg

SEQ ID NO: 42568 - RNA, 18 nt, Artificial Sequence
  Description of Artificial Sequence: Synthetic oligonucleotide
gggucagaacagugugug

SEQ ID NO: 42569 - RNA, 18 nt, Artificial Sequence
  Description of Artificial Sequence: Synthetic oligonucleotide
ugcugaggcccagcuggg

SEQ ID NO: 42570 - RNA, 18 nt, Artificial Sequence
  Description of Artificial Sequence: Synthetic oligonucleotide
gcugcugaggcccagcug

SEQ ID NO: 42571 - RNA, 18 nt, Artificial Sequence
  Description of Artificial Sequence: Synthetic oligonucleotide
aggcugagaccggagaga

SEQ ID NO: 42572 - RNA, 18 nt, Artificial Sequence
  Description of Artificial Sequence: Synthetic oligonucleotide
uauugaggcugagaccgg

SEQ ID NO: 42573 - RNA, 18 nt, Artificial Sequence
  Description of Artificial Sequence: Synthetic oligonucleotide
caggguauugaggcugag

SEQ ID NO: 42574 - RNA, 18 nt, Artificial Sequence
  Description of Artificial Sequence: Synthetic oligonucleotide
auggucaggguauugagg

SEQ ID NO: 42575 - RNA, 18 nt, Artificial Sequence
  Description of Artificial Sequence: Synthetic oligonucleotide
agaagauggucaggguau

SEQ ID NO: 42576 - RNA, 18 nt, Artificial Sequence
  Description of Artificial Sequence: Synthetic oligonucleotide
gaaagagaagauggucag

SEQ ID NO: 42577 - RNA, 18 nt, Artificial Sequence
  Description of Artificial Sequence: Synthetic oligonucleotide
uugcagaaagagaagaug

SEQ ID NO: 42578 - RNA, 18 nt, Artificial Sequence
  Description of Artificial Sequence: Synthetic oligonucleotide
gggucuugcagaaagaga

SEQ ID NO: 42579 - RNA, 18 nt, Artificial Sequence
  Description of Artificial Sequence: Synthetic oligonucleotide
gcagggaguccgcagcuc

SEQ ID NO: 42580 - RNA, 18 nt, Artificial Sequence
  Description of Artificial Sequence: Synthetic oligonucleotide
agguggcagggaguccgc

SEQ ID NO: 42581 - RNA, 18 nt, Artificial Sequence
  Description of Artificial Sequence: Synthetic oligonucleotide
ccaguagguggcagggag

SEQ ID NO: 42582 - RNA, 18 nt, Artificial Sequence
  Description of Artificial Sequence: Synthetic oligonucleotide
cagcaccaguagguggca

SEQ ID NO: 42583 - RNA, 18 nt, Artificial Sequence
  Description of Artificial Sequence: Synthetic oligonucleotide
aagcucagcaccaguagg

SEQ ID NO: 42584 - RNA, 18 nt, Artificial Sequence
  Description of Artificial Sequence: Synthetic oligonucleotide
gagccaagcucagcacca

SEQ ID NO: 42585 - RNA, 18 nt, Artificial Sequence
  Description of Artificial Sequence: Synthetic oligonucleotide
cgcaagagccaagcucag

SEQ ID NO: 42586 - RNA, 18 nt, Artificial Sequence
  Description of Artificial Sequence: Synthetic oligonucleotide
cuguccgcaagagccaag

SEQ ID NO: 42587 - RNA, 18 nt, Artificial Sequence
  Description of Artificial Sequence: Synthetic oligonucleotide
ucccacuguccgcaagag

SEQ ID NO: 42588 - RNA, 18 nt, Artificial Sequence
  Description of Artificial Sequence: Synthetic oligonucleotide
gcugaucccacuguccgc

SEQ ID NO: 42589 - RNA, 18 nt, Artificial Sequence
  Description of Artificial Sequence: Synthetic oligonucleotide
uucaggcugaucccacug

SEQ ID NO: 42590 - RNA, 18 nt, Artificial Sequence
  Description of Artificial Sequence: Synthetic oligonucleotide
gggcauucaggcugaucc

SEQ ID NO: 42591 - RNA, 18 nt, Artificial Sequence
  Description of Artificial Sequence: Synthetic oligonucleotide
aacgagggcauucaggcu

SEQ ID NO: 42592 - RNA, 18 nt, Artificial Sequence
  Description of Artificial Sequence: Synthetic oligonucleotide
gcugcaacgagggcauuc

SEQ ID NO: 42593 - RNA, 18 nt, Artificial Sequence
  Description of Artificial Sequence: Synthetic oligonucleotide
auguggcugcaacgaggg

SEQ ID NO: 42594 - RNA, 18 nt, Artificial Sequence
  Description of Artificial Sequence: Synthetic oligonucleotide
gcuggauguggcugcaac

SEQ ID NO: 42595 - RNA, 18 nt, Artificial Sequence
  Description of Artificial Sequence: Synthetic oligonucleotide
agaaggcuggauguggcu

SEQ ID NO: 42596 - RNA, 18 nt, Artificial Sequence
  Description of Artificial Sequence: Synthetic oligonucleotide
aggcugagaccggagaga

SEQ ID NO: 42597 - RNA, 18 nt, Artificial Sequence
  Description of Artificial Sequence: Synthetic oligonucleotide
uauugaggcugagaccgg

SEQ ID NO: 42598 - RNA, 18 nt, Artificial Sequence
  Description of Artificial Sequence: Synthetic oligonucleotide
caggguauugaggcugag

SEQ ID NO: 42599 - RNA, 18 nt, Artificial Sequence
  Description of Artificial Sequence: Synthetic oligonucleotide
auggucaggguauugagg

SEQ ID NO: 42600 - RNA, 18 nt, Artificial Sequence
  Description of Artificial Sequence: Synthetic oligonucleotide
agaagauggucaggguau

SEQ ID NO: 42601 - RNA, 18 nt, Artificial Sequence
  Description of Artificial Sequence: Synthetic oligonucleotide
gaaagagaagauggucag

SEQ ID NO: 42602 - RNA, 18 nt, Artificial Sequence
  Description of Artificial Sequence: Synthetic oligonucleotide
uugcagaaagagaagaug

SEQ ID NO: 42603 - RNA, 18 nt, Artificial Sequence
  Description of Artificial Sequence: Synthetic oligonucleotide
gggucuugcagaaagaga

SEQ ID NO: 42604 - RNA, 18 nt, Artificial Sequence
  Description of Artificial Sequence: Synthetic oligonucleotide
ggaguccgcagcuccggg

SEQ ID NO: 42605 - RNA, 18 nt, Artificial Sequence
  Description of Artificial Sequence: Synthetic oligonucleotide
gcagggaguccgcagcuc

SEQ ID NO: 42606 - RNA, 18 nt, Artificial Sequence
  Description of Artificial Sequence: Synthetic oligonucleotide
agguggcagggaguccgc

SEQ ID NO: 42607 - RNA, 18 nt, Artificial Sequence
  Description of Artificial Sequence: Synthetic oligonucleotide
ccaguagguggcagggag

SEQ ID NO: 42608 - RNA, 18 nt, Artificial Sequence
  Description of Artificial Sequence: Synthetic oligonucleotide
cagcaccaguagguggca

SEQ ID NO: 42609 - RNA, 18 nt, Artificial Sequence
  Description of Artificial Sequence: Synthetic oligonucleotide
aagcucagcaccaguagg

SEQ ID NO: 42610 - RNA, 18 nt, Artificial Sequence
  Description of Artificial Sequence: Synthetic oligonucleotide
gagccaagcucagcacca

SEQ ID NO: 42611 - RNA, 18 nt, Artificial Sequence
  Description of Artificial Sequence: Synthetic oligonucleotide
cgcaagagccaagcucag

SEQ ID NO: 42612 - RNA, 18 nt, Artificial Sequence
  Description of Artificial Sequence: Synthetic oligonucleotide
cuguccgcaagagccaag

SEQ ID NO: 42613 - RNA, 18 nt, Artificial Sequence
  Description of Artificial Sequence: Synthetic oligonucleotide
ucccacuguccgcaagag

SEQ ID NO: 42614 - RNA, 18 nt, Artificial Sequence
  Description of Artificial Sequence: Synthetic oligonucleotide
gcugaucccacuguccgc

SEQ ID NO: 42615 - RNA, 18 nt, Artificial Sequence
  Description of Artificial Sequence: Synthetic oligonucleotide
uucaggcugaucccacug

SEQ ID NO: 42616 - RNA, 18 nt, Artificial Sequence
  Description of Artificial Sequence: Synthetic oligonucleotide
gggcauucaggcugaucc

SEQ ID NO: 42617 - RNA, 18 nt, Artificial Sequence
  Description of Artificial Sequence: Synthetic oligonucleotide
aacgagggcauucaggcu

SEQ ID NO: 42618 - RNA, 18 nt, Artificial Sequence
  Description of Artificial Sequence: Synthetic oligonucleotide
gcugcaacgagggcauuc

SEQ ID NO: 42619 - RNA, 18 nt, Artificial Sequence
  Description of Artificial Sequence: Synthetic oligonucleotide
auguggcugcaacgaggg

SEQ ID NO: 42620 - RNA, 18 nt, Artificial Sequence
  Description of Artificial Sequence: Synthetic oligonucleotide
gcuggauguggcugcaac

SEQ ID NO: 42621 - RNA, 18 nt, Artificial Sequence
  Description of Artificial Sequence: Synthetic oligonucleotide
agaaggcuggauguggcu

SEQ ID NO: 42622 - RNA, 18 nt, Artificial Sequence
  Description of Artificial Sequence: Synthetic oligonucleotide
ccagagccuguggacugg

SEQ ID NO: 42623 - RNA, 18 nt, Artificial Sequence
  Description of Artificial Sequence: Synthetic oligonucleotide
ggaccccagagccugugg

SEQ ID NO: 42624 - RNA, 18 nt, Artificial Sequence
  Description of Artificial Sequence: Synthetic oligonucleotide
aggcaggaccccagagcc

SEQ ID NO: 42625 - RNA, 18 nt, Artificial Sequence
  Description of Artificial Sequence: Synthetic oligonucleotide
gccccaggcaggacccca

SEQ ID NO: 42626 - RNA, 18 nt, Artificial Sequence
  Description of Artificial Sequence: Synthetic oligonucleotide
gucaggccccaggcagga

SEQ ID NO: 42627 - RNA, 18 nt, Artificial Sequence
  Description of Artificial Sequence: Synthetic oligonucleotide
gggucaggccccaggcag

SEQ ID NO: 42628 - RNA, 18 nt, Artificial Sequence
  Description of Artificial Sequence: Synthetic oligonucleotide
gcugcccagggcccaggg

SEQ ID NO: 42629 - RNA, 18 nt, Artificial Sequence
  Description of Artificial Sequence: Synthetic oligonucleotide
gccuggcugcccagggcc

SEQ ID NO: 42630 - RNA, 18 nt, Artificial Sequence
  Description of Artificial Sequence: Synthetic oligonucleotide
ccuuggccuggcugccca

SEQ ID NO: 42631 - RNA, 18 nt, Artificial Sequence
  Description of Artificial Sequence: Synthetic oligonucleotide
aaugcccuuggccuggcu

SEQ ID NO: 42632 - RNA, 18 nt, Artificial Sequence
  Description of Artificial Sequence: Synthetic oligonucleotide
guaaaaaugcccuuggcc

SEQ ID NO: 42633 - RNA, 18 nt, Artificial Sequence
  Description of Artificial Sequence: Synthetic oligonucleotide
aaguaguaaaaaugcccu

SEQ ID NO: 42634 - RNA, 18 nt, Artificial Sequence
  Description of Artificial Sequence: Synthetic oligonucleotide
ucuguaaguaguaaaaau

SEQ ID NO: 42635 - RNA, 18 nt, Artificial Sequence
  Description of Artificial Sequence: Synthetic oligonucleotide
aauuuucuguaaguagua

SEQ ID NO: 42636 - RNA, 18 nt, Artificial Sequence
  Description of Artificial Sequence: Synthetic oligonucleotide
uggccaauuuucuguaag

SEQ ID NO: 42637 - RNA, 18 nt, Artificial Sequence
  Description of Artificial Sequence: Synthetic oligonucleotide
gcccuuggccaauuuucu

SEQ ID NO: 42638 - RNA, 18 nt, Artificial Sequence
  Description of Artificial Sequence: Synthetic oligonucleotide
ccucugcccuuggccaau

SEQ ID NO: 42639 - RNA, 18 nt, Artificial Sequence
  Description of Artificial Sequence: Synthetic oligonucleotide
cccacccucugcccuugg

SEQ ID NO: 42640 - RNA, 18 nt, Artificial Sequence
  Description of Artificial Sequence: Synthetic oligonucleotide
gccugcccacccucugcc

SEQ ID NO: 42641 - RNA, 18 nt, Artificial Sequence
  Description of Artificial Sequence: Synthetic oligonucleotide
uuuuagccugcccacccu

SEQ ID NO: 42642 - RNA, 18 nt, Artificial Sequence
  Description of Artificial Sequence: Synthetic oligonucleotide
gcccauuuuagccugccc

SEQ ID NO: 42643 - RNA, 18 nt, Artificial Sequence
  Description of Artificial Sequence: Synthetic oligonucleotide
auucagcccauuuuagcc

SEQ ID NO: 42644 - RNA, 18 nt, Artificial Sequence
  Description of Artificial Sequence: Synthetic oligonucleotide
cuggaauucagcccauuu

SEQ ID NO: 42645 - RNA, 18 nt, Artificial Sequence
  Description of Artificial Sequence: Synthetic oligonucleotide
ucaaucuggaauucagcc

SEQ ID NO: 42646 - RNA, 18 nt, Artificial Sequence
  Description of Artificial Sequence: Synthetic oligonucleotide
cagaaucaaucuggaauu

SEQ ID NO: 42647 - RNA, 18 nt, Artificial Sequence
  Description of Artificial Sequence: Synthetic oligonucleotide
uucuucagaaucaaucug

SEQ ID NO: 42648 - RNA, 18 nt, Artificial Sequence
  Description of Artificial Sequence: Synthetic oligonucleotide
ugucguucuucagaauca

SEQ ID NO: 42649 - RNA, 18 nt, Artificial Sequence
  Description of Artificial Sequence: Synthetic oligonucleotide
ucagcugucguucuucag

SEQ ID NO: 42650 - RNA, 18 nt, Artificial Sequence
  Description of Artificial Sequence: Synthetic oligonucleotide
agaaaucagcugucguuc

SEQ ID NO: 42651 - RNA, 18 nt, Artificial Sequence
  Description of Artificial Sequence: Synthetic oligonucleotide
cuuccagaaaucagcugu

SEQ ID NO: 42652 - RNA, 18 nt, Artificial Sequence
  Description of Artificial Sequence: Synthetic oligonucleotide
ccugucuuccagaaauca

SEQ ID NO: 42653 - RNA, 18 nt, Artificial Sequence
  Description of Artificial Sequence: Synthetic oligonucleotide
caaccccugucuuccaga

SEQ ID NO: 42654 - RNA, 18 nt, Artificial Sequence
  Description of Artificial Sequence: Synthetic oligonucleotide
uucagcaaccccugucuu

SEQ ID NO: 42655 - RNA, 18 nt, Artificial Sequence
  Description of Artificial Sequence: Synthetic oligonucleotide
cagguuucagcaaccccu

SEQ ID NO: 42656 - RNA, 18 nt, Artificial Sequence
  Description of Artificial Sequence: Synthetic oligonucleotide
uucaucagguuucagcaa

SEQ ID NO: 42657 - RNA, 18 nt, Artificial Sequence
  Description of Artificial Sequence: Synthetic oligonucleotide
ucucuuucaucagguuuc

SEQ ID NO: 42658 - RNA, 18 nt, Artificial Sequence
  Description of Artificial Sequence: Synthetic oligonucleotide
uaccaucucuuucaucag

SEQ ID NO: 42659 - RNA, 18 nt, Artificial Sequence
  Description of Artificial Sequence: Synthetic oligonucleotide
cagccuaccaucucuuuc

SEQ ID NO: 42660 - RNA, 18 nt, Artificial Sequence
  Description of Artificial Sequence: Synthetic oligonucleotide
cucuacagccuaccaucu

SEQ ID NO: 42661 - RNA, 18 nt, Artificial Sequence
  Description of Artificial Sequence: Synthetic oligonucleotide
uugaucucuacagccuac

SEQ ID NO: 42662 - RNA, 18 nt, Artificial Sequence
  Description of Artificial Sequence: Synthetic oligonucleotide
caccauugaucucuacag

SEQ ID NO: 42663 - RNA, 18 nt, Artificial Sequence
  Description of Artificial Sequence: Synthetic oligonucleotide
acccacaccauugaucuc

SEQ ID NO: 42664 - RNA, 18 nt, Artificial Sequence
  Description of Artificial Sequence: Synthetic oligonucleotide
acagaacccacaccauug

SEQ ID NO: 42665 - RNA, 18 nt, Artificial Sequence
  Description of Artificial Sequence: Synthetic oligonucleotide
ugguuacagaacccacac

SEQ ID NO: 42666 - RNA, 18 nt, Artificial Sequence
  Description of Artificial Sequence: Synthetic oligonucleotide
uugcuugguuacagaacc

SEQ ID NO: 42667 - RNA, 18 nt, Artificial Sequence
  Description of Artificial Sequence: Synthetic oligonucleotide
cuagguugcuugguuaca

SEQ ID NO: 42668 - RNA, 18 nt, Artificial Sequence
  Description of Artificial Sequence: Synthetic oligonucleotide
caaaccuagguugcuugg

SEQ ID NO: 42669 - RNA, 18 nt, Artificial Sequence
  Description of Artificial Sequence: Synthetic oligonucleotide
gaaugcaaaccuagguug

SEQ ID NO: 42670 - RNA, 18 nt, Artificial Sequence
  Description of Artificial Sequence: Synthetic oligonucleotide
agccagaaugcaaaccua

SEQ ID NO: 42671 - RNA, 18 nt, Artificial Sequence
  Description of Artificial Sequence: Synthetic oligonucleotide
gcugaagccagaaugcaa

SEQ ID NO: 42672 - RNA, 18 nt, Artificial Sequence
  Description of Artificial Sequence: Synthetic oligonucleotide
gaaaugcugaagccagaa

SEQ ID NO: 42673 - RNA, 18 nt, Artificial Sequence
  Description of Artificial Sequence: Synthetic oligonucleotide
aacuagaaaugcugaagc

SEQ ID NO: 42674 - RNA, 18 nt, Artificial Sequence
  Description of Artificial Sequence: Synthetic oligonucleotide
cccagaacuagaaaugcu

SEQ ID NO: 42675 - RNA, 18 nt, Artificial Sequence
  Description of Artificial Sequence: Synthetic oligonucleotide
agaagcccagaacuagaa

SEQ ID NO: 42676 - RNA, 18 nt, Artificial Sequence
  Description of Artificial Sequence: Synthetic oligonucleotide
auggaagaagcccagaac

SEQ ID NO: 42677 - RNA, 18 nt, Artificial Sequence
  Description of Artificial Sequence: Synthetic oligonucleotide
gauuuauggaagaagccc

SEQ ID NO: 42678 - RNA, 18 nt, Artificial Sequence
  Description of Artificial Sequence: Synthetic oligonucleotide
uauccgauuuauggaaga

SEQ ID NO: 42679 - RNA, 18 nt, Artificial Sequence
  Description of Artificial Sequence: Synthetic oligonucleotide
aauaauauccgauuuaug

SEQ ID NO: 42680 - RNA, 18 nt, Artificial Sequence
  Description of Artificial Sequence: Synthetic oligonucleotide
uaggaaauaauauccgau

SEQ ID NO: 42681 - RNA, 18 nt, Artificial Sequence
  Description of Artificial Sequence: Synthetic oligonucleotide
ugaguuaggaaauaauau

SEQ ID NO: 42682 - RNA, 18 nt, Artificial Sequence
  Description of Artificial Sequence: Synthetic oligonucleotide
cuauaugaguuaggaaau

SEQ ID NO: 42683 - RNA, 18 nt, Artificial Sequence
  Description of Artificial Sequence: Synthetic oligonucleotide
accaccuauaugaguuag

SEQ ID NO: 42684 - RNA, 18 nt, Artificial Sequence
  Description of Artificial Sequence: Synthetic oligonucleotide
uuccaaccaccuauauga

SEQ ID NO: 42685 - RNA, 18 nt, Artificial Sequence
  Description of Artificial Sequence: Synthetic oligonucleotide
aauacuuccaaccaccua

SEQ ID NO: 42686 - RNA, 18 nt, Artificial Sequence
  Description of Artificial Sequence: Synthetic oligonucleotide
aaguaaauacuuccaacc

SEQ ID NO: 42687 - RNA, 18 nt, Artificial Sequence
  Description of Artificial Sequence: Synthetic oligonucleotide
aauagaaguaaauacuuc

SEQ ID NO: 42688 - RNA, 18 nt, Artificial Sequence
  Description of Artificial Sequence: Synthetic oligonucleotide
cacauaauagaaguaaau

SEQ ID NO: 42689 - RNA, 18 nt, Artificial Sequence
  Description of Artificial Sequence: Synthetic oligonucleotide
auuuacacauaauagaag

SEQ ID NO: 42690 - RNA, 18 nt, Artificial Sequence
  Description of Artificial Sequence: Synthetic oligonucleotide
aaguuauuuacacauaau

SEQ ID NO: 42691 - RNA, 18 nt, Artificial Sequence
  Description of Artificial Sequence: Synthetic oligonucleotide
auuuuaaguuauuuacac

SEQ ID NO: 42692 - RNA, 18 nt, Artificial Sequence
  Description of Artificial Sequence: Synthetic oligonucleotide
gcauuauuuuaaguuauu

SEQ ID NO: 42693 - RNA, 18 nt, Artificial Sequence
  Description of Artificial Sequence: Synthetic oligonucleotide
aucaagcauuauuuuaag

SEQ ID NO: 42694 - RNA, 18 nt, Artificial Sequence
  Description of Artificial Sequence: Synthetic oligonucleotide
uagguaucaagcauuauu

SEQ ID NO: 42695 - RNA, 18 nt, Artificial Sequence
  Description of Artificial Sequence: Synthetic oligonucleotide
aguccuagguaucaagca

SEQ ID NO: 42696 - RNA, 18 nt, Artificial Sequence
  Description of Artificial Sequence: Synthetic oligonucleotide
cguagaguccuagguauc

SEQ ID NO: 42697 - RNA, 18 nt, Artificial Sequence
  Description of Artificial Sequence: Synthetic oligonucleotide
acuuacguagaguccuag

SEQ ID NO: 42698 - RNA, 18 nt, Artificial Sequence
  Description of Artificial Sequence: Synthetic oligonucleotide
caaacacuuacguagagu

SEQ ID NO: 42699 - RNA, 18 nt, Artificial Sequence
  Description of Artificial Sequence: Synthetic oligonucleotide
guucacaaacacuuacgu

SEQ ID NO: 42700 - RNA, 18 nt, Artificial Sequence
  Description of Artificial Sequence: Synthetic oligonucleotide
uuuguguucacaaacacu

SEQ ID NO: 42701 - RNA, 18 nt, Artificial Sequence
  Description of Artificial Sequence: Synthetic oligonucleotide
ccccauuuguguucacaa

SEQ ID NO: 42702 - RNA, 18 nt, Artificial Sequence
  Description of Artificial Sequence: Synthetic oligonucleotide
aacgcccccauuuguguu

SEQ ID NO: 42703 - RNA, 18 nt, Artificial Sequence
  Description of Artificial Sequence: Synthetic oligonucleotide
gugauaacgcccccauuu

SEQ ID NO: 42704 - RNA, 18 nt, Artificial Sequence
  Description of Artificial Sequence: Synthetic oligonucleotide
uaguggugauaacgcccc

SEQ ID NO: 42705 - RNA, 18 nt, Artificial Sequence
  Description of Artificial Sequence: Synthetic oligonucleotide
ugcaguaguggugauaac

SEQ ID NO: 42706 - RNA, 18 nt, Artificial Sequence
  Description of Artificial Sequence: Synthetic oligonucleotide
acgggugcaguaguggug

SEQ ID NO: 42707 - RNA, 18 nt, Artificial Sequence
  Description of Artificial Sequence: Synthetic oligonucleotide
uacauacgggugcaguag

SEQ ID NO: 42708 - RNA, 18 nt, Artificial Sequence
  Description of Artificial Sequence: Synthetic oligonucleotide
ccagauacauacgggugc

SEQ ID NO: 42709 - RNA, 18 nt, Artificial Sequence
  Description of Artificial Sequence: Synthetic oligonucleotide
ggagcccagauacauacg

SEQ ID NO: 42710 - RNA, 18 nt, Artificial Sequence
  Description of Artificial Sequence: Synthetic oligonucleotide
cuccaggagcccagauac

SEQ ID NO: 42711 - RNA, 18 nt, Artificial Sequence
  Description of Artificial Sequence: Synthetic oligonucleotide
cuccacuccaggagccca

SEQ ID NO: 42712 - RNA, 18 nt, Artificial Sequence
  Description of Artificial Sequence: Synthetic oligonucleotide
ugucccuccacuccagga

SEQ ID NO: 42713 - RNA, 18 nt, Artificial Sequence
  Description of Artificial Sequence: Synthetic oligonucleotide
aucggugucccuccacuc

SEQ ID NO: 42714 - RNA, 18 nt, Artificial Sequence
  Description of Artificial Sequence: Synthetic oligonucleotide
acugcaucggugucccuc

SEQ ID NO: 42715 - RNA, 18 nt, Artificial Sequence
  Description of Artificial Sequence: Synthetic oligonucleotide
uccacacugcaucggugu

SEQ ID NO: 42716 - RNA, 18 nt, Artificial Sequence
  Description of Artificial Sequence: Synthetic oligonucleotide
uccucuccacacugcauc

SEQ ID NO: 42717 - RNA, 18 nt, Artificial Sequence
  Description of Artificial Sequence: Synthetic oligonucleotide
ucuuauccucuccacacu

SEQ ID NO: 42718 - RNA, 18 nt, Artificial Sequence
  Description of Artificial Sequence: Synthetic oligonucleotide
cuccgucuguagugucca

SEQ ID NO: 42719 - RNA, 18 nt, Artificial Sequence
  Description of Artificial Sequence: Synthetic oligonucleotide
ccagccuccgucuguagu

SEQ ID NO: 42720 - RNA, 18 nt, Artificial Sequence
  Description of Artificial Sequence: Synthetic oligonucleotide
gggcuccagccuccgucu

SEQ ID NO: 42721 - RNA, 18 nt, Artificial Sequence
  Description of Artificial Sequence: Synthetic oligonucleotide
ugagcaugcacauccggg

SEQ ID NO: 42722 - RNA, 18 nt, Artificial Sequence
  Description of Artificial Sequence: Synthetic oligonucleotide
gcacugagcaugcacauc

SEQ ID NO: 42723 - RNA, 18 nt, Artificial Sequence
  Description of Artificial Sequence: Synthetic oligonucleotide
ggucagcacugagcaugc

SEQ ID NO: 42724 - RNA, 18 nt, Artificial Sequence
  Description of Artificial Sequence: Synthetic oligonucleotide
aggcuggucagcacugag

SEQ ID NO: 42725 - RNA, 18 nt, Artificial Sequence
  Description of Artificial Sequence: Synthetic oligonucleotide
cccccaggcuggucagca

SEQ ID NO: 42726 - RNA, 18 nt, Artificial Sequence
  Description of Artificial Sequence: Synthetic oligonucleotide
cagaccccccaggcuggu

SEQ ID NO: 42727 - RNA, 18 nt, Artificial Sequence
  Description of Artificial Sequence: Synthetic oligonucleotide
ugaugcagaccccccagg

SEQ ID NO: 42728 - RNA, 18 nt, Artificial Sequence
  Description of Artificial Sequence: Synthetic oligonucleotide
cucacugaugcagacccc

SEQ ID NO: 42729 - RNA, 18 nt, Artificial Sequence
  Description of Artificial Sequence: Synthetic oligonucleotide
gaguucucacugaugcag

SEQ ID NO: 42730 - RNA, 18 nt, Artificial Sequence
  Description of Artificial Sequence: Synthetic oligonucleotide
aggaagaguucucacuga

SEQ ID NO: 42731 - RNA, 18 nt, Artificial Sequence
  Description of Artificial Sequence: Synthetic oligonucleotide
gugggaggaagaguucuc

SEQ ID NO: 42732 - RNA, 18 nt, Artificial Sequence
  Description of Artificial Sequence: Synthetic oligonucleotide
ucucugugggaggaagag

SEQ ID NO: 42733 - RNA, 18 nt, Artificial Sequence
  Description of Artificial Sequence: Synthetic oligonucleotide
ucaauucucugugggagg

SEQ ID NO: 42734 - RNA, 18 nt, Artificial Sequence
  Description of Artificial Sequence: Synthetic oligonucleotide
aaacuucaauucucugug

SEQ ID NO: 42735 - RNA, 18 nt, Artificial Sequence
  Description of Artificial Sequence: Synthetic oligonucleotide
gguggaaacuucaauucu

SEQ ID NO: 42736 - RNA, 18 nt, Artificial Sequence
  Description of Artificial Sequence: Synthetic oligonucleotide
gcaaagguggaaacuuca

SEQ ID NO: 42737 - RNA, 18 nt, Artificial Sequence
  Description of Artificial Sequence: Synthetic oligonucleotide
ggcaagcaaagguggaaa

SEQ ID NO: 42738 - RNA, 18 nt, Artificial Sequence
  Description of Artificial Sequence: Synthetic oligonucleotide
aaaagggcaagcaaaggu

SEQ ID NO: 42739 - RNA, 18 nt, Artificial Sequence
  Description of Artificial Sequence: Synthetic oligonucleotide
agccuaaaagggcaagca

SEQ ID NO: 42740 - RNA, 18 nt, Artificial Sequence
  Description of Artificial Sequence: Synthetic oligonucleotide
uccccagccuaaaagggc

SEQ ID NO: 42741 - RNA, 18 nt, Artificial Sequence
  Description of Artificial Sequence: Synthetic oligonucleotide
aggccuccccagccuaaa

SEQ ID NO: 42742 - RNA, 18 nt, Artificial Sequence
  Description of Artificial Sequence: Synthetic oligonucleotide
aucccaggccuccccagc

SEQ ID NO: 42743 - RNA, 18 nt, Artificial Sequence
  Description of Artificial Sequence: Synthetic oligonucleotide
gggagaucccaggccucc

SEQ ID NO: 42744 - RNA, 18 nt, Artificial Sequence
  Description of Artificial Sequence: Synthetic oligonucleotide
gaaggcaaagucagaggg

SEQ ID NO: 42745 - RNA, 18 nt, Artificial Sequence
  Description of Artificial Sequence: Synthetic oligonucleotide
ugaaggcaaagucagagg

SEQ ID NO: 42746 - RNA, 18 nt, Artificial Sequence
  Description of Artificial Sequence: Synthetic oligonucleotide
gaagaugaaggcaaaguc

SEQ ID NO: 42747 - RNA, 18 nt, Artificial Sequence
  Description of Artificial Sequence: Synthetic oligonucleotide
acacagaagaugaaggca

SEQ ID NO: 42748 - RNA, 18 nt, Artificial Sequence
  Description of Artificial Sequence: Synthetic oligonucleotide
aggucacacagaagauga

SEQ ID NO: 42749 - RNA, 18 nt, Artificial Sequence
  Description of Artificial Sequence: Synthetic oligonucleotide
agccaaggucacacagaa

SEQ ID NO: 42750 - RNA, 18 nt, Artificial Sequence
  Description of Artificial Sequence: Synthetic oligonucleotide
acugaagccaaggucaca

SEQ ID NO: 42751 - RNA, 18 nt, Artificial Sequence
  Description of Artificial Sequence: Synthetic oligonucleotide
aagauacugaagccaagg

SEQ ID NO: 42752 - RNA, 18 nt, Artificial Sequence
  Description of Artificial Sequence: Synthetic oligonucleotide
aggcaaagauacugaagc

SEQ ID NO: 42753 - RNA, 18 nt, Artificial Sequence
  Description of Artificial Sequence: Synthetic oligonucleotide
caaagaggcaaagauacu

SEQ ID NO: 42754 - RNA, 18 nt, Artificial Sequence
  Description of Artificial Sequence: Synthetic oligonucleotide
acauucaaagaggcaaag

SEQ ID NO: 42755 - RNA, 18 nt, Artificial Sequence
  Description of Artificial Sequence: Synthetic oligonucleotide
aacugacauucaaagagg

SEQ ID NO: 42756 - RNA, 18 nt, Artificial Sequence
  Description of Artificial Sequence: Synthetic oligonucleotide
cuguauuugauagguggg

SEQ ID NO: 42757 - RNA, 18 nt, Artificial Sequence
  Description of Artificial Sequence: Synthetic oligonucleotide
caugccuguauuugauag

SEQ ID NO: 42758 - RNA, 18 nt, Artificial Sequence
  Description of Artificial Sequence: Synthetic oligonucleotide
gagcucaugccuguauuu

SEQ ID NO: 42759 - RNA, 18 nt, Artificial Sequence
  Description of Artificial Sequence: Synthetic oligonucleotide
caggagagcucaugccug

SEQ ID NO: 42760 - RNA, 18 nt, Artificial Sequence
  Description of Artificial Sequence: Synthetic oligonucleotide
ugucacaggagagcucau

SEQ ID NO: 42761 - RNA, 18 nt, Artificial Sequence
  Description of Artificial Sequence: Synthetic oligonucleotide
cccucugucacaggagag

SEQ ID NO: 42762 - RNA, 18 nt, Artificial Sequence
  Description of Artificial Sequence: Synthetic oligonucleotide
cagaucccucugucacag

SEQ ID NO: 42763 - RNA, 18 nt, Artificial Sequence
  Description of Artificial Sequence: Synthetic oligonucleotide
gugaucagaucccucugu

SEQ ID NO: 42764 - RNA, 18 nt, Artificial Sequence
  Description of Artificial Sequence: Synthetic oligonucleotide
ucugcgugaucagauccc

SEQ ID NO: 42765 - RNA, 18 nt, Artificial Sequence
  Description of Artificial Sequence: Synthetic oligonucleotide
cucucucugcgugaucag

SEQ ID NO: 42766 - RNA, 18 nt, Artificial Sequence
  Description of Artificial Sequence: Synthetic oligonucleotide
auaggcucucucugcgug

SEQ ID NO: 42767 - RNA, 18 nt, Artificial Sequence
  Description of Artificial Sequence: Synthetic oligonucleotide
gggccauaggcucucucu

SEQ ID NO: 42768 - RNA, 18 nt, Artificial Sequence
  Description of Artificial Sequence: Synthetic oligonucleotide
ugguugggccauaggcuc

SEQ ID NO: 42769 - RNA, 18 nt, Artificial Sequence
  Description of Artificial Sequence: Synthetic oligonucleotide
caccaugguugggccaua

SEQ ID NO: 42770 - RNA, 18 nt, Artificial Sequence
  Description of Artificial Sequence: Synthetic oligonucleotide
gacugcaccaugguuggg

SEQ ID NO: 42771 - RNA, 18 nt, Artificial Sequence
  Description of Artificial Sequence: Synthetic oligonucleotide
acuuugacugcaccaugg

SEQ ID NO: 42772 - RNA, 18 nt, Artificial Sequence
  Description of Artificial Sequence: Synthetic oligonucleotide
gggugacuuugacugcac

SEQ ID NO: 42773 - RNA, 18 nt, Artificial Sequence
  Description of Artificial Sequence: Synthetic oligonucleotide
aggcugggugacuuugac

SEQ ID NO: 42774 - RNA, 18 nt, Artificial Sequence
  Description of Artificial Sequence: Synthetic oligonucleotide
ucuccaggcugggugacu

SEQ ID NO: 42775 - RNA, 18 nt, Artificial Sequence
  Description of Artificial Sequence: Synthetic oligonucleotide
cacacucuccaggcuggg

SEQ ID NO: 42776 - RNA, 18 nt, Artificial Sequence
  Description of Artificial Sequence: Synthetic oligonucleotide
caaugcacacucuccagg

SEQ ID NO: 42777 - RNA, 18 nt, Artificial Sequence
  Description of Artificial Sequence: Synthetic oligonucleotide
gagcccaaugcacacucu

SEQ ID NO: 42778 - RNA, 18 nt, Artificial Sequence
  Description of Artificial Sequence: Synthetic oligonucleotide
ggguggagcccaaugcac

SEQ ID NO: 42779 - RNA, 18 nt, Artificial Sequence
  Description of Artificial Sequence: Synthetic oligonucleotide
aguaacugggcugaaggg

SEQ ID NO: 42780 - RNA, 18 nt, Artificial Sequence
  Description of Artificial Sequence: Synthetic oligonucleotide
cucaaguaacugggcuga

SEQ ID NO: 42781 - RNA, 18 nt, Artificial Sequence
  Description of Artificial Sequence: Synthetic oligonucleotide
uggagcucaaguaacugg

SEQ ID NO: 42782 - RNA, 18 nt, Artificial Sequence
  Description of Artificial Sequence: Synthetic oligonucleotide
ggcguuggagcucaagua

SEQ ID NO: 42783 - RNA, 18 nt, Artificial Sequence
  Description of Artificial Sequence: Synthetic oligonucleotide
uaugaggcguuggagcuc

SEQ ID NO: 42784 - RNA, 18 nt, Artificial Sequence
  Description of Artificial Sequence: Synthetic oligonucleotide
uuuccuaugaggcguugg

SEQ ID NO: 42785 - RNA, 18 nt, Artificial Sequence
  Description of Artificial Sequence: Synthetic oligonucleotide
gugucuuuccuaugaggc

SEQ ID NO: 42786 - RNA, 18 nt, Artificial Sequence
  Description of Artificial Sequence: Synthetic oligonucleotide
uauuggugucuuuccuau

SEQ ID NO: 42787 - RNA, 18 nt, Artificial Sequence
  Description of Artificial Sequence: Synthetic oligonucleotide
cuuaauauuggugucuuu

SEQ ID NO: 42788 - RNA, 18 nt, Artificial Sequence
  Description of Artificial Sequence: Synthetic oligonucleotide
agggccuuaauauuggug

SEQ ID NO: 42789 - RNA, 18 nt, Artificial Sequence
  Description of Artificial Sequence: Synthetic oligonucleotide
ugaagagggccuuaauau

SEQ ID NO: 42790 - RNA, 18 nt, Artificial Sequence
  Description of Artificial Sequence: Synthetic oligonucleotide
uucucugaagagggccuu

SEQ ID NO: 42791 - RNA, 18 nt, Artificial Sequence
  Description of Artificial Sequence: Synthetic oligonucleotide
ccuucuucucugaagagg

SEQ ID NO: 42792 - RNA, 18 nt, Artificial Sequence
  Description of Artificial Sequence: Synthetic oligonucleotide
gcugcccuucuucucuga

SEQ ID NO: 42793 - RNA, 18 nt, Artificial Sequence
  Description of Artificial Sequence: Synthetic oligonucleotide
ugaaugcugcccuucuuc

SEQ ID NO: 42794 - RNA, 18 nt, Artificial Sequence
  Description of Artificial Sequence: Synthetic oligonucleotide
guuccugaaugcugcccu

SEQ ID NO: 42795 - RNA, 18 nt, Artificial Sequence
  Description of Artificial Sequence: Synthetic oligonucleotide
uguguguuccugaaugcu

SEQ ID NO: 42796 - RNA, 18 nt, Artificial Sequence
  Description of Artificial Sequence: Synthetic oligonucleotide
uggaguguguguuccuga

SEQ ID NO: 42797 - RNA, 18 nt, Artificial Sequence
  Description of Artificial Sequence: Synthetic oligonucleotide
cagcuuggaguguguguu

SEQ ID NO: 42798 - RNA, 18 nt, Artificial Sequence
  Description of Artificial Sequence: Synthetic oligonucleotide
aaguacagcuuggagugu

SEQ ID NO: 42799 - RNA, 18 nt, Artificial Sequence
  Description of Artificial Sequence: Synthetic oligonucleotide
cugccaaguacagcuugg

SEQ ID NO: 42800 - RNA, 18 nt, Artificial Sequence
  Description of Artificial Sequence: Synthetic oligonucleotide
cacaccugccaaguacag

SEQ ID NO: 42801 - RNA, 18 nt, Artificial Sequence
  Description of Artificial Sequence: Synthetic oligonucleotide
ccucccacaccugccaag

SEQ ID NO: 42802 - RNA, 18 nt, Artificial Sequence
  Description of Artificial Sequence: Synthetic oligonucleotide
uuccaccucccacaccug

SEQ ID NO: 42803 - RNA, 18 nt, Artificial Sequence
  Description of Artificial Sequence: Synthetic oligonucleotide
auccuuuccaccucccac

SEQ ID NO: 42804 - RNA, 18 nt, Artificial Sequence
  Description of Artificial Sequence: Synthetic oligonucleotide
cuccgauccuuuccaccu

SEQ ID NO: 42805 - RNA, 18 nt, Artificial Sequence
  Description of Artificial Sequence: Synthetic oligonucleotide
cucuccuccgauccuuuc

SEQ ID NO: 42806 - RNA, 18 nt, Artificial Sequence
  Description of Artificial Sequence: Synthetic oligonucleotide
ccagcgccugugggagac

SEQ ID NO: 42807 - RNA, 18 nt, Artificial Sequence
  Description of Artificial Sequence: Synthetic oligonucleotide
uagggccagcgccugugg

SEQ ID NO: 42808 - RNA, 18 nt, Artificial Sequence
  Description of Artificial Sequence: Synthetic oligonucleotide
agccguagggccagcgcc

SEQ ID NO: 42809 - RNA, 18 nt, Artificial Sequence
  Description of Artificial Sequence: Synthetic oligonucleotide
guccgagccguagggcca

SEQ ID NO: 42810 - RNA, 18 nt, Artificial Sequence
  Description of Artificial Sequence: Synthetic oligonucleotide
cagccguccgagccguag

SEQ ID NO: 42811 - RNA, 18 nt, Artificial Sequence
  Description of Artificial Sequence: Synthetic oligonucleotide
ccuggcagccguccgagc

SEQ ID NO: 42812 - RNA, 18 nt, Artificial Sequence
  Description of Artificial Sequence: Synthetic oligonucleotide
gugagccuggcagccguc

SEQ ID NO: 42813 - RNA, 18 nt, Artificial Sequence
  Description of Artificial Sequence: Synthetic oligonucleotide
aagccgugagccuggcag

SEQ ID NO: 42814 - RNA, 18 nt, Artificial Sequence
  Description of Artificial Sequence: Synthetic oligonucleotide
ccuggaagccgugagccu

SEQ ID NO: 42815 - RNA, 18 nt, Artificial Sequence
  Description of Artificial Sequence: Synthetic oligonucleotide
aaagcccuggaagccgug

SEQ ID NO: 42816 - RNA, 18 nt, Artificial Sequence
  Description of Artificial Sequence: Synthetic oligonucleotide
gucacaaagcccuggaag

SEQ ID NO: 42817 - RNA, 18 nt, Artificial Sequence
  Description of Artificial Sequence: Synthetic oligonucleotide
acgcugucacaaagcccu

SEQ ID NO: 42818 - RNA, 18 nt, Artificial Sequence
  Description of Artificial Sequence: Synthetic oligonucleotide
ggccaacgcugucacaaa

SEQ ID NO: 42819 - RNA, 18 nt, Artificial Sequence
  Description of Artificial Sequence: Synthetic oligonucleotide
augcuggccaacgcuguc

SEQ ID NO: 42820 - RNA, 18 nt, Artificial Sequence
  Description of Artificial Sequence: Synthetic oligonucleotide
ugcagaugcuggccaacg

SEQ ID NO: 42821 - RNA, 18 nt, Artificial Sequence
  Description of Artificial Sequence: Synthetic oligonucleotide
acugcugcagaugcuggc

SEQ ID NO: 42822 - RNA, 18 nt, Artificial Sequence
  Description of Artificial Sequence: Synthetic oligonucleotide
gcugcacugcugcagaug

SEQ ID NO: 42823 - RNA, 18 nt, Artificial Sequence
  Description of Artificial Sequence: Synthetic oligonucleotide
cgauggcugcacugcugc

SEQ ID NO: 42824 - RNA, 18 nt, Artificial Sequence
  Description of Artificial Sequence: Synthetic oligonucleotide
ccaugcgauggcugcacu

SEQ ID NO: 42825 - RNA, 18 nt, Artificial Sequence
  Description of Artificial Sequence: Synthetic oligonucleotide
cgcccccaugcgauggcu

SEQ ID NO: 42826 - RNA, 18 nt, Artificial Sequence
  Description of Artificial Sequence: Synthetic oligonucleotide
gauaacgcccccaugcga

SEQ ID NO: 42827 - RNA, 18 nt, Artificial Sequence
  Description of Artificial Sequence: Synthetic oligonucleotide
guggugauaacgccccca

SEQ ID NO: 42828 - RNA, 18 nt, Artificial Sequence
  Description of Artificial Sequence: Synthetic oligonucleotide
caguaguggugauaacgc

SEQ ID NO: 42829 - RNA, 18 nt, Artificial Sequence
  Description of Artificial Sequence: Synthetic oligonucleotide
gggugcaguaguggugau

SEQ ID NO: 42830 - RNA, 18 nt, Artificial Sequence
  Description of Artificial Sequence: Synthetic oligonucleotide
caguggcccagcugucuc

SEQ ID NO: 42831 - RNA, 18 nt, Artificial Sequence
  Description of Artificial Sequence: Synthetic oligonucleotide
acugccaguggcccagcu

SEQ ID NO: 42832 - RNA, 18 nt, Artificial Sequence
  Description of Artificial Sequence: Synthetic oligonucleotide
cccucacugccaguggcc

SEQ ID NO: 42833 - RNA, 18 nt, Artificial Sequence
  Description of Artificial Sequence: Synthetic oligonucleotide
acucucccucacugccag

SEQ ID NO: 42834 - RNA, 18 nt, Artificial Sequence
  Description of Artificial Sequence: Synthetic oligonucleotide
uccucacucucccucacu

SEQ ID NO: 42835 - RNA, 18 nt, Artificial Sequence
  Description of Artificial Sequence: Synthetic oligonucleotide
ugccauccucacucuccc

SEQ ID NO: 42836 - RNA, 18 nt, Artificial Sequence
  Description of Artificial Sequence: Synthetic oligonucleotide
gucucugccauccucacu

SEQ ID NO: 42837 - RNA, 18 nt, Artificial Sequence
  Description of Artificial Sequence: Synthetic oligonucleotide
cacuggucucugccaucc

SEQ ID NO: 42838 - RNA, 18 nt, Artificial Sequence
  Description of Artificial Sequence: Synthetic oligonucleotide
cagggcacuggucucugc

SEQ ID NO: 42839 - RNA, 18 nt, Artificial Sequence
  Description of Artificial Sequence: Synthetic oligonucleotide
gugggcagggcacugguc

SEQ ID NO: 42840 - RNA, 18 nt, Artificial Sequence
  Description of Artificial Sequence: Synthetic oligonucleotide
agccagugggcagggcac

SEQ ID NO: 42841 - RNA, 18 nt, Artificial Sequence
  Description of Artificial Sequence: Synthetic oligonucleotide
cccgaagccagugggcag

SEQ ID NO: 42842 - RNA, 18 nt, Artificial Sequence
  Description of Artificial Sequence: Synthetic oligonucleotide
agcuccccgaagccagug

SEQ ID NO: 42843 - RNA, 18 nt, Artificial Sequence
  Description of Artificial Sequence: Synthetic oligonucleotide
ccucgagcuccccgaagc

SEQ ID NO: 42844 - RNA, 18 nt, Artificial Sequence
  Description of Artificial Sequence: Synthetic oligonucleotide
cagcaccucgagcucccc

SEQ ID NO: 42845 - RNA, 18 nt, Artificial Sequence
  Description of Artificial Sequence: Synthetic oligonucleotide
acagccagcaccucgagc

SEQ ID NO: 42846 - RNA, 18 nt, Artificial Sequence
  Description of Artificial Sequence: Synthetic oligonucleotide
uccccacagccagcaccu

SEQ ID NO: 42847 - RNA, 18 nt, Artificial Sequence
  Description of Artificial Sequence: Synthetic oligonucleotide
caccauccccacagccag

SEQ ID NO: 42848 - RNA, 18 nt, Artificial Sequence
  Description of Artificial Sequence: Synthetic oligonucleotide
aguagcaccauccccaca

SEQ ID NO: 42849 - RNA, 18 nt, Artificial Sequence
  Description of Artificial Sequence: Synthetic oligonucleotide
ccaccaguagcaccaucc

SEQ ID NO: 42850 - RNA, 18 nt, Artificial Sequence
  Description of Artificial Sequence: Synthetic oligonucleotide
accccagguucugccugg

SEQ ID NO: 42851 - RNA, 18 nt, Artificial Sequence
  Description of Artificial Sequence: Synthetic oligonucleotide
gcugcaccccagguucug

SEQ ID NO: 42852 - RNA, 18 nt, Artificial Sequence
  Description of Artificial Sequence: Synthetic oligonucleotide
cccccgcugcaccccagg

SEQ ID NO: 42853 - RNA, 18 nt, Artificial Sequence
  Description of Artificial Sequence: Synthetic oligonucleotide
cugggcccccgcugcacc

SEQ ID NO: 42854 - RNA, 18 nt, Artificial Sequence
  Description of Artificial Sequence: Synthetic oligonucleotide
acccacugggcccccgcu

SEQ ID NO: 42855 - RNA, 18 nt, Artificial Sequence
  Description of Artificial Sequence: Synthetic oligonucleotide
ucagaacccacugggccc

SEQ ID NO: 42856 - RNA, 18 nt, Artificial Sequence
  Description of Artificial Sequence: Synthetic oligonucleotide
gguccucagaacccacug

SEQ ID NO: 42857 - RNA, 18 nt, Artificial Sequence
  Description of Artificial Sequence: Synthetic oligonucleotide
gccuggguccucagaacc

SEQ ID NO: 42858 - RNA, 18 nt, Artificial Sequence
  Description of Artificial Sequence: Synthetic oligonucleotide
ugguggccuggguccuca

SEQ ID NO: 42859 - RNA, 18 nt, Artificial Sequence
  Description of Artificial Sequence: Synthetic oligonucleotide
cacacugguggccugggu

SEQ ID NO: 42860 - RNA, 18 nt, Artificial Sequence
  Description of Artificial Sequence: Synthetic oligonucleotide
agcuccacacugguggcc

SEQ ID NO: 42861 - RNA, 18 nt, Artificial Sequence
  Description of Artificial Sequence: Synthetic oligonucleotide
uugccagcuccacacugg

SEQ ID NO: 42862 - RNA, 18 nt, Artificial Sequence
  Description of Artificial Sequence: Synthetic oligonucleotide
ucuccuugccagcuccac

SEQ ID NO: 42863 - RNA, 18 nt, Artificial Sequence
  Description of Artificial Sequence: Synthetic oligonucleotide
ucuccucuccuugccagc

SEQ ID NO: 42864 - RNA, 18 nt, Artificial Sequence
  Description of Artificial Sequence: Synthetic oligonucleotide
ggaccucuccucuccuug

SEQ ID NO: 42865 - RNA, 18 nt, Artificial Sequence
  Description of Artificial Sequence: Synthetic oligonucleotide
gggaccucuccucuccuu

SEQ ID NO: 42866 - RNA, 18 nt, Artificial Sequence
  Description of Artificial Sequence: Synthetic oligonucleotide
cacccagcuggguuuggg

SEQ ID NO: 42867 - RNA, 18 nt, Artificial Sequence
  Description of Artificial Sequence: Synthetic oligonucleotide
ccggacacccagcugggu

SEQ ID NO: 42868 - RNA, 18 nt, Artificial Sequence
  Description of Artificial Sequence: Synthetic oligonucleotide
ugggaccggacacccagc

SEQ ID NO: 42869 - RNA, 18 nt, Artificial Sequence
  Description of Artificial Sequence: Synthetic oligonucleotide
gccaaugggaccggacac

SEQ ID NO: 42870 - RNA, 18 nt, Artificial Sequence
  Description of Artificial Sequence: Synthetic oligonucleotide
aggcagccaaugggaccg

SEQ ID NO: 42871 - RNA, 18 nt, Artificial Sequence
  Description of Artificial Sequence: Synthetic oligonucleotide
gggaaggcagccaauggg

SEQ ID NO: 42872 - RNA, 18 nt, Artificial Sequence
  Description of Artificial Sequence: Synthetic oligonucleotide
gaguccgggcacagaggg

SEQ ID NO: 42873 - RNA, 18 nt, Artificial Sequence
  Description of Artificial Sequence: Synthetic oligonucleotide
cccccgaguccgggcaca

SEQ ID NO: 42874 - RNA, 18 nt, Artificial Sequence
  Description of Artificial Sequence: Synthetic oligonucleotide
aacaccccccgaguccgg

SEQ ID NO: 42875 - RNA, 18 nt, Artificial Sequence
  Description of Artificial Sequence: Synthetic oligonucleotide
gucagaacaccccccgag

SEQ ID NO: 42876 - RNA, 18 nt, Artificial Sequence
  Description of Artificial Sequence: Synthetic oligonucleotide
caauugucagaacacccc

SEQ ID NO: 42877 - RNA, 18 nt, Artificial Sequence
  Description of Artificial Sequence: Synthetic oligonucleotide
agguucaauugucagaac

SEQ ID NO: 42878 - RNA, 18 nt, Artificial Sequence
  Description of Artificial Sequence: Synthetic oligonucleotide
cucacagguucaauuguc

SEQ ID NO: 42879 - RNA, 18 nt, Artificial Sequence
  Description of Artificial Sequence: Synthetic oligonucleotide
ugcaccucacagguucaa

SEQ ID NO: 42880 - RNA, 18 nt, Artificial Sequence
  Description of Artificial Sequence: Synthetic oligonucleotide
ugugcugcaccucacagg

SEQ ID NO: 42881 - RNA, 18 nt, Artificial Sequence
  Description of Artificial Sequence: Synthetic oligonucleotide
ggcagugugcugcaccuc

SEQ ID NO: 42882 - RNA, 18 nt, Artificial Sequence
  Description of Artificial Sequence: Synthetic oligonucleotide
cagcgggcagugugcugc

SEQ ID NO: 42883 - RNA, 18 nt, Artificial Sequence
  Description of Artificial Sequence: Synthetic oligonucleotide
gcucccagcgggcagugu

SEQ ID NO: 42884 - RNA, 18 nt, Artificial Sequence
  Description of Artificial Sequence: Synthetic oligonucleotide
ucucugcucccagcgggc

SEQ ID NO: 42885 - RNA, 18 nt, Artificial Sequence
  Description of Artificial Sequence: Synthetic oligonucleotide
cuuccucucugcucccag

SEQ ID NO: 42886 - RNA, 18 nt, Artificial Sequence
  Description of Artificial Sequence: Synthetic oligonucleotide
ccuggcuuccucucugcu

SEQ ID NO: 42887 - RNA, 18 nt, Artificial Sequence
  Description of Artificial Sequence: Synthetic oligonucleotide
ccuugccuggcuuccucu

SEQ ID NO: 42888 - RNA, 18 nt, Artificial Sequence
  Description of Artificial Sequence: Synthetic oligonucleotide
cugacccuugccuggcuu

SEQ ID NO: 42889 - RNA, 18 nt, Artificial Sequence
  Description of Artificial Sequence: Synthetic oligonucleotide
ccucccugacccuugccu

SEQ ID NO: 42890 - RNA, 18 nt, Artificial Sequence
  Description of Artificial Sequence: Synthetic oligonucleotide
cccucccucccugacccu

SEQ ID NO: 42891 - RNA, 18 nt, Artificial Sequence
  Description of Artificial Sequence: Synthetic oligonucleotide
aaagucccucccucccug

SEQ ID NO: 42892 - RNA, 18 nt, Artificial Sequence
  Description of Artificial Sequence: Synthetic oligonucleotide
cuuucaaagucccucccu

SEQ ID NO: 42893 - RNA, 18 nt, Artificial Sequence
  Description of Artificial Sequence: Synthetic oligonucleotide
guccccuuucaaaguccc

SEQ ID NO: 42894 - RNA, 18 nt, Artificial Sequence
  Description of Artificial Sequence: Synthetic oligonucleotide
cagauguccccuuucaaa

SEQ ID NO: 42895 - RNA, 18 nt, Artificial Sequence
  Description of Artificial Sequence: Synthetic oligonucleotide
cugggcagauguccccuu

SEQ ID NO: 42896 - RNA, 18 nt, Artificial Sequence
  Description of Artificial Sequence: Synthetic oligonucleotide
aucuccugggcagauguc

SEQ ID NO: 42897 - RNA, 18 nt, Artificial Sequence
  Description of Artificial Sequence: Synthetic oligonucleotide
ugaucaucuccugggcag

SEQ ID NO: 42898 - RNA, 18 nt, Artificial Sequence
  Description of Artificial Sequence: Synthetic oligonucleotide
gcucuugaucaucuccug

SEQ ID NO: 42899 - RNA, 18 nt, Artificial Sequence
  Description of Artificial Sequence: Synthetic oligonucleotide
gccuggcucuugaucauc

SEQ ID NO: 42900 - RNA, 18 nt, Artificial Sequence
  Description of Artificial Sequence: Synthetic oligonucleotide
cuaaagccuggcucuuga

SEQ ID NO: 42901 - RNA, 18 nt, Artificial Sequence
  Description of Artificial Sequence: Synthetic oligonucleotide
aaguccuaaagccuggcu

SEQ ID NO: 42902 - RNA, 18 nt, Artificial Sequence
  Description of Artificial Sequence: Synthetic oligonucleotide
augaaaaguccuaaagcc

SEQ ID NO: 42903 - RNA, 18 nt, Artificial Sequence
  Description of Artificial Sequence: Synthetic oligonucleotide
gggacaugaaaaguccua

SEQ ID NO: 42904 - RNA, 18 nt, Artificial Sequence
  Description of Artificial Sequence: Synthetic oligonucleotide
cuggagggacaugaaaag

SEQ ID NO: 42905 - RNA, 18 nt, Artificial Sequence
  Description of Artificial Sequence: Synthetic oligonucleotide
cccggcuggagggacaug

SEQ ID NO: 42906 - RNA, 18 nt, Artificial Sequence
  Description of Artificial Sequence: Synthetic oligonucleotide
uuucucccggcuggaggg

SEQ ID NO: 42907 - RNA, 18 nt, Artificial Sequence
  Description of Artificial Sequence: Synthetic oligonucleotide
uaaauuuucucccggcug

SEQ ID NO: 42908 - RNA, 18 nt, Artificial Sequence
  Description of Artificial Sequence: Synthetic oligonucleotide
uggauuaaauuuucuccc

SEQ ID NO: 42909 - RNA, 18 nt, Artificial Sequence
  Description of Artificial Sequence: Synthetic oligonucleotide
aggaguggauuaaauuuu

SEQ ID NO: 42910 - RNA, 18 nt, Artificial Sequence
  Description of Artificial Sequence: Synthetic oligonucleotide
uuccaaggaguggauuaa

SEQ ID NO: 42911 - RNA, 18 nt, Artificial Sequence
  Description of Artificial Sequence: Synthetic oligonucleotide
aggauuuccaaggagugg

SEQ ID NO: 42912 - RNA, 18 nt, Artificial Sequence
  Description of Artificial Sequence: Synthetic oligonucleotide
ucagcaggauuuccaagg

SEQ ID NO: 42913 - RNA, 18 nt, Artificial Sequence
  Description of Artificial Sequence: Synthetic oligonucleotide
gauucucagcaggauuuc

SEQ ID NO: 42914 - RNA, 18 nt, Artificial Sequence
  Description of Artificial Sequence: Synthetic oligonucleotide
ugugggauucucagcagg

SEQ ID NO: 42915 - RNA, 18 nt, Artificial Sequence
  Description of Artificial Sequence: Synthetic oligonucleotide
ucuuaugugggauucuca

SEQ ID NO: 42916 - RNA, 18 nt, Artificial Sequence
  Description of Artificial Sequence: Synthetic oligonucleotide
acugaucuuaugugggau

SEQ ID NO: 42917 - RNA, 18 nt, Artificial Sequence
  Description of Artificial Sequence: Synthetic oligonucleotide
gggacugaucuuaugugg

SEQ ID NO: 42918 - RNA, 18 nt, Artificial Sequence
  Description of Artificial Sequence: Synthetic oligonucleotide
uccccagagccuuuuggg

SEQ ID NO: 42919 - RNA, 18 nt, Artificial Sequence
  Description of Artificial Sequence: Synthetic oligonucleotide
gucuguccccagagccuu

SEQ ID NO: 42920 - RNA, 18 nt, Artificial Sequence
  Description of Artificial Sequence: Synthetic oligonucleotide
gagcugucuguccccaga

SEQ ID NO: 42921 - RNA, 18 nt, Artificial Sequence
  Description of Artificial Sequence: Synthetic oligonucleotide
aggcagagcugucugucc

SEQ ID NO: 42922 - RNA, 18 nt, Artificial Sequence
  Description of Artificial Sequence: Synthetic oligonucleotide
gcaggaggcagagcuguc

SEQ ID NO: 42923 - RNA, 18 nt, Artificial Sequence
  Description of Artificial Sequence: Synthetic oligonucleotide
caagagcaggaggcagag

SEQ ID NO: 42924 - RNA, 18 nt, Artificial Sequence
  Description of Artificial Sequence: Synthetic oligonucleotide
ccacacaagagcaggagg

SEQ ID NO: 42925 - RNA, 18 nt, Artificial Sequence
  Description of Artificial Sequence: Synthetic oligonucleotide
uccagccacacaagagca

SEQ ID NO: 42926 - RNA, 18 nt, Artificial Sequence
  Description of Artificial Sequence: Synthetic oligonucleotide
uugguuccagccacacaa

SEQ ID NO: 42927 - RNA, 18 nt, Artificial Sequence
  Description of Artificial Sequence: Synthetic oligonucleotide
gggacuugguuccagcca

SEQ ID NO: 42928 - RNA, 18 nt, Artificial Sequence
  Description of Artificial Sequence: Synthetic oligonucleotide
cugaagggacuugguucc

SEQ ID NO: 42929 - RNA, 18 nt, Artificial Sequence
  Description of Artificial Sequence: Synthetic oligonucleotide
gagagcugaagggacuug

SEQ ID NO: 42930 - RNA, 18 nt, Artificial Sequence
  Description of Artificial Sequence: Synthetic oligonucleotide
gggcagagagcugaaggg

SEQ ID NO: 42931 - RNA, 18 nt, Artificial Sequence
  Description of Artificial Sequence: Synthetic oligonucleotide
auugagggcagagagcug

SEQ ID NO: 42932 - RNA, 18 nt, Artificial Sequence
  Description of Artificial Sequence: Synthetic oligonucleotide
aaggcauugagggcagag

SEQ ID NO: 42933 - RNA, 18 nt, Artificial Sequence
  Description of Artificial Sequence: Synthetic oligonucleotide
augucaaggcauugaggg

SEQ ID NO: 42934 - RNA, 18 nt, Artificial Sequence
  Description of Artificial Sequence: Synthetic oligonucleotide
ucggaaugucaaggcauu

SEQ ID NO: 42935 - RNA, 18 nt, Artificial Sequence
  Description of Artificial Sequence: Synthetic oligonucleotide
cccauucggaaugucaag

SEQ ID NO: 42936 - RNA, 18 nt, Artificial Sequence
  Description of Artificial Sequence: Synthetic oligonucleotide
aaccacccauucggaaug

SEQ ID NO: 42937 - RNA, 18 nt, Artificial Sequence
  Description of Artificial Sequence: Synthetic oligonucleotide
uuuacaaccacccauucg

SEQ ID NO: 42938 - RNA, 18 nt, Artificial Sequence
  Description of Artificial Sequence: Synthetic oligonucleotide
uaaucuuuacaaccaccc

SEQ ID NO: 42939 - RNA, 18 nt, Artificial Sequence
  Description of Artificial Sequence: Synthetic oligonucleotide
ccauuuaaucuuuacaac

SEQ ID NO: 42940 - RNA, 18 nt, Artificial Sequence
  Description of Artificial Sequence: Synthetic oligonucleotide
uuaucccauuuaaucuuu

SEQ ID NO: 42941 - RNA, 18 nt, Artificial Sequence
  Description of Artificial Sequence: Synthetic oligonucleotide
acccauuaucccauuuaa

SEQ ID NO: 42942 - RNA, 18 nt, Artificial Sequence
  Description of Artificial Sequence: Synthetic oligonucleotide
uuuauacccauuauccca

SEQ ID NO: 42943 - RNA, 18 nt, Artificial Sequence
  Description of Artificial Sequence: Synthetic oligonucleotide
agcacuuuauacccauua

SEQ ID NO: 42944 - RNA, 18 nt, Artificial Sequence
  Description of Artificial Sequence: Synthetic oligonucleotide
accuugaauuuuggcuug

SEQ ID NO: 42945 - RNA, 18 nt, Artificial Sequence
  Description of Artificial Sequence: Synthetic oligonucleotide
acccgaccuugaauuuug

SEQ ID NO: 42946 - RNA, 18 nt, Artificial Sequence
  Description of Artificial Sequence: Synthetic oligonucleotide
gagagacccgaccuugaa

SEQ ID NO: 42947 - RNA, 18 nt, Artificial Sequence
  Description of Artificial Sequence: Synthetic oligonucleotide
caacagagagacccgacc

SEQ ID NO: 42948 - RNA, 18 nt, Artificial Sequence
  Description of Artificial Sequence: Synthetic oligonucleotide
ucuggcaacagagagacc

SEQ ID NO: 42949 - RNA, 18 nt, Artificial Sequence
  Description of Artificial Sequence: Synthetic oligonucleotide
cguacucuggcaacagag

SEQ ID NO: 42950 - RNA, 18 nt, Artificial Sequence
  Description of Artificial Sequence: Synthetic oligonucleotide
ggaagugaacaugaaggg

SEQ ID NO: 42951 - RNA, 18 nt, Artificial Sequence
  Description of Artificial Sequence: Synthetic oligonucleotide
ggcauggaagugaacaug

SEQ ID NO: 42952 - RNA, 18 nt, Artificial Sequence
  Description of Artificial Sequence: Synthetic oligonucleotide
cgccaggcauggaaguga

SEQ ID NO: 42953 - RNA, 18 nt, Artificial Sequence
  Description of Artificial Sequence: Synthetic oligonucleotide
caggacgccaggcaugga

SEQ ID NO: 42954 - RNA, 18 nt, Artificial Sequence
  Description of Artificial Sequence: Synthetic oligonucleotide
cugcccaggacgccaggc

SEQ ID NO: 42955 - RNA, 18 nt, Artificial Sequence
  Description of Artificial Sequence: Synthetic oligonucleotide
gggagcugcccaggacgc

SEQ ID NO: 42956 - RNA, 18 nt, Artificial Sequence
  Description of Artificial Sequence: Synthetic oligonucleotide
gagcugggagcugcccag

SEQ ID NO: 42957 - RNA, 18 nt, Artificial Sequence
  Description of Artificial Sequence: Synthetic oligonucleotide
uguuagagcugggagcug

SEQ ID NO: 42958 - RNA, 18 nt, Artificial Sequence
  Description of Artificial Sequence: Synthetic oligonucleotide
gucgauguuagagcuggg

SEQ ID NO: 42959 - RNA, 18 nt, Artificial Sequence
  Description of Artificial Sequence: Synthetic oligonucleotide
gaagagucgauguuagag

SEQ ID NO: 42960 - RNA, 18 nt, Artificial Sequence
  Description of Artificial Sequence: Synthetic oligonucleotide
aaggagaagagucgaugu

SEQ ID NO: 42961 - RNA, 18 nt, Artificial Sequence
  Description of Artificial Sequence: Synthetic oligonucleotide
gcuccaaggagaagaguc

SEQ ID NO: 42962 - RNA, 18 nt, Artificial Sequence
  Description of Artificial Sequence: Synthetic oligonucleotide
gagaggcuccaaggagaa

SEQ ID NO: 42963 - RNA, 18 nt, Artificial Sequence
  Description of Artificial Sequence: Synthetic oligonucleotide
agucagagaggcuccaag

SEQ ID NO: 42964 - RNA, 18 nt, Artificial Sequence
  Description of Artificial Sequence: Synthetic oligonucleotide
agcaaagucagagaggcu

SEQ ID NO: 42965 - RNA, 18 nt, Artificial Sequence
  Description of Artificial Sequence: Synthetic oligonucleotide
uguagagcaaagucagag

SEQ ID NO: 42966 - RNA, 18 nt, Artificial Sequence
  Description of Artificial Sequence: Synthetic oligonucleotide
aggacuguagagcaaagu

SEQ ID NO: 42967 - RNA, 18 nt, Artificial Sequence
  Description of Artificial Sequence: Synthetic oligonucleotide
cuccaaggacuguagagc

SEQ ID NO: 42968 - RNA, 18 nt, Artificial Sequence
  Description of Artificial Sequence: Synthetic oligonucleotide
gccuucuccaaggacugu

SEQ ID NO: 42969 - RNA, 18 nt, Artificial Sequence
  Description of Artificial Sequence: Synthetic oligonucleotide
aaaaugccuucuccaagg

SEQ ID NO: 42970 - RNA, 18 nt, Artificial Sequence
  Description of Artificial Sequence: Synthetic oligonucleotide
auuucaaaaugccuucuc

SEQ ID NO: 42971 - RNA, 18 nt, Artificial Sequence
  Description of Artificial Sequence: Synthetic oligonucleotide
uuuggauuucaaaaugcc

SEQ ID NO: 42972 - RNA, 18 nt, Artificial Sequence
  Description of Artificial Sequence: Synthetic oligonucleotide
ggccuuuuggauuucaaa

SEQ ID NO: 42973 - RNA, 18 nt, Artificial Sequence
  Description of Artificial Sequence: Synthetic oligonucleotide
auucaggccuuuuggauu

SEQ ID NO: 42974 - RNA, 18 nt, Artificial Sequence
  Description of Artificial Sequence: Synthetic oligonucleotide
cuugaauucaggccuuuu

SEQ ID NO: 42975 - RNA, 18 nt, Artificial Sequence
  Description of Artificial Sequence: Synthetic oligonucleotide
uggaacuugaauucaggc

SEQ ID NO: 42976 - RNA, 18 nt, Artificial Sequence
  Description of Artificial Sequence: Synthetic oligonucleotide
ggagcuggaacuugaauu

SEQ ID NO: 42977 - RNA, 18 nt, Artificial Sequence
  Description of Artificial Sequence: Synthetic oligonucleotide
gcgguggagcuggaacuu

SEQ ID NO: 42978 - RNA, 18 nt, Artificial Sequence
  Description of Artificial Sequence: Synthetic oligonucleotide
aguaagcgguggagcugg

SEQ ID NO: 42979 - RNA, 18 nt, Artificial Sequence
  Description of Artificial Sequence: Synthetic oligonucleotide
cagcuaguaagcggugga

SEQ ID NO: 42980 - RNA, 18 nt, Artificial Sequence
  Description of Artificial Sequence: Synthetic oligonucleotide
guacacagcuaguaagcg

SEQ ID NO: 42981 - RNA, 18 nt, Artificial Sequence
  Description of Artificial Sequence: Synthetic oligonucleotide
ccuaaguacacagcuagu

SEQ ID NO: 42982 - RNA, 18 nt, Artificial Sequence
  Description of Artificial Sequence: Synthetic oligonucleotide
cuugcccuaaguacacag

SEQ ID NO: 42983 - RNA, 18 nt, Artificial Sequence
  Description of Artificial Sequence: Synthetic oligonucleotide
gcuaacuugcccuaagua

SEQ ID NO: 42984 - RNA, 18 nt, Artificial Sequence
  Description of Artificial Sequence: Synthetic oligonucleotide
cacuagcuaacuugcccu

SEQ ID NO: 42985 - RNA, 18 nt, Artificial Sequence
  Description of Artificial Sequence: Synthetic oligonucleotide
agagacacuagcuaacuu

SEQ ID NO: 42986 - RNA, 18 nt, Artificial Sequence
  Description of Artificial Sequence: Synthetic oligonucleotide
ggcucagagacacuagcu

SEQ ID NO: 42987 - RNA, 18 nt, Artificial Sequence
  Description of Artificial Sequence: Synthetic oligonucleotide
acugaggcucagagacac

SEQ ID NO: 42988 - RNA, 18 nt, Artificial Sequence
  Description of Artificial Sequence: Synthetic oligonucleotide
gggaaacugaggcucaga

SEQ ID NO: 42989 - RNA, 18 nt, Artificial Sequence
  Description of Artificial Sequence: Synthetic oligonucleotide
uagcugggaaacugaggc

SEQ ID NO: 42990 - RNA, 18 nt, Artificial Sequence
  Description of Artificial Sequence: Synthetic oligonucleotide
auuuauagcugggaaacu

SEQ ID NO: 42991 - RNA, 18 nt, Artificial Sequence
  Description of Artificial Sequence: Synthetic oligonucleotide
ucuccauuuauagcuggg

SEQ ID NO: 42992 - RNA, 18 nt, Artificial Sequence
  Description of Artificial Sequence: Synthetic oligonucleotide
ucucuucuccauuuauag

SEQ ID NO: 42993 - RNA, 18 nt, Artificial Sequence
  Description of Artificial Sequence: Synthetic oligonucleotide
gauacucucuucuccauu

SEQ ID NO: 42994 - RNA, 18 nt, Artificial Sequence
  Description of Artificial Sequence: Synthetic oligonucleotide
acuuggauacucucuucu

SEQ ID NO: 42995 - RNA, 18 nt, Artificial Sequence
  Description of Artificial Sequence: Synthetic oligonucleotide
ucuuuacuuggauacucu

SEQ ID NO: 42996 - RNA, 18 nt, Artificial Sequence
  Description of Artificial Sequence: Synthetic oligonucleotide
uucaaucuuuacuuggau

SEQ ID NO: 42997 - RNA, 18 nt, Artificial Sequence
  Description of Artificial Sequence: Synthetic oligonucleotide
ucucauucaaucuuuacu

SEQ ID NO: 42998 - RNA, 18 nt, Artificial Sequence
  Description of Artificial Sequence: Synthetic oligonucleotide
agucaucucauucaaucu

SEQ ID NO: 42999 - RNA, 18 nt, Artificial Sequence
  Description of Artificial Sequence: Synthetic oligonucleotide
auaugagucaucucauuc

SEQ ID NO: 43000 - RNA, 18 nt, Artificial Sequence
  Description of Artificial Sequence: Synthetic oligonucleotide
acuuuauaugagucaucu

SEQ ID NO: 43001 - RNA, 18 nt, Artificial Sequence
  Description of Artificial Sequence: Synthetic oligonucleotide
uaagcacuuuauaugagu

SEQ ID NO: 43002 - RNA, 18 nt, Artificial Sequence
  Description of Artificial Sequence: Synthetic oligonucleotide
caggauaagcacuuuaua

SEQ ID NO: 43003 - RNA, 18 nt, Artificial Sequence
  Description of Artificial Sequence: Synthetic oligonucleotide
ggcaccaggauaagcacu

SEQ ID NO: 43004 - RNA, 18 nt, Artificial Sequence
  Description of Artificial Sequence: Synthetic oligonucleotide
caccaggcaccaggauaa

SEQ ID NO: 43005 - RNA, 18 nt, Artificial Sequence
  Description of Artificial Sequence: Synthetic oligonucleotide
gcacacaccaggcaccag

SEQ ID NO: 43006 - RNA, 18 nt, Artificial Sequence
  Description of Artificial Sequence: Synthetic oligonucleotide
acuuagcacacaccaggc

SEQ ID NO: 43007 - RNA, 18 nt, Artificial Sequence
  Description of Artificial Sequence: Synthetic oligonucleotide
caggcacuuagcacacac

SEQ ID NO: 43008 - RNA, 18 nt, Artificial Sequence
  Description of Artificial Sequence: Synthetic oligonucleotide
gcugccaggcacuuagca

SEQ ID NO: 43009 - RNA, 18 nt, Artificial Sequence
  Description of Artificial Sequence: Synthetic oligonucleotide
ugacagcugccaggcacu

SEQ ID NO: 43010 - RNA, 18 nt, Artificial Sequence
  Description of Artificial Sequence: Synthetic oligonucleotide
aucacugacagcugccag

SEQ ID NO: 43011 - RNA, 18 nt, Artificial Sequence
  Description of Artificial Sequence: Synthetic oligonucleotide
ucauaaucacugacagcu

SEQ ID NO: 43012 - RNA, 18 nt, Artificial Sequence
  Description of Artificial Sequence: Synthetic oligonucleotide
aacagucauaaucacuga

SEQ ID NO: 43013 - RNA, 18 nt, Artificial Sequence
  Description of Artificial Sequence: Synthetic oligonucleotide
gcuauaacagucauaauc

SEQ ID NO: 43014 - RNA, 18 nt, Artificial Sequence
  Description of Artificial Sequence: Synthetic oligonucleotide
uucaugcuauaacaguca

SEQ ID NO: 43015 - RNA, 18 nt, Artificial Sequence
  Description of Artificial Sequence: Synthetic oligonucleotide
caugcuucaugcuauaac

SEQ ID NO: 43016 - RNA, 18 nt, Artificial Sequence
  Description of Artificial Sequence: Synthetic oligonucleotide
gguagcaugcuucaugcu

SEQ ID NO: 43017 - RNA, 18 nt, Artificial Sequence
  Description of Artificial Sequence: Synthetic oligonucleotide
uauaggguagcaugcuuc

SEQ ID NO: 43018 - RNA, 18 nt, Artificial Sequence
  Description of Artificial Sequence: Synthetic oligonucleotide
aucaauauaggguagcau

SEQ ID NO: 43019 - RNA, 18 nt, Artificial Sequence
  Description of Artificial Sequence: Synthetic oligonucleotide
agacaaucaauauagggu

SEQ ID NO: 43020 - RNA, 18 nt, Artificial Sequence
  Description of Artificial Sequence: Synthetic oligonucleotide
aaggaagacaaucaauau

SEQ ID NO: 43021 - RNA, 18 nt, Artificial Sequence
  Description of Artificial Sequence: Synthetic oligonucleotide
cagacaaggaagacaauc

SEQ ID NO: 43022 - RNA, 18 nt, Artificial Sequence
  Description of Artificial Sequence: Synthetic oligonucleotide
cuggacagacaaggaaga

SEQ ID NO: 43023 - RNA, 18 nt, Artificial Sequence
  Description of Artificial Sequence: Synthetic oligonucleotide
accuccuggacagacaag

SEQ ID NO: 43024 - RNA, 18 nt, Artificial Sequence
  Description of Artificial Sequence: Synthetic oligonucleotide
cagcaaccuccuggacag

SEQ ID NO: 43025 - RNA, 18 nt, Artificial Sequence
  Description of Artificial Sequence: Synthetic oligonucleotide
aacaucagcaaccuccug

SEQ ID NO: 43026 - RNA, 18 nt, Artificial Sequence
  Description of Artificial Sequence: Synthetic oligonucleotide
gauggaacaucagcaacc

SEQ ID NO: 43027 - RNA, 18 nt, Artificial Sequence
  Description of Artificial Sequence: Synthetic oligonucleotide
ggguggauggaacaucag

SEQ ID NO: 43028 - RNA, 18 nt, Artificial Sequence
  Description of Artificial Sequence: Synthetic oligonucleotide
cagaacaguguguguggg

SEQ ID NO: 43029 - RNA, 18 nt, Artificial Sequence
  Description of Artificial Sequence: Synthetic oligonucleotide
gggucagaacagugugug

SEQ ID NO: 43030 - RNA, 18 nt, Artificial Sequence
  Description of Artificial Sequence: Synthetic oligonucleotide
ugcugaggcccagcuggg

SEQ ID NO: 43031 - RNA, 18 nt, Artificial Sequence
  Description of Artificial Sequence: Synthetic oligonucleotide
gcugcugaggcccagcug

SEQ ID NO: 43032 - RNA, 18 nt, Artificial Sequence
  Description of Artificial Sequence: Synthetic oligonucleotide
aggcugagaccggagaga

SEQ ID NO: 43033 - RNA, 18 nt, Artificial Sequence
  Description of Artificial Sequence: Synthetic oligonucleotide
uauugaggcugagaccgg

SEQ ID NO: 43034 - RNA, 18 nt, Artificial Sequence
  Description of Artificial Sequence: Synthetic oligonucleotide
caggguauugaggcugag

SEQ ID NO: 43035 - RNA, 18 nt, Artificial Sequence
  Description of Artificial Sequence: Synthetic oligonucleotide
auggucaggguauugagg

SEQ ID NO: 43036 - RNA, 18 nt, Artificial Sequence
  Description of Artificial Sequence: Synthetic oligonucleotide
agaagauggucaggguau

SEQ ID NO: 43037 - RNA, 18 nt, Artificial Sequence
  Description of Artificial Sequence: Synthetic oligonucleotide
gaaagagaagauggucag

SEQ ID NO: 43038 - RNA, 18 nt, Artificial Sequence
  Description of Artificial Sequence: Synthetic oligonucleotide
uugcagaaagagaagaug

SEQ ID NO: 43039 - RNA, 18 nt, Artificial Sequence
  Description of Artificial Sequence: Synthetic oligonucleotide
gggucuugcagaaagaga

SEQ ID NO: 43040 - RNA, 18 nt, Artificial Sequence
  Description of Artificial Sequence: Synthetic oligonucleotide
gcagggaguccgcagcuc

SEQ ID NO: 43041 - RNA, 18 nt, Artificial Sequence
  Description of Artificial Sequence: Synthetic oligonucleotide
agguggcagggaguccgc

SEQ ID NO: 43042 - RNA, 18 nt, Artificial Sequence
  Description of Artificial Sequence: Synthetic oligonucleotide
ccaguagguggcagggag

SEQ ID NO: 43043 - RNA, 18 nt, Artificial Sequence
  Description of Artificial Sequence: Synthetic oligonucleotide
cagcaccaguagguggca

SEQ ID NO: 43044 - RNA, 18 nt, Artificial Sequence
  Description of Artificial Sequence: Synthetic oligonucleotide
aagcucagcaccaguagg

SEQ ID NO: 43045 - RNA, 18 nt, Artificial Sequence
  Description of Artificial Sequence: Synthetic oligonucleotide
gagccaagcucagcacca

SEQ ID NO: 43046 - RNA, 18 nt, Artificial Sequence
  Description of Artificial Sequence: Synthetic oligonucleotide
cgcaagagccaagcucag

SEQ ID NO: 43047 - RNA, 18 nt, Artificial Sequence
  Description of Artificial Sequence: Synthetic oligonucleotide
cuguccgcaagagccaag

SEQ ID NO: 43048 - RNA, 18 nt, Artificial Sequence
  Description of Artificial Sequence: Synthetic oligonucleotide
ucccacuguccgcaagag

SEQ ID NO: 43049 - RNA, 18 nt, Artificial Sequence
  Description of Artificial Sequence: Synthetic oligonucleotide
gcugaucccacuguccgc

SEQ ID NO: 43050 - RNA, 18 nt, Artificial Sequence
  Description of Artificial Sequence: Synthetic oligonucleotide
uucaggcugaucccacug

SEQ ID NO: 43051 - RNA, 18 nt, Artificial Sequence
  Description of Artificial Sequence: Synthetic oligonucleotide
gggcauucaggcugaucc

SEQ ID NO: 43052 - RNA, 18 nt, Artificial Sequence
  Description of Artificial Sequence: Synthetic oligonucleotide
aacgagggcauucaggcu

SEQ ID NO: 43053 - RNA, 18 nt, Artificial Sequence
  Description of Artificial Sequence: Synthetic oligonucleotide
gcugcaacgagggcauuc

SEQ ID NO: 43054 - RNA, 18 nt, Artificial Sequence
  Description of Artificial Sequence: Synthetic oligonucleotide
auguggcugcaacgaggg

SEQ ID NO: 43055 - RNA, 18 nt, Artificial Sequence
  Description of Artificial Sequence: Synthetic oligonucleotide
gcuggauguggcugcaac

SEQ ID NO: 43056 - RNA, 18 nt, Artificial Sequence
  Description of Artificial Sequence: Synthetic oligonucleotide
agaaggcuggauguggcu

SEQ ID NO: 43057 - RNA, 18 nt, Artificial Sequence
  Description of Artificial Sequence: Synthetic oligonucleotide
aggcugagaccggagaga

SEQ ID NO: 43058 - RNA, 18 nt, Artificial Sequence
  Description of Artificial Sequence: Synthetic oligonucleotide
uauugaggcugagaccgg

SEQ ID NO: 43059 - RNA, 18 nt, Artificial Sequence
  Description of Artificial Sequence: Synthetic oligonucleotide
caggguauugaggcugag

SEQ ID NO: 43060 - RNA, 18 nt, Artificial Sequence
  Description of Artificial Sequence: Synthetic oligonucleotide
auggucaggguauugagg

SEQ ID NO: 43061 - RNA, 18 nt, Artificial Sequence
  Description of Artificial Sequence: Synthetic oligonucleotide
agaagauggucaggguau

SEQ ID NO: 43062 - RNA, 18 nt, Artificial Sequence
  Description of Artificial Sequence: Synthetic oligonucleotide
gaaagagaagauggucag

SEQ ID NO: 43063 - RNA, 18 nt, Artificial Sequence
  Description of Artificial Sequence: Synthetic oligonucleotide
uugcagaaagagaagaug

SEQ ID NO: 43064 - RNA, 18 nt, Artificial Sequence
  Description of Artificial Sequence: Synthetic oligonucleotide
gggucuugcagaaagaga

SEQ ID NO: 43065 - RNA, 18 nt, Artificial Sequence
  Description of Artificial Sequence: Synthetic oligonucleotide
ggaguccgcagcuccggg

SEQ ID NO: 43066 - RNA, 18 nt, Artificial Sequence
  Description of Artificial Sequence: Synthetic oligonucleotide
gcagggaguccgcagcuc

SEQ ID NO: 43067 - RNA, 18 nt, Artificial Sequence
  Description of Artificial Sequence: Synthetic oligonucleotide
agguggcagggaguccgc

SEQ ID NO: 43068 - RNA, 18 nt, Artificial Sequence
  Description of Artificial Sequence: Synthetic oligonucleotide
ccaguagguggcagggag

SEQ ID NO: 43069 - RNA, 18 nt, Artificial Sequence
  Description of Artificial Sequence: Synthetic oligonucleotide
cagcaccaguagguggca

SEQ ID NO: 43070 - RNA, 18 nt, Artificial Sequence
  Description of Artificial Sequence: Synthetic oligonucleotide
aagcucagcaccaguagg

SEQ ID NO: 43071 - RNA, 18 nt, Artificial Sequence
  Description of Artificial Sequence: Synthetic oligonucleotide
gagccaagcucagcacca

SEQ ID NO: 43072 - RNA, 18 nt, Artificial Sequence
  Description of Artificial Sequence: Synthetic oligonucleotide
cgcaagagccaagcucag

SEQ ID NO: 43073 - RNA, 18 nt, Artificial Sequence
  Description of Artificial Sequence: Synthetic oligonucleotide
cuguccgcaagagccaag

SEQ ID NO: 43074 - RNA, 18 nt, Artificial Sequence
  Description of Artificial Sequence: Synthetic oligonucleotide
ucccacuguccgcaagag

SEQ ID NO: 43075 - RNA, 18 nt, Artificial Sequence
  Description of Artificial Sequence: Synthetic oligonucleotide
gcugaucccacuguccgc

SEQ ID NO: 43076 - RNA, 18 nt, Artificial Sequence
  Description of Artificial Sequence: Synthetic oligonucleotide
uucaggcugaucccacug

SEQ ID NO: 43077 - RNA, 18 nt, Artificial Sequence
  Description of Artificial Sequence: Synthetic oligonucleotide
gggcauucaggcugaucc

SEQ ID NO: 43078 - RNA, 18 nt, Artificial Sequence
  Description of Artificial Sequence: Synthetic oligonucleotide
aacgagggcauucaggcu

SEQ ID NO: 43079 - RNA, 18 nt, Artificial Sequence
  Description of Artificial Sequence: Synthetic oligonucleotide
gcugcaacgagggcauuc

SEQ ID NO: 43080 - RNA, 18 nt, Artificial Sequence
  Description of Artificial Sequence: Synthetic oligonucleotide
auguggcugcaacgaggg

SEQ ID NO: 43081 - RNA, 18 nt, Artificial Sequence
  Description of Artificial Sequence: Synthetic oligonucleotide
gcuggauguggcugcaac

SEQ ID NO: 43082 - RNA, 18 nt, Artificial Sequence
  Description of Artificial Sequence: Synthetic oligonucleotide
agaaggcuggauguggcu

SEQ ID NO: 43083 - RNA, 18 nt, Artificial Sequence
  Description of Artificial Sequence: Synthetic oligonucleotide
ccagagccuguggacugg

SEQ ID NO: 43084 - RNA, 18 nt, Artificial Sequence
  Description of Artificial Sequence: Synthetic oligonucleotide
ggaccccagagccugugg

SEQ ID NO: 43085 - RNA, 18 nt, Artificial Sequence
  Description of Artificial Sequence: Synthetic oligonucleotide
aggcaggaccccagagcc

SEQ ID NO: 43086 - RNA, 18 nt, Artificial Sequence
  Description of Artificial Sequence: Synthetic oligonucleotide
gccccaggcaggacccca

SEQ ID NO: 43087 - RNA, 18 nt, Artificial Sequence
  Description of Artificial Sequence: Synthetic oligonucleotide
gucaggccccaggcagga

SEQ ID NO: 43088 - RNA, 18 nt, Artificial Sequence
  Description of Artificial Sequence: Synthetic oligonucleotide
gggucaggccccaggcag

SEQ ID NO: 43089 - RNA, 18 nt, Artificial Sequence
  Description of Artificial Sequence: Synthetic oligonucleotide
gcugcccagggcccaggg

SEQ ID NO: 43090 - RNA, 18 nt, Artificial Sequence
  Description of Artificial Sequence: Synthetic oligonucleotide
gccuggcugcccagggcc

SEQ ID NO: 43091 - RNA, 18 nt, Artificial Sequence
  Description of Artificial Sequence: Synthetic oligonucleotide
ccuuggccuggcugccca

SEQ ID NO: 43092 - RNA, 18 nt, Artificial Sequence
  Description of Artificial Sequence: Synthetic oligonucleotide
aaugcccuuggccuggcu

SEQ ID NO: 43093 - RNA, 18 nt, Artificial Sequence
  Description of Artificial Sequence: Synthetic oligonucleotide
guaaaaaugcccuuggcc

SEQ ID NO: 43094 - RNA, 18 nt, Artificial Sequence
  Description of Artificial Sequence: Synthetic oligonucleotide
aaguaguaaaaaugcccu

SEQ ID NO: 43095 - RNA, 18 nt, Artificial Sequence
  Description of Artificial Sequence: Synthetic oligonucleotide
ucuguaaguaguaaaaau

SEQ ID NO: 43096 - RNA, 18 nt, Artificial Sequence
  Description of Artificial Sequence: Synthetic oligonucleotide
aauuuucuguaaguagua

SEQ ID NO: 43097 - RNA, 18 nt, Artificial Sequence
  Description of Artificial Sequence: Synthetic oligonucleotide
uggccaauuuucuguaag

SEQ ID NO: 43098 - RNA, 18 nt, Artificial Sequence
  Description of Artificial Sequence: Synthetic oligonucleotide
gcccuuggccaauuuucu

SEQ ID NO: 43099 - RNA, 18 nt, Artificial Sequence
  Description of Artificial Sequence: Synthetic oligonucleotide
ccucugcccuuggccaau

SEQ ID NO: 43100 - RNA, 18 nt, Artificial Sequence
  Description of Artificial Sequence: Synthetic oligonucleotide
cccacccucugcccuugg

SEQ ID NO: 43101 - RNA, 18 nt, Artificial Sequence
  Description of Artificial Sequence: Synthetic oligonucleotide
gccugcccacccucugcc

SEQ ID NO: 43102 - RNA, 18 nt, Artificial Sequence
  Description of Artificial Sequence: Synthetic oligonucleotide
uuuuagccugcccacccu

SEQ ID NO: 43103 - RNA, 18 nt, Artificial Sequence
  Description of Artificial Sequence: Synthetic oligonucleotide
gcccauuuuagccugccc

SEQ ID NO: 43104 - RNA, 18 nt, Artificial Sequence
  Description of Artificial Sequence: Synthetic oligonucleotide
auucagcccauuuuagcc

SEQ ID NO: 43105 - RNA, 18 nt, Artificial Sequence
  Description of Artificial Sequence: Synthetic oligonucleotide
cuggaauucagcccauuu

SEQ ID NO: 43106 - RNA, 18 nt, Artificial Sequence
  Description of Artificial Sequence: Synthetic oligonucleotide
ucaaucuggaauucagcc

SEQ ID NO: 43107 - RNA, 18 nt, Artificial Sequence
  Description of Artificial Sequence: Synthetic oligonucleotide
cagaaucaaucuggaauu

SEQ ID NO: 43108 - RNA, 18 nt, Artificial Sequence
  Description of Artificial Sequence: Synthetic oligonucleotide
uucuucagaaucaaucug

SEQ ID NO: 43109 - RNA, 18 nt, Artificial Sequence
  Description of Artificial Sequence: Synthetic oligonucleotide
ugucguucuucagaauca

SEQ ID NO: 43110 - RNA, 18 nt, Artificial Sequence
  Description of Artificial Sequence: Synthetic oligonucleotide
ucagcugucguucuucag

SEQ ID NO: 43111 - RNA, 18 nt, Artificial Sequence
  Description of Artificial Sequence: Synthetic oligonucleotide
agaaaucagcugucguuc

SEQ ID NO: 43112 - RNA, 18 nt, Artificial Sequence
  Description of Artificial Sequence: Synthetic oligonucleotide
cuuccagaaaucagcugu

SEQ ID NO: 43113 - RNA, 18 nt, Artificial Sequence
  Description of Artificial Sequence: Synthetic oligonucleotide
ccugucuuccagaaauca

SEQ ID NO: 43114 - RNA, 18 nt, Artificial Sequence
  Description of Artificial Sequence: Synthetic oligonucleotide
caaccccugucuuccaga

SEQ ID NO: 43115 - RNA, 18 nt, Artificial Sequence
  Description of Artificial Sequence: Synthetic oligonucleotide
uucagcaaccccugucuu

SEQ ID NO: 43116 - RNA, 18 nt, Artificial Sequence
  Description of Artificial Sequence: Synthetic oligonucleotide
cagguuucagcaaccccu

SEQ ID NO: 43117 - RNA, 18 nt, Artificial Sequence
  Description of Artificial Sequence: Synthetic oligonucleotide
uucaucagguuucagcaa

SEQ ID NO: 43118 - RNA, 18 nt, Artificial Sequence
  Description of Artificial Sequence: Synthetic oligonucleotide
ucucuuucaucagguuuc

SEQ ID NO: 43119 - RNA, 18 nt, Artificial Sequence
  Description of Artificial Sequence: Synthetic oligonucleotide
uaccaucucuuucaucag

SEQ ID NO: 43120 - RNA, 18 nt, Artificial Sequence
  Description of Artificial Sequence: Synthetic oligonucleotide
cagccuaccaucucuuuc

SEQ ID NO: 43121 - RNA, 18 nt, Artificial Sequence
  Description of Artificial Sequence: Synthetic oligonucleotide
cucuacagccuaccaucu

SEQ ID NO: 43122 - RNA, 18 nt, Artificial Sequence
  Description of Artificial Sequence: Synthetic oligonucleotide
uugaucucuacagccuac

SEQ ID NO: 43123 - RNA, 18 nt, Artificial Sequence
  Description of Artificial Sequence: Synthetic oligonucleotide
caccauugaucucuacag

SEQ ID NO: 43124 - RNA, 18 nt, Artificial Sequence
  Description of Artificial Sequence: Synthetic oligonucleotide
acccacaccauugaucuc

SEQ ID NO: 43125 - RNA, 18 nt, Artificial Sequence
  Description of Artificial Sequence: Synthetic oligonucleotide
acagaacccacaccauug

SEQ ID NO: 43126 - RNA, 18 nt, Artificial Sequence
  Description of Artificial Sequence: Synthetic oligonucleotide
ugguuacagaacccacac

SEQ ID NO: 43127 - RNA, 18 nt, Artificial Sequence
  Description of Artificial Sequence: Synthetic oligonucleotide
uugcuugguuacagaacc

SEQ ID NO: 43128 - RNA, 18 nt, Artificial Sequence
  Description of Artificial Sequence: Synthetic oligonucleotide
cuagguugcuugguuaca

SEQ ID NO: 43129 - RNA, 18 nt, Artificial Sequence
  Description of Artificial Sequence: Synthetic oligonucleotide
caaaccuagguugcuugg

SEQ ID NO: 43130 - RNA, 18 nt, Artificial Sequence
  Description of Artificial Sequence: Synthetic oligonucleotide
gaaugcaaaccuagguug

SEQ ID NO: 43131 - RNA, 18 nt, Artificial Sequence
  Description of Artificial Sequence: Synthetic oligonucleotide
agccagaaugcaaaccua

SEQ ID NO: 43132 - RNA, 18 nt, Artificial Sequence
  Description of Artificial Sequence: Synthetic oligonucleotide
gcugaagccagaaugcaa

SEQ ID NO: 43133 - RNA, 18 nt, Artificial Sequence
  Description of Artificial Sequence: Synthetic oligonucleotide
gaaaugcugaagccagaa

SEQ ID NO: 43134 - RNA, 18 nt, Artificial Sequence
  Description of Artificial Sequence: Synthetic oligonucleotide
aacuagaaaugcugaagc

SEQ ID NO: 43135 - RNA, 18 nt, Artificial Sequence
  Description of Artificial Sequence: Synthetic oligonucleotide
cccagaacuagaaaugcu

SEQ ID NO: 43136 - RNA, 18 nt, Artificial Sequence
  Description of Artificial Sequence: Synthetic oligonucleotide
agaagcccagaacuagaa

SEQ ID NO: 43137 - RNA, 18 nt, Artificial Sequence
  Description of Artificial Sequence: Synthetic oligonucleotide
auggaagaagcccagaac

SEQ ID NO: 43138 - RNA, 18 nt, Artificial Sequence
  Description of Artificial Sequence: Synthetic oligonucleotide
gauuuauggaagaagccc

SEQ ID NO: 43139 - RNA, 18 nt, Artificial Sequence
  Description of Artificial Sequence: Synthetic oligonucleotide
uauccgauuuauggaaga

SEQ ID NO: 43140 - RNA, 18 nt, Artificial Sequence
  Description of Artificial Sequence: Synthetic oligonucleotide
aauaauauccgauuuaug

SEQ ID NO: 43141 - RNA, 18 nt, Artificial Sequence
  Description of Artificial Sequence: Synthetic oligonucleotide
uaggaaauaauauccgau

SEQ ID NO: 43142 - RNA, 18 nt, Artificial Sequence
  Description of Artificial Sequence: Synthetic oligonucleotide
ugaguuaggaaauaauau

SEQ ID NO: 43143 - RNA, 18 nt, Artificial Sequence
  Description of Artificial Sequence: Synthetic oligonucleotide
cuauaugaguuaggaaau

SEQ ID NO: 43144 - RNA, 18 nt, Artificial Sequence
  Description of Artificial Sequence: Synthetic oligonucleotide
accaccuauaugaguuag

SEQ ID NO: 43145 - RNA, 18 nt, Artificial Sequence
  Description of Artificial Sequence: Synthetic oligonucleotide
uuccaaccaccuauauga

SEQ ID NO: 43146 - RNA, 18 nt, Artificial Sequence
  Description of Artificial Sequence: Synthetic oligonucleotide
aauacuuccaaccaccua

SEQ ID NO: 43147 - RNA, 18 nt, Artificial Sequence
  Description of Artificial Sequence: Synthetic oligonucleotide
aaguaaauacuuccaacc

SEQ ID NO: 43148 - RNA, 18 nt, Artificial Sequence
  Description of Artificial Sequence: Synthetic oligonucleotide
aauagaaguaaauacuuc

SEQ ID NO: 43149 - RNA, 18 nt, Artificial Sequence
  Description of Artificial Sequence: Synthetic oligonucleotide
cacauaauagaaguaaau

SEQ ID NO: 43150 - RNA, 18 nt, Artificial Sequence
  Description of Artificial Sequence: Synthetic oligonucleotide
auuuacacauaauagaag

SEQ ID NO: 43151 - RNA, 18 nt, Artificial Sequence
  Description of Artificial Sequence: Synthetic oligonucleotide
aaguuauuuacacauaau

SEQ ID NO: 43152 - RNA, 18 nt, Artificial Sequence
  Description of Artificial Sequence: Synthetic oligonucleotide
auuuuaaguuauuuacac

SEQ ID NO: 43153 - RNA, 18 nt, Artificial Sequence
  Description of Artificial Sequence: Synthetic oligonucleotide
gcauuauuuuaaguuauu

SEQ ID NO: 43154 - RNA, 18 nt, Artificial Sequence
  Description of Artificial Sequence: Synthetic oligonucleotide
aucaagcauuauuuuaag

SEQ ID NO: 43155 - RNA, 18 nt, Artificial Sequence
  Description of Artificial Sequence: Synthetic oligonucleotide
uagguaucaagcauuauu

SEQ ID NO: 43156 - RNA, 18 nt, Artificial Sequence
  Description of Artificial Sequence: Synthetic oligonucleotide
aguccuagguaucaagca

SEQ ID NO: 43157 - RNA, 18 nt, Artificial Sequence
  Description of Artificial Sequence: Synthetic oligonucleotide
cguagaguccuagguauc

SEQ ID NO: 43158 - RNA, 18 nt, Artificial Sequence
  Description of Artificial Sequence: Synthetic oligonucleotide
acuuacguagaguccuag

SEQ ID NO: 43159 - RNA, 18 nt, Artificial Sequence
  Description of Artificial Sequence: Synthetic oligonucleotide
caaacacuuacguagagu

SEQ ID NO: 43160 - RNA, 18 nt, Artificial Sequence
  Description of Artificial Sequence: Synthetic oligonucleotide
guucacaaacacuuacgu

SEQ ID NO: 43161 - RNA, 18 nt, Artificial Sequence
  Description of Artificial Sequence: Synthetic oligonucleotide
uuuguguucacaaacacu

SEQ ID NO: 43162 - RNA, 18 nt, Artificial Sequence
  Description of Artificial Sequence: Synthetic oligonucleotide
ccccauuuguguucacaa

SEQ ID NO: 43163 - RNA, 18 nt, Artificial Sequence
  Description of Artificial Sequence: Synthetic oligonucleotide
aacgcccccauuuguguu

SEQ ID NO: 43164 - RNA, 18 nt, Artificial Sequence
  Description of Artificial Sequence: Synthetic oligonucleotide
gugauaacgcccccauuu

SEQ ID NO: 43165 - RNA, 18 nt, Artificial Sequence
  Description of Artificial Sequence: Synthetic oligonucleotide
uaguggugauaacgcccc

SEQ ID NO: 43166 - RNA, 18 nt, Artificial Sequence
  Description of Artificial Sequence: Synthetic oligonucleotide
ugcaguaguggugauaac

SEQ ID NO: 43167 - RNA, 18 nt, Artificial Sequence
  Description of Artificial Sequence: Synthetic oligonucleotide
acgggugcaguaguggug

SEQ ID NO: 43168 - RNA, 18 nt, Artificial Sequence
  Description of Artificial Sequence: Synthetic oligonucleotide
uacauacgggugcaguag

SEQ ID NO: 43169 - RNA, 18 nt, Artificial Sequence
  Description of Artificial Sequence: Synthetic oligonucleotide
ccagauacauacgggugc

SEQ ID NO: 43170 - RNA, 18 nt, Artificial Sequence
  Description of Artificial Sequence: Synthetic oligonucleotide
ggagcccagauacauacg

SEQ ID NO: 43171 - RNA, 18 nt, Artificial Sequence
  Description of Artificial Sequence: Synthetic oligonucleotide
cuccaggagcccagauac

SEQ ID NO: 43172 - RNA, 18 nt, Artificial Sequence
  Description of Artificial Sequence: Synthetic oligonucleotide
cuccacuccaggagccca

SEQ ID NO: 43173 - RNA, 18 nt, Artificial Sequence
  Description of Artificial Sequence: Synthetic oligonucleotide
ugucccuccacuccagga

SEQ ID NO: 43174 - RNA, 18 nt, Artificial Sequence
  Description of Artificial Sequence: Synthetic oligonucleotide
aucggugucccuccacuc

SEQ ID NO: 43175 - RNA, 18 nt, Artificial Sequence
  Description of Artificial Sequence: Synthetic oligonucleotide
acugcaucggugucccuc

SEQ ID NO: 43176 - RNA, 18 nt, Artificial Sequence
  Description of Artificial Sequence: Synthetic oligonucleotide
uccacacugcaucggugu

SEQ ID NO: 43177 - RNA, 18 nt, Artificial Sequence
  Description of Artificial Sequence: Synthetic oligonucleotide
uccucuccacacugcauc

SEQ ID NO: 43178 - RNA, 18 nt, Artificial Sequence
  Description of Artificial Sequence: Synthetic oligonucleotide
ucuuauccucuccacacu

SEQ ID NO: 43179 - RNA, 18 nt, Artificial Sequence
  Description of Artificial Sequence: Synthetic oligonucleotide
gggcuccagccuccgucu

SEQ ID NO: 43180 - RNA, 18 nt, Artificial Sequence
  Description of Artificial Sequence: Synthetic oligonucleotide
ugagcaugcacauccggg

SEQ ID NO: 43181 - RNA, 18 nt, Artificial Sequence
  Description of Artificial Sequence: Synthetic oligonucleotide
gcacugagcaugcacauc

SEQ ID NO: 43182 - RNA, 18 nt, Artificial Sequence
  Description of Artificial Sequence: Synthetic oligonucleotide
ggucagcacugagcaugc

SEQ ID NO: 43183 - RNA, 18 nt, Artificial Sequence
  Description of Artificial Sequence: Synthetic oligonucleotide
aggcuggucagcacugag

SEQ ID NO: 43184 - RNA, 18 nt, Artificial Sequence
  Description of Artificial Sequence: Synthetic oligonucleotide
cccccaggcuggucagca

SEQ ID NO: 43185 - RNA, 18 nt, Artificial Sequence
  Description of Artificial Sequence: Synthetic oligonucleotide
cagaccccccaggcuggu

SEQ ID NO: 43186 - RNA, 18 nt, Artificial Sequence
  Description of Artificial Sequence: Synthetic oligonucleotide
ugaugcagaccccccagg

SEQ ID NO: 43187 - RNA, 18 nt, Artificial Sequence
  Description of Artificial Sequence: Synthetic oligonucleotide
cucacugaugcagacccc

SEQ ID NO: 43188 - RNA, 18 nt, Artificial Sequence
  Description of Artificial Sequence: Synthetic oligonucleotide
gaguucucacugaugcag

SEQ ID NO: 43189 - RNA, 18 nt, Artificial Sequence
  Description of Artificial Sequence: Synthetic oligonucleotide
aggaagaguucucacuga

SEQ ID NO: 43190 - RNA, 18 nt, Artificial Sequence
  Description of Artificial Sequence: Synthetic oligonucleotide
gugggaggaagaguucuc

SEQ ID NO: 43191 - RNA, 18 nt, Artificial Sequence
  Description of Artificial Sequence: Synthetic oligonucleotide
ucucugugggaggaagag

SEQ ID NO: 43192 - RNA, 18 nt, Artificial Sequence
  Description of Artificial Sequence: Synthetic oligonucleotide
ucaauucucugugggagg

SEQ ID NO: 43193 - RNA, 18 nt, Artificial Sequence
  Description of Artificial Sequence: Synthetic oligonucleotide
aaacuucaauucucugug

SEQ ID NO: 43194 - RNA, 18 nt, Artificial Sequence
  Description of Artificial Sequence: Synthetic oligonucleotide
gguggaaacuucaauucu

SEQ ID NO: 43195 - RNA, 18 nt, Artificial Sequence
  Description of Artificial Sequence: Synthetic oligonucleotide
gcaaagguggaaacuuca

SEQ ID NO: 43196 - RNA, 18 nt, Artificial Sequence
  Description of Artificial Sequence: Synthetic oligonucleotide
ggcaagcaaagguggaaa

SEQ ID NO: 43197 - RNA, 18 nt, Artificial Sequence
  Description of Artificial Sequence: Synthetic oligonucleotide
aaaagggcaagcaaaggu

SEQ ID NO: 43198 - RNA, 18 nt, Artificial Sequence
  Description of Artificial Sequence: Synthetic oligonucleotide
agccuaaaagggcaagca

SEQ ID NO: 43199 - RNA, 18 nt, Artificial Sequence
  Description of Artificial Sequence: Synthetic oligonucleotide
uccccagccuaaaagggc

SEQ ID NO: 43200 - RNA, 18 nt, Artificial Sequence
  Description of Artificial Sequence: Synthetic oligonucleotide
aggccuccccagccuaaa

SEQ ID NO: 43201 - RNA, 18 nt, Artificial Sequence
  Description of Artificial Sequence: Synthetic oligonucleotide
aucccaggccuccccagc

SEQ ID NO: 43202 - RNA, 18 nt, Artificial Sequence
  Description of Artificial Sequence: Synthetic oligonucleotide
gggagaucccaggccucc

SEQ ID NO: 43203 - RNA, 18 nt, Artificial Sequence
  Description of Artificial Sequence: Synthetic oligonucleotide
gaaggcaaagucagaggg

SEQ ID NO: 43204 - RNA, 18 nt, Artificial Sequence
  Description of Artificial Sequence: Synthetic oligonucleotide
ugaaggcaaagucagagg

SEQ ID NO: 43205 - RNA, 18 nt, Artificial Sequence
  Description of Artificial Sequence: Synthetic oligonucleotide
gaagaugaaggcaaaguc

SEQ ID NO: 43206 - RNA, 18 nt, Artificial Sequence
  Description of Artificial Sequence: Synthetic oligonucleotide
acacagaagaugaaggca

SEQ ID NO: 43207 - RNA, 18 nt, Artificial Sequence
  Description of Artificial Sequence: Synthetic oligonucleotide
aggucacacagaagauga

SEQ ID NO: 43208 - RNA, 18 nt, Artificial Sequence
  Description of Artificial Sequence: Synthetic oligonucleotide
agccaaggucacacagaa

SEQ ID NO: 43209 - RNA, 18 nt, Artificial Sequence
  Description of Artificial Sequence: Synthetic oligonucleotide
acugaagccaaggucaca

SEQ ID NO: 43210 - RNA, 18 nt, Artificial Sequence
  Description of Artificial Sequence: Synthetic oligonucleotide
aagauacugaagccaagg

SEQ ID NO: 43211 - RNA, 18 nt, Artificial Sequence
  Description of Artificial Sequence: Synthetic oligonucleotide
aggcaaagauacugaagc

SEQ ID NO: 43212 - RNA, 18 nt, Artificial Sequence
  Description of Artificial Sequence: Synthetic oligonucleotide
caaagaggcaaagauacu

SEQ ID NO: 43213 - RNA, 18 nt, Artificial Sequence
  Description of Artificial Sequence: Synthetic oligonucleotide
acauucaaagaggcaaag

SEQ ID NO: 43214 - RNA, 18 nt, Artificial Sequence
  Description of Artificial Sequence: Synthetic oligonucleotide
aacugacauucaaagagg

SEQ ID NO: 43215 - RNA, 18 nt, Artificial Sequence
  Description of Artificial Sequence: Synthetic oligonucleotide
cuguauuugauagguggg

SEQ ID NO: 43216 - RNA, 18 nt, Artificial Sequence
  Description of Artificial Sequence: Synthetic oligonucleotide
caugccuguauuugauag

SEQ ID NO: 43217 - RNA, 18 nt, Artificial Sequence
  Description of Artificial Sequence: Synthetic oligonucleotide
gagcucaugccuguauuu

SEQ ID NO: 43218 - RNA, 18 nt, Artificial Sequence
  Description of Artificial Sequence: Synthetic oligonucleotide
caggagagcucaugccug

SEQ ID NO: 43219 - RNA, 18 nt, Artificial Sequence
  Description of Artificial Sequence: Synthetic oligonucleotide
ugucacaggagagcucau

SEQ ID NO: 43220 - RNA, 18 nt, Artificial Sequence
  Description of Artificial Sequence: Synthetic oligonucleotide
cccucugucacaggagag

SEQ ID NO: 43221 - RNA, 18 nt, Artificial Sequence
  Description of Artificial Sequence: Synthetic oligonucleotide
cagaucccucugucacag

SEQ ID NO: 43222 - RNA, 18 nt, Artificial Sequence
  Description of Artificial Sequence: Synthetic oligonucleotide
gugaucagaucccucugu

SEQ ID NO: 43223 - RNA, 18 nt, Artificial Sequence
  Description of Artificial Sequence: Synthetic oligonucleotide
ucugcgugaucagauccc

SEQ ID NO: 43224 - RNA, 18 nt, Artificial Sequence
  Description of Artificial Sequence: Synthetic oligonucleotide
cucucucugcgugaucag

SEQ ID NO: 43225 - RNA, 18 nt, Artificial Sequence
  Description of Artificial Sequence: Synthetic oligonucleotide
auaggcucucucugcgug

SEQ ID NO: 43226 - RNA, 18 nt, Artificial Sequence
  Description of Artificial Sequence: Synthetic oligonucleotide
gggccauaggcucucucu

SEQ ID NO: 43227 - RNA, 18 nt, Artificial Sequence
  Description of Artificial Sequence: Synthetic oligonucleotide
ugguugggccauaggcuc

SEQ ID NO: 43228 - RNA, 18 nt, Artificial Sequence
  Description of Artificial Sequence: Synthetic oligonucleotide
caccaugguugggccaua

SEQ ID NO: 43229 - RNA, 18 nt, Artificial Sequence
  Description of Artificial Sequence: Synthetic oligonucleotide
gacugcaccaugguuggg

SEQ ID NO: 43230 - RNA, 18 nt, Artificial Sequence
  Description of Artificial Sequence: Synthetic oligonucleotide
acuuugacugcaccaugg

SEQ ID NO: 43231 - RNA, 18 nt, Artificial Sequence
  Description of Artificial Sequence: Synthetic oligonucleotide
gggugacuuugacugcac

SEQ ID NO: 43232 - RNA, 18 nt, Artificial Sequence
  Description of Artificial Sequence: Synthetic oligonucleotide
aggcugggugacuuugac

SEQ ID NO: 43233 - RNA, 18 nt, Artificial Sequence
  Description of Artificial Sequence: Synthetic oligonucleotide
ucuccaggcugggugacu

SEQ ID NO: 43234 - RNA, 18 nt, Artificial Sequence
  Description of Artificial Sequence: Synthetic oligonucleotide
cacacucuccaggcuggg

SEQ ID NO: 43235 - RNA, 18 nt, Artificial Sequence
  Description of Artificial Sequence: Synthetic oligonucleotide
caaugcacacucuccagg

SEQ ID NO: 43236 - RNA, 18 nt, Artificial Sequence
  Description of Artificial Sequence: Synthetic oligonucleotide
gagcccaaugcacacucu

SEQ ID NO: 43237 - RNA, 18 nt, Artificial Sequence
  Description of Artificial Sequence: Synthetic oligonucleotide
ggguggagcccaaugcac

SEQ ID NO: 43238 - RNA, 18 nt, Artificial Sequence
  Description of Artificial Sequence: Synthetic oligonucleotide
aguaacugggcugaaggg

SEQ ID NO: 43239 - RNA, 18 nt, Artificial Sequence
  Description of Artificial Sequence: Synthetic oligonucleotide
aaguaacugggcugaagg

SEQ ID NO: 43240 - RNA, 18 nt, Artificial Sequence
  Description of Artificial Sequence: Synthetic oligonucleotide
agcucaaguaacugggcu

SEQ ID NO: 43241 - RNA, 18 nt, Artificial Sequence
  Description of Artificial Sequence: Synthetic oligonucleotide
guuggagcucaaguaacu

SEQ ID NO: 43242 - RNA, 18 nt, Artificial Sequence
  Description of Artificial Sequence: Synthetic oligonucleotide
gaggcguuggagcucaag

SEQ ID NO: 43243 - RNA, 18 nt, Artificial Sequence
  Description of Artificial Sequence: Synthetic oligonucleotide
ccuaugaggcguuggagc

SEQ ID NO: 43244 - RNA, 18 nt, Artificial Sequence
  Description of Artificial Sequence: Synthetic oligonucleotide
ucuuuccuaugaggcguu

SEQ ID NO: 43245 - RNA, 18 nt, Artificial Sequence
  Description of Artificial Sequence: Synthetic oligonucleotide
uggugucuuuccuaugag

SEQ ID NO: 43246 - RNA, 18 nt, Artificial Sequence
  Description of Artificial Sequence: Synthetic oligonucleotide
aauauuggugucuuuccu

SEQ ID NO: 43247 - RNA, 18 nt, Artificial Sequence
  Description of Artificial Sequence: Synthetic oligonucleotide
gccuuaauauuggugucu

SEQ ID NO: 43248 - RNA, 18 nt, Artificial Sequence
  Description of Artificial Sequence: Synthetic oligonucleotide
agagggccuuaauauugg

SEQ ID NO: 43249 - RNA, 18 nt, Artificial Sequence
  Description of Artificial Sequence: Synthetic oligonucleotide
ucugaagagggccuuaau

SEQ ID NO: 43250 - RNA, 18 nt, Artificial Sequence
  Description of Artificial Sequence: Synthetic oligonucleotide
ucuucucugaagagggcc

SEQ ID NO: 43251 - RNA, 18 nt, Artificial Sequence
  Description of Artificial Sequence: Synthetic oligonucleotide
gcccuucuucucugaaga

SEQ ID NO: 43252 - RNA, 18 nt, Artificial Sequence
  Description of Artificial Sequence: Synthetic oligonucleotide
augcugcccuucuucucu

SEQ ID NO: 43253 - RNA, 18 nt, Artificial Sequence
  Description of Artificial Sequence: Synthetic oligonucleotide
ccugaaugcugcccuucu

SEQ ID NO: 43254 - RNA, 18 nt, Artificial Sequence
  Description of Artificial Sequence: Synthetic oligonucleotide
guguuccugaaugcugcc

SEQ ID NO: 43255 - RNA, 18 nt, Artificial Sequence
  Description of Artificial Sequence: Synthetic oligonucleotide
aguguguguuccugaaug

SEQ ID NO: 43256 - RNA, 18 nt, Artificial Sequence
  Description of Artificial Sequence: Synthetic oligonucleotide
cuuggaguguguguuccu

SEQ ID NO: 43257 - RNA, 18 nt, Artificial Sequence
  Description of Artificial Sequence: Synthetic oligonucleotide
uacagcuuggagugugug

SEQ ID NO: 43258 - RNA, 18 nt, Artificial Sequence
  Description of Artificial Sequence: Synthetic oligonucleotide
ccaaguacagcuuggagu

SEQ ID NO: 43259 - RNA, 18 nt, Artificial Sequence
  Description of Artificial Sequence: Synthetic oligonucleotide
accugccaaguacagcuu

SEQ ID NO: 43260 - RNA, 18 nt, Artificial Sequence
  Description of Artificial Sequence: Synthetic oligonucleotide
cccacaccugccaaguac

SEQ ID NO: 43261 - RNA, 18 nt, Artificial Sequence
  Description of Artificial Sequence: Synthetic oligonucleotide
caccucccacaccugcca

SEQ ID NO: 43262 - RNA, 18 nt, Artificial Sequence
  Description of Artificial Sequence: Synthetic oligonucleotide
cuuuccaccucccacacc

SEQ ID NO: 43263 - RNA, 18 nt, Artificial Sequence
  Description of Artificial Sequence: Synthetic oligonucleotide
cgauccuuuccaccuccc

SEQ ID NO: 43264 - RNA, 18 nt, Artificial Sequence
  Description of Artificial Sequence: Synthetic oligonucleotide
uccuccgauccuuuccac

SEQ ID NO: 43265 - RNA, 18 nt, Artificial Sequence
  Description of Artificial Sequence: Synthetic oligonucleotide
accucuccuccgauccuu

SEQ ID NO: 43266 - RNA, 18 nt, Artificial Sequence
  Description of Artificial Sequence: Synthetic oligonucleotide
cagugaccucuccuccga

SEQ ID NO: 43267 - RNA, 18 nt, Artificial Sequence
  Description of Artificial Sequence: Synthetic oligonucleotide
ggcaccagugaccucucc

SEQ ID NO: 43268 - RNA, 18 nt, Artificial Sequence
  Description of Artificial Sequence: Synthetic oligonucleotide
cgagccguagggccagcg

SEQ ID NO: 43269 - RNA, 18 nt, Artificial Sequence
  Description of Artificial Sequence: Synthetic oligonucleotide
ccguccgagccguagggc

SEQ ID NO: 43270 - RNA, 18 nt, Artificial Sequence
  Description of Artificial Sequence: Synthetic oligonucleotide
ggcagccguccgagccgu

SEQ ID NO: 43271 - RNA, 18 nt, Artificial Sequence
  Description of Artificial Sequence: Synthetic oligonucleotide
agccuggcagccguccga

SEQ ID NO: 43272 - RNA, 18 nt, Artificial Sequence
  Description of Artificial Sequence: Synthetic oligonucleotide
ccgugagccuggcagccg

SEQ ID NO: 43273 - RNA, 18 nt, Artificial Sequence
  Description of Artificial Sequence: Synthetic oligonucleotide
ggaagccgugagccuggc

SEQ ID NO: 43274 - RNA, 18 nt, Artificial Sequence
  Description of Artificial Sequence: Synthetic oligonucleotide
gcccuggaagccgugagc

SEQ ID NO: 43275 - RNA, 18 nt, Artificial Sequence
  Description of Artificial Sequence: Synthetic oligonucleotide
acaaagcccuggaagccg

SEQ ID NO: 43276 - RNA, 18 nt, Artificial Sequence
  Description of Artificial Sequence: Synthetic oligonucleotide
cugucacaaagcccugga

SEQ ID NO: 43277 - RNA, 18 nt, Artificial Sequence
  Description of Artificial Sequence: Synthetic oligonucleotide
caacgcugucacaaagcc

SEQ ID NO: 43278 - RNA, 18 nt, Artificial Sequence
  Description of Artificial Sequence: Synthetic oligonucleotide
cuggccaacgcugucaca

SEQ ID NO: 43279 - RNA, 18 nt, Artificial Sequence
  Description of Artificial Sequence: Synthetic oligonucleotide
agaugcuggccaacgcug

SEQ ID NO: 43280 - RNA, 18 nt, Artificial Sequence
  Description of Artificial Sequence: Synthetic oligonucleotide
gcugcagaugcuggccaa

SEQ ID NO: 43281 - RNA, 18 nt, Artificial Sequence
  Description of Artificial Sequence: Synthetic oligonucleotide
gcacugcugcagaugcug

SEQ ID NO: 43282 - RNA, 18 nt, Artificial Sequence
  Description of Artificial Sequence: Synthetic oligonucleotide
uggcugcacugcugcaga

SEQ ID NO: 43283 - RNA, 18 nt, Artificial Sequence
  Description of Artificial Sequence: Synthetic oligonucleotide
ugcgauggcugcacugcu

SEQ ID NO: 43284 - RNA, 18 nt, Artificial Sequence
  Description of Artificial Sequence: Synthetic oligonucleotide
ccccaugcgauggcugca

SEQ ID NO: 43285 - RNA, 18 nt, Artificial Sequence
  Description of Artificial Sequence: Synthetic oligonucleotide
aacgcccccaugcgaugg

SEQ ID NO: 43286 - RNA, 18 nt, Artificial Sequence
  Description of Artificial Sequence: Synthetic oligonucleotide
gugauaacgcccccaugc

SEQ ID NO: 43287 - RNA, 18 nt, Artificial Sequence
  Description of Artificial Sequence: Synthetic oligonucleotide
uaguggugauaacgcccc

SEQ ID NO: 43288 - RNA, 18 nt, Artificial Sequence
  Description of Artificial Sequence: Synthetic oligonucleotide
ugcaguaguggugauaac

SEQ ID NO: 43289 - RNA, 18 nt, Artificial Sequence
  Description of Artificial Sequence: Synthetic oligonucleotide
caguggcccagcugucuc

SEQ ID NO: 43290 - RNA, 18 nt, Artificial Sequence
  Description of Artificial Sequence: Synthetic oligonucleotide
acugccaguggcccagcu

SEQ ID NO: 43291 - RNA, 18 nt, Artificial Sequence
  Description of Artificial Sequence: Synthetic oligonucleotide
cccucacugccaguggcc

SEQ ID NO: 43292 - RNA, 18 nt, Artificial Sequence
  Description of Artificial Sequence: Synthetic oligonucleotide
acucucccucacugccag

SEQ ID NO: 43293 - RNA, 18 nt, Artificial Sequence
  Description of Artificial Sequence: Synthetic oligonucleotide
uccucacucucccucacu

SEQ ID NO: 43294 - RNA, 18 nt, Artificial Sequence
  Description of Artificial Sequence: Synthetic oligonucleotide
ugccauccucacucuccc

SEQ ID NO: 43295 - RNA, 18 nt, Artificial Sequence
  Description of Artificial Sequence: Synthetic oligonucleotide
gucucugccauccucacu

SEQ ID NO: 43296 - RNA, 18 nt, Artificial Sequence
  Description of Artificial Sequence: Synthetic oligonucleotide
cacuggucucugccaucc

SEQ ID NO: 43297 - RNA, 18 nt, Artificial Sequence
  Description of Artificial Sequence: Synthetic oligonucleotide
cagggcacuggucucugc

SEQ ID NO: 43298 - RNA, 18 nt, Artificial Sequence
  Description of Artificial Sequence: Synthetic oligonucleotide
gugggcagggcacugguc

SEQ ID NO: 43299 - RNA, 18 nt, Artificial Sequence
  Description of Artificial Sequence: Synthetic oligonucleotide
agccagugggcagggcac

SEQ ID NO: 43300 - RNA, 18 nt, Artificial Sequence
  Description of Artificial Sequence: Synthetic oligonucleotide
cccgaagccagugggcag

SEQ ID NO: 43301 - RNA, 18 nt, Artificial Sequence
  Description of Artificial Sequence: Synthetic oligonucleotide
agcuccccgaagccagug

SEQ ID NO: 43302 - RNA, 18 nt, Artificial Sequence
  Description of Artificial Sequence: Synthetic oligonucleotide
ccucgagcuccccgaagc

SEQ ID NO: 43303 - RNA, 18 nt, Artificial Sequence
  Description of Artificial Sequence: Synthetic oligonucleotide
cagcaccucgagcucccc

SEQ ID NO: 43304 - RNA, 18 nt, Artificial Sequence
  Description of Artificial Sequence: Synthetic oligonucleotide
acagccagcaccucgagc

SEQ ID NO: 43305 - RNA, 18 nt, Artificial Sequence
  Description of Artificial Sequence: Synthetic oligonucleotide
uccccacagccagcaccu

SEQ ID NO: 43306 - RNA, 18 nt, Artificial Sequence
  Description of Artificial Sequence: Synthetic oligonucleotide
caccauccccacagccag

SEQ ID NO: 43307 - RNA, 18 nt, Artificial Sequence
  Description of Artificial Sequence: Synthetic oligonucleotide
aguagcaccauccccaca

SEQ ID NO: 43308 - RNA, 18 nt, Artificial Sequence
  Description of Artificial Sequence: Synthetic oligonucleotide
ccaccaguagcaccaucc

SEQ ID NO: 43309 - RNA, 18 nt, Artificial Sequence
  Description of Artificial Sequence: Synthetic oligonucleotide
accccagguucugccugg

SEQ ID NO: 43310 - RNA, 18 nt, Artificial Sequence
  Description of Artificial Sequence: Synthetic oligonucleotide
gcugcaccccagguucug

SEQ ID NO: 43311 - RNA, 18 nt, Artificial Sequence
  Description of Artificial Sequence: Synthetic oligonucleotide
cccccgcugcaccccagg

SEQ ID NO: 43312 - RNA, 18 nt, Artificial Sequence
  Description of Artificial Sequence: Synthetic oligonucleotide
cugggcccccgcugcacc

SEQ ID NO: 43313 - RNA, 18 nt, Artificial Sequence
  Description of Artificial Sequence: Synthetic oligonucleotide
acccacugggcccccgcu

SEQ ID NO: 43314 - RNA, 18 nt, Artificial Sequence
  Description of Artificial Sequence: Synthetic oligonucleotide
ucagaacccacugggccc

SEQ ID NO: 43315 - RNA, 18 nt, Artificial Sequence
  Description of Artificial Sequence: Synthetic oligonucleotide
gguccucagaacccacug

SEQ ID NO: 43316 - RNA, 18 nt, Artificial Sequence
  Description of Artificial Sequence: Synthetic oligonucleotide
gccuggguccucagaacc

SEQ ID NO: 43317 - RNA, 18 nt, Artificial Sequence
  Description of Artificial Sequence: Synthetic oligonucleotide
ugguggccuggguccuca

SEQ ID NO: 43318 - RNA, 18 nt, Artificial Sequence
  Description of Artificial Sequence: Synthetic oligonucleotide
cacacugguggccugggu

SEQ ID NO: 43319 - RNA, 18 nt, Artificial Sequence
  Description of Artificial Sequence: Synthetic oligonucleotide
agcuccacacugguggcc

SEQ ID NO: 43320 - RNA, 18 nt, Artificial Sequence
  Description of Artificial Sequence: Synthetic oligonucleotide
uugccagcuccacacugg

SEQ ID NO: 43321 - RNA, 18 nt, Artificial Sequence
  Description of Artificial Sequence: Synthetic oligonucleotide
ucuccuugccagcuccac

SEQ ID NO: 43322 - RNA, 18 nt, Artificial Sequence
  Description of Artificial Sequence: Synthetic oligonucleotide
ucuccucuccuugccagc

SEQ ID NO: 43323 - RNA, 18 nt, Artificial Sequence
  Description of Artificial Sequence: Synthetic oligonucleotide
ggaccucuccucuccuug

SEQ ID NO: 43324 - RNA, 18 nt, Artificial Sequence
  Description of Artificial Sequence: Synthetic oligonucleotide
gggaccucuccucuccuu

SEQ ID NO: 43325 - RNA, 18 nt, Artificial Sequence
  Description of Artificial Sequence: Synthetic oligonucleotide
cacccagcuggguuuggg

SEQ ID NO: 43326 - RNA, 18 nt, Artificial Sequence
  Description of Artificial Sequence: Synthetic oligonucleotide
ccggacacccagcugggu

SEQ ID NO: 43327 - RNA, 18 nt, Artificial Sequence
  Description of Artificial Sequence: Synthetic oligonucleotide
ugggaccggacacccagc

SEQ ID NO: 43328 - RNA, 18 nt, Artificial Sequence
  Description of Artificial Sequence: Synthetic oligonucleotide
gccaaugggaccggacac

SEQ ID NO: 43329 - RNA, 18 nt, Artificial Sequence
  Description of Artificial Sequence: Synthetic oligonucleotide
aggcagccaaugggaccg

SEQ ID NO: 43330 - RNA, 18 nt, Artificial Sequence
  Description of Artificial Sequence: Synthetic oligonucleotide
gggaaggcagccaauggg

SEQ ID NO: 43331 - RNA, 18 nt, Artificial Sequence
  Description of Artificial Sequence: Synthetic oligonucleotide
gaguccgggcacagaggg

SEQ ID NO: 43332 - RNA, 18 nt, Artificial Sequence
  Description of Artificial Sequence: Synthetic oligonucleotide
cccccgaguccgggcaca

SEQ ID NO: 43333 - RNA, 18 nt, Artificial Sequence
  Description of Artificial Sequence: Synthetic oligonucleotide
aacaccccccgaguccgg

SEQ ID NO: 43334 - RNA, 18 nt, Artificial Sequence
  Description of Artificial Sequence: Synthetic oligonucleotide
gucagaacaccccccgag

SEQ ID NO: 43335 - RNA, 18 nt, Artificial Sequence
  Description of Artificial Sequence: Synthetic oligonucleotide
caauugucagaacacccc

SEQ ID NO: 43336 - RNA, 18 nt, Artificial Sequence
  Description of Artificial Sequence: Synthetic oligonucleotide
agguucaauugucagaac

SEQ ID NO: 43337 - RNA, 18 nt, Artificial Sequence
  Description of Artificial Sequence: Synthetic oligonucleotide
cucacagguucaauuguc

SEQ ID NO: 43338 - RNA, 18 nt, Artificial Sequence
  Description of Artificial Sequence: Synthetic oligonucleotide
ugcaccucacagguucaa

SEQ ID NO: 43339 - RNA, 18 nt, Artificial Sequence
  Description of Artificial Sequence: Synthetic oligonucleotide
ugugcugcaccucacagg

SEQ ID NO: 43340 - RNA, 18 nt, Artificial Sequence
  Description of Artificial Sequence: Synthetic oligonucleotide
ggcagugugcugcaccuc

SEQ ID NO: 43341 - RNA, 18 nt, Artificial Sequence
  Description of Artificial Sequence: Synthetic oligonucleotide
cagcgggcagugugcugc

SEQ ID NO: 43342 - RNA, 18 nt, Artificial Sequence
  Description of Artificial Sequence: Synthetic oligonucleotide
gcucccagcgggcagugu

SEQ ID NO: 43343 - RNA, 18 nt, Artificial Sequence
  Description of Artificial Sequence: Synthetic oligonucleotide
ucucugcucccagcgggc

SEQ ID NO: 43344 - RNA, 18 nt, Artificial Sequence
  Description of Artificial Sequence: Synthetic oligonucleotide
cuuccucucugcucccag

SEQ ID NO: 43345 - RNA, 18 nt, Artificial Sequence
  Description of Artificial Sequence: Synthetic oligonucleotide
ccuggcuuccucucugcu

SEQ ID NO: 43346 - RNA, 18 nt, Artificial Sequence
  Description of Artificial Sequence: Synthetic oligonucleotide
ccuugccuggcuuccucu

SEQ ID NO: 43347 - RNA, 18 nt, Artificial Sequence
  Description of Artificial Sequence: Synthetic oligonucleotide
cugacccuugccuggcuu

SEQ ID NO: 43348 - RNA, 18 nt, Artificial Sequence
  Description of Artificial Sequence: Synthetic oligonucleotide
ccucccugacccuugccu

SEQ ID NO: 43349 - RNA, 18 nt, Artificial Sequence
  Description of Artificial Sequence: Synthetic oligonucleotide
cccucccucccugacccu

SEQ ID NO: 43350 - RNA, 18 nt, Artificial Sequence
  Description of Artificial Sequence: Synthetic oligonucleotide
aaagucccucccucccug

SEQ ID NO: 43351 - RNA, 18 nt, Artificial Sequence
  Description of Artificial Sequence: Synthetic oligonucleotide
cuuucaaagucccucccu

SEQ ID NO: 43352 - RNA, 18 nt, Artificial Sequence
  Description of Artificial Sequence: Synthetic oligonucleotide
guccccuuucaaaguccc

SEQ ID NO: 43353 - RNA, 18 nt, Artificial Sequence
  Description of Artificial Sequence: Synthetic oligonucleotide
cagauguccccuuucaaa

SEQ ID NO: 43354 - RNA, 18 nt, Artificial Sequence
  Description of Artificial Sequence: Synthetic oligonucleotide
cugggcagauguccccuu

SEQ ID NO: 43355 - RNA, 18 nt, Artificial Sequence
  Description of Artificial Sequence: Synthetic oligonucleotide
aucuccugggcagauguc

SEQ ID NO: 43356 - RNA, 18 nt, Artificial Sequence
  Description of Artificial Sequence: Synthetic oligonucleotide
ugaucaucuccugggcag

SEQ ID NO: 43357 - RNA, 18 nt, Artificial Sequence
  Description of Artificial Sequence: Synthetic oligonucleotide
gcucuugaucaucuccug

SEQ ID NO: 43358 - RNA, 18 nt, Artificial Sequence
  Description of Artificial Sequence: Synthetic oligonucleotide
gccuggcucuugaucauc

SEQ ID NO: 43359 - RNA, 18 nt, Artificial Sequence
  Description of Artificial Sequence: Synthetic oligonucleotide
cuaaagccuggcucuuga

SEQ ID NO: 43360 - RNA, 18 nt, Artificial Sequence
  Description of Artificial Sequence: Synthetic oligonucleotide
aaguccuaaagccuggcu

SEQ ID NO: 43361 - RNA, 18 nt, Artificial Sequence
  Description of Artificial Sequence: Synthetic oligonucleotide
augaaaaguccuaaagcc

SEQ ID NO: 43362 - RNA, 18 nt, Artificial Sequence
  Description of Artificial Sequence: Synthetic oligonucleotide
gggacaugaaaaguccua

SEQ ID NO: 43363 - RNA, 18 nt, Artificial Sequence
  Description of Artificial Sequence: Synthetic oligonucleotide
cuggagggacaugaaaag

SEQ ID NO: 43364 - RNA, 18 nt, Artificial Sequence
  Description of Artificial Sequence: Synthetic oligonucleotide
cccggcuggagggacaug

SEQ ID NO: 43365 - RNA, 18 nt, Artificial Sequence
  Description of Artificial Sequence: Synthetic oligonucleotide
uuucucccggcuggaggg

SEQ ID NO: 43366 - RNA, 18 nt, Artificial Sequence
  Description of Artificial Sequence: Synthetic oligonucleotide
uaaauuuucucccggcug

SEQ ID NO: 43367 - RNA, 18 nt, Artificial Sequence
  Description of Artificial Sequence: Synthetic oligonucleotide
uggauuaaauuuucuccc

SEQ ID NO: 43368 - RNA, 18 nt, Artificial Sequence
  Description of Artificial Sequence: Synthetic oligonucleotide
aggaguggauuaaauuuu

SEQ ID NO: 43369 - RNA, 18 nt, Artificial Sequence
  Description of Artificial Sequence: Synthetic oligonucleotide
uuccaaggaguggauuaa

SEQ ID NO: 43370 - RNA, 18 nt, Artificial Sequence
  Description of Artificial Sequence: Synthetic oligonucleotide
aggauuuccaaggagugg

SEQ ID NO: 43371 - RNA, 18 nt, Artificial Sequence
  Description of Artificial Sequence: Synthetic oligonucleotide
ucagcaggauuuccaagg

SEQ ID NO: 43372 - RNA, 18 nt, Artificial Sequence
  Description of Artificial Sequence: Synthetic oligonucleotide
gauucucagcaggauuuc

SEQ ID NO: 43373 - RNA, 18 nt, Artificial Sequence
  Description of Artificial Sequence: Synthetic oligonucleotide
ugugggauucucagcagg

SEQ ID NO: 43374 - RNA, 18 nt, Artificial Sequence
  Description of Artificial Sequence: Synthetic oligonucleotide
ucuuaugugggauucuca

SEQ ID NO: 43375 - RNA, 18 nt, Artificial Sequence
  Description of Artificial Sequence: Synthetic oligonucleotide
acugaucuuaugugggau

SEQ ID NO: 43376 - RNA, 18 nt, Artificial Sequence
  Description of Artificial Sequence: Synthetic oligonucleotide
gggacugaucuuaugugg

SEQ ID NO: 43377 - RNA, 18 nt, Artificial Sequence
  Description of Artificial Sequence: Synthetic oligonucleotide
uccccagagccuuuuggg

SEQ ID NO: 43378 - RNA, 18 nt, Artificial Sequence
  Description of Artificial Sequence: Synthetic oligonucleotide
gucuguccccagagccuu

SEQ ID NO: 43379 - RNA, 18 nt, Artificial Sequence
  Description of Artificial Sequence: Synthetic oligonucleotide
gagcugucuguccccaga

SEQ ID NO: 43380 - RNA, 18 nt, Artificial Sequence
  Description of Artificial Sequence: Synthetic oligonucleotide
aggcagagcugucugucc

SEQ ID NO: 43381 - RNA, 18 nt, Artificial Sequence
  Description of Artificial Sequence: Synthetic oligonucleotide
gcaggaggcagagcuguc

SEQ ID NO: 43382 - RNA, 18 nt, Artificial Sequence
  Description of Artificial Sequence: Synthetic oligonucleotide
caagagcaggaggcagag

SEQ ID NO: 43383 - RNA, 18 nt, Artificial Sequence
  Description of Artificial Sequence: Synthetic oligonucleotide
ccacacaagagcaggagg

SEQ ID NO: 43384 - RNA, 18 nt, Artificial Sequence
  Description of Artificial Sequence: Synthetic oligonucleotide
uccagccacacaagagca

SEQ ID NO: 43385 - RNA, 18 nt, Artificial Sequence
  Description of Artificial Sequence: Synthetic oligonucleotide
uugguuccagccacacaa

SEQ ID NO: 43386 - RNA, 18 nt, Artificial Sequence
  Description of Artificial Sequence: Synthetic oligonucleotide
gggacuugguuccagcca

SEQ ID NO: 43387 - RNA, 18 nt, Artificial Sequence
  Description of Artificial Sequence: Synthetic oligonucleotide
cugaagggacuugguucc

SEQ ID NO: 43388 - RNA, 18 nt, Artificial Sequence
  Description of Artificial Sequence: Synthetic oligonucleotide
gagagcugaagggacuug

SEQ ID NO: 43389 - RNA, 18 nt, Artificial Sequence
  Description of Artificial Sequence: Synthetic oligonucleotide
gggcagagagcugaaggg

SEQ ID NO: 43390 - RNA, 18 nt, Artificial Sequence
  Description of Artificial Sequence: Synthetic oligonucleotide
auugagggcagagagcug

SEQ ID NO: 43391 - RNA, 18 nt, Artificial Sequence
  Description of Artificial Sequence: Synthetic oligonucleotide
aaggcauugagggcagag

SEQ ID NO: 43392 - RNA, 18 nt, Artificial Sequence
  Description of Artificial Sequence: Synthetic oligonucleotide
augucaaggcauugaggg

SEQ ID NO: 43393 - RNA, 18 nt, Artificial Sequence
  Description of Artificial Sequence: Synthetic oligonucleotide
ucggaaugucaaggcauu

SEQ ID NO: 43394 - RNA, 18 nt, Artificial Sequence
  Description of Artificial Sequence: Synthetic oligonucleotide
cccauucggaaugucaag

SEQ ID NO: 43395 - RNA, 18 nt, Artificial Sequence
  Description of Artificial Sequence: Synthetic oligonucleotide
aaccacccauucggaaug

SEQ ID NO: 43396 - RNA, 18 nt, Artificial Sequence
  Description of Artificial Sequence: Synthetic oligonucleotide
uuuacaaccacccauucg

SEQ ID NO: 43397 - RNA, 18 nt, Artificial Sequence
  Description of Artificial Sequence: Synthetic oligonucleotide
uaaucuuuacaaccaccc

SEQ ID NO: 43398 - RNA, 18 nt, Artificial Sequence
  Description of Artificial Sequence: Synthetic oligonucleotide
ccauuuaaucuuuacaac

SEQ ID NO: 43399 - RNA, 18 nt, Artificial Sequence
  Description of Artificial Sequence: Synthetic oligonucleotide
uuaucccauuuaaucuuu

SEQ ID NO: 43400 - RNA, 18 nt, Artificial Sequence
  Description of Artificial Sequence: Synthetic oligonucleotide
acccauuaucccauuuaa

SEQ ID NO: 43401 - RNA, 18 nt, Artificial Sequence
  Description of Artificial Sequence: Synthetic oligonucleotide
uuuauacccauuauccca

SEQ ID NO: 43402 - RNA, 18 nt, Artificial Sequence
  Description of Artificial Sequence: Synthetic oligonucleotide
agcacuuuauacccauua

SEQ ID NO: 43403 - RNA, 18 nt, Artificial Sequence
  Description of Artificial Sequence: Synthetic oligonucleotide
accuugaauuuuggcuug

SEQ ID NO: 43404 - RNA, 18 nt, Artificial Sequence
  Description of Artificial Sequence: Synthetic oligonucleotide
acccgaccuugaauuuug

SEQ ID NO: 43405 - RNA, 18 nt, Artificial Sequence
  Description of Artificial Sequence: Synthetic oligonucleotide
gagagacccgaccuugaa

SEQ ID NO: 43406 - RNA, 18 nt, Artificial Sequence
  Description of Artificial Sequence: Synthetic oligonucleotide
caacagagagacccgacc

SEQ ID NO: 43407 - RNA, 18 nt, Artificial Sequence
  Description of Artificial Sequence: Synthetic oligonucleotide
ucuggcaacagagagacc

SEQ ID NO: 43408 - RNA, 18 nt, Artificial Sequence
  Description of Artificial Sequence: Synthetic oligonucleotide
cguacucuggcaacagag

SEQ ID NO: 43409 - RNA, 18 nt, Artificial Sequence
  Description of Artificial Sequence: Synthetic oligonucleotide
ggaagugaacaugaaggg

SEQ ID NO: 43410 - RNA, 18 nt, Artificial Sequence
  Description of Artificial Sequence: Synthetic oligonucleotide
ggcauggaagugaacaug

SEQ ID NO: 43411 - RNA, 18 nt, Artificial Sequence
  Description of Artificial Sequence: Synthetic oligonucleotide
cgccaggcauggaaguga

SEQ ID NO: 43412 - RNA, 18 nt, Artificial Sequence
  Description of Artificial Sequence: Synthetic oligonucleotide
caggacgccaggcaugga

SEQ ID NO: 43413 - RNA, 18 nt, Artificial Sequence
  Description of Artificial Sequence: Synthetic oligonucleotide
cugcccaggacgccaggc

SEQ ID NO: 43414 - RNA, 18 nt, Artificial Sequence
  Description of Artificial Sequence: Synthetic oligonucleotide
gggagcugcccaggacgc

SEQ ID NO: 43415 - RNA, 18 nt, Artificial Sequence
  Description of Artificial Sequence: Synthetic oligonucleotide
gagcugggagcugcccag

SEQ ID NO: 43416 - RNA, 18 nt, Artificial Sequence
  Description of Artificial Sequence: Synthetic oligonucleotide
uguuagagcugggagcug

SEQ ID NO: 43417 - RNA, 18 nt, Artificial Sequence
  Description of Artificial Sequence: Synthetic oligonucleotide
gucgauguuagagcuggg

SEQ ID NO: 43418 - RNA, 18 nt, Artificial Sequence
  Description of Artificial Sequence: Synthetic oligonucleotide
gaagagucgauguuagag

SEQ ID NO: 43419 - RNA, 18 nt, Artificial Sequence
  Description of Artificial Sequence: Synthetic oligonucleotide
aaggagaagagucgaugu

SEQ ID NO: 43420 - RNA, 18 nt, Artificial Sequence
  Description of Artificial Sequence: Synthetic oligonucleotide
gcuccaaggagaagaguc

SEQ ID NO: 43421 - RNA, 18 nt, Artificial Sequence
  Description of Artificial Sequence: Synthetic oligonucleotide
gagaggcuccaaggagaa

SEQ ID NO: 43422 - RNA, 18 nt, Artificial Sequence
  Description of Artificial Sequence: Synthetic oligonucleotide
agucagagaggcuccaag

SEQ ID NO: 43423 - RNA, 18 nt, Artificial Sequence
  Description of Artificial Sequence: Synthetic oligonucleotide
agcaaagucagagaggcu

SEQ ID NO: 43424 - RNA, 18 nt, Artificial Sequence
  Description of Artificial Sequence: Synthetic oligonucleotide
uguagagcaaagucagag

SEQ ID NO: 43425 - RNA, 18 nt, Artificial Sequence
  Description of Artificial Sequence: Synthetic oligonucleotide
aggacuguagagcaaagu

SEQ ID NO: 43426 - RNA, 18 nt, Artificial Sequence
  Description of Artificial Sequence: Synthetic oligonucleotide
cuccaaggacuguagagc

SEQ ID NO: 43427 - RNA, 18 nt, Artificial Sequence
  Description of Artificial Sequence: Synthetic oligonucleotide
gccuucuccaaggacugu

SEQ ID NO: 43428 - RNA, 18 nt, Artificial Sequence
  Description of Artificial Sequence: Synthetic oligonucleotide
aaaaugccuucuccaagg

SEQ ID NO: 43429 - RNA, 18 nt, Artificial Sequence
  Description of Artificial Sequence: Synthetic oligonucleotide
auuucaaaaugccuucuc

SEQ ID NO: 43430 - RNA, 18 nt, Artificial Sequence
  Description of Artificial Sequence: Synthetic oligonucleotide
uuuggauuucaaaaugcc

SEQ ID NO: 43431 - RNA, 18 nt, Artificial Sequence
  Description of Artificial Sequence: Synthetic oligonucleotide
ggccuuuuggauuucaaa

SEQ ID NO: 43432 - RNA, 18 nt, Artificial Sequence
  Description of Artificial Sequence: Synthetic oligonucleotide
auucaggccuuuuggauu

SEQ ID NO: 43433 - RNA, 18 nt, Artificial Sequence
  Description of Artificial Sequence: Synthetic oligonucleotide
cuugaauucaggccuuuu

SEQ ID NO: 43434 - RNA, 18 nt, Artificial Sequence
  Description of Artificial Sequence: Synthetic oligonucleotide
uggaacuugaauucaggc

SEQ ID NO: 43435 - RNA, 18 nt, Artificial Sequence
  Description of Artificial Sequence: Synthetic oligonucleotide
ggagcuggaacuugaauu

SEQ ID NO: 43436 - RNA, 18 nt, Artificial Sequence
  Description of Artificial Sequence: Synthetic oligonucleotide
gcgguggagcuggaacuu

SEQ ID NO: 43437 - RNA, 18 nt, Artificial Sequence
  Description of Artificial Sequence: Synthetic oligonucleotide
aguaagcgguggagcugg

SEQ ID NO: 43438 - RNA, 18 nt, Artificial Sequence
  Description of Artificial Sequence: Synthetic oligonucleotide
cagcuaguaagcggugga

SEQ ID NO: 43439 - RNA, 18 nt, Artificial Sequence
  Description of Artificial Sequence: Synthetic oligonucleotide
guacacagcuaguaagcg

SEQ ID NO: 43440 - RNA, 18 nt, Artificial Sequence
  Description of Artificial Sequence: Synthetic oligonucleotide
ccuaaguacacagcuagu

SEQ ID NO: 43441 - RNA, 18 nt, Artificial Sequence
  Description of Artificial Sequence: Synthetic oligonucleotide
cuugcccuaaguacacag

SEQ ID NO: 43442 - RNA, 18 nt, Artificial Sequence
  Description of Artificial Sequence: Synthetic oligonucleotide
gcuaacuugcccuaagua

SEQ ID NO: 43443 - RNA, 18 nt, Artificial Sequence
  Description of Artificial Sequence: Synthetic oligonucleotide
cacuagcuaacuugcccu

SEQ ID NO: 43444 - RNA, 18 nt, Artificial Sequence
  Description of Artificial Sequence: Synthetic oligonucleotide
agagacacuagcuaacuu

SEQ ID NO: 43445 - RNA, 18 nt, Artificial Sequence
  Description of Artificial Sequence: Synthetic oligonucleotide
ggcucagagacacuagcu

SEQ ID NO: 43446 - RNA, 18 nt, Artificial Sequence
  Description of Artificial Sequence: Synthetic oligonucleotide
acugaggcucagagacac

SEQ ID NO: 43447 - RNA, 18 nt, Artificial Sequence
  Description of Artificial Sequence: Synthetic oligonucleotide
gggaaacugaggcucaga

SEQ ID NO: 43448 - RNA, 18 nt, Artificial Sequence
  Description of Artificial Sequence: Synthetic oligonucleotide
uagcugggaaacugaggc

SEQ ID NO: 43449 - RNA, 18 nt, Artificial Sequence
  Description of Artificial Sequence: Synthetic oligonucleotide
auuuauagcugggaaacu

SEQ ID NO: 43450 - RNA, 18 nt, Artificial Sequence
  Description of Artificial Sequence: Synthetic oligonucleotide
ucuccauuuauagcuggg

SEQ ID NO: 43451 - RNA, 18 nt, Artificial Sequence
  Description of Artificial Sequence: Synthetic oligonucleotide
ucucuucuccauuuauag

SEQ ID NO: 43452 - RNA, 18 nt, Artificial Sequence
  Description of Artificial Sequence: Synthetic oligonucleotide
gauacucucuucuccauu

SEQ ID NO: 43453 - RNA, 18 nt, Artificial Sequence
  Description of Artificial Sequence: Synthetic oligonucleotide
acuuggauacucucuucu

SEQ ID NO: 43454 - RNA, 18 nt, Artificial Sequence
  Description of Artificial Sequence: Synthetic oligonucleotide
ucuuuacuuggauacucu

SEQ ID NO: 43455 - RNA, 18 nt, Artificial Sequence
  Description of Artificial Sequence: Synthetic oligonucleotide
uucaaucuuuacuuggau

SEQ ID NO: 43456 - RNA, 18 nt, Artificial Sequence
  Description of Artificial Sequence: Synthetic oligonucleotide
ucucauucaaucuuuacu

SEQ ID NO: 43457 - RNA, 18 nt, Artificial Sequence
  Description of Artificial Sequence: Synthetic oligonucleotide
agucaucucauucaaucu

SEQ ID NO: 43458 - RNA, 18 nt, Artificial Sequence
  Description of Artificial Sequence: Synthetic oligonucleotide
auaugagucaucucauuc

SEQ ID NO: 43459 - RNA, 18 nt, Artificial Sequence
  Description of Artificial Sequence: Synthetic oligonucleotide
acuuuauaugagucaucu

SEQ ID NO: 43460 - RNA, 18 nt, Artificial Sequence
  Description of Artificial Sequence: Synthetic oligonucleotide
uaagcacuuuauaugagu

SEQ ID NO: 43461 - RNA, 18 nt, Artificial Sequence
  Description of Artificial Sequence: Synthetic oligonucleotide
caggauaagcacuuuaua

SEQ ID NO: 43462 - RNA, 18 nt, Artificial Sequence
  Description of Artificial Sequence: Synthetic oligonucleotide
ggcaccaggauaagcacu

SEQ ID NO: 43463 - RNA, 18 nt, Artificial Sequence
  Description of Artificial Sequence: Synthetic oligonucleotide
caccaggcaccaggauaa

SEQ ID NO: 43464 - RNA, 18 nt, Artificial Sequence
  Description of Artificial Sequence: Synthetic oligonucleotide
gcacacaccaggcaccag

SEQ ID NO: 43465 - RNA, 18 nt, Artificial Sequence
  Description of Artificial Sequence: Synthetic oligonucleotide
acuuagcacacaccaggc

SEQ ID NO: 43466 - RNA, 18 nt, Artificial Sequence
  Description of Artificial Sequence: Synthetic oligonucleotide
caggcacuuagcacacac

SEQ ID NO: 43467 - RNA, 18 nt, Artificial Sequence
  Description of Artificial Sequence: Synthetic oligonucleotide
gcugccaggcacuuagca

SEQ ID NO: 43468 - RNA, 18 nt, Artificial Sequence
  Description of Artificial Sequence: Synthetic oligonucleotide
ugacagcugccaggcacu

SEQ ID NO: 43469 - RNA, 18 nt, Artificial Sequence
  Description of Artificial Sequence: Synthetic oligonucleotide
aucacugacagcugccag

SEQ ID NO: 43470 - RNA, 18 nt, Artificial Sequence
  Description of Artificial Sequence: Synthetic oligonucleotide
ucauaaucacugacagcu

SEQ ID NO: 43471 - RNA, 18 nt, Artificial Sequence
  Description of Artificial Sequence: Synthetic oligonucleotide
aacagucauaaucacuga

SEQ ID NO: 43472 - RNA, 18 nt, Artificial Sequence
  Description of Artificial Sequence: Synthetic oligonucleotide
gcuauaacagucauaauc

SEQ ID NO: 43473 - RNA, 18 nt, Artificial Sequence
  Description of Artificial Sequence: Synthetic oligonucleotide
uucaugcuauaacaguca

SEQ ID NO: 43474 - RNA, 18 nt, Artificial Sequence
  Description of Artificial Sequence: Synthetic oligonucleotide
caugcuucaugcuauaac

SEQ ID NO: 43475 - RNA, 18 nt, Artificial Sequence
  Description of Artificial Sequence: Synthetic oligonucleotide
gguagcaugcuucaugcu

SEQ ID NO: 43476 - RNA, 18 nt, Artificial Sequence
  Description of Artificial Sequence: Synthetic oligonucleotide
uauaggguagcaugcuuc

SEQ ID NO: 43477 - RNA, 18 nt, Artificial Sequence
  Description of Artificial Sequence: Synthetic oligonucleotide
aucaauauaggguagcau

SEQ ID NO: 43478 - RNA, 18 nt, Artificial Sequence
  Description of Artificial Sequence: Synthetic oligonucleotide
agacaaucaauauagggu

SEQ ID NO: 43479 - RNA, 18 nt, Artificial Sequence
  Description of Artificial Sequence: Synthetic oligonucleotide
aaggaagacaaucaauau

SEQ ID NO: 43480 - RNA, 18 nt, Artificial Sequence
  Description of Artificial Sequence: Synthetic oligonucleotide
cagacaaggaagacaauc

SEQ ID NO: 43481 - RNA, 18 nt, Artificial Sequence
  Description of Artificial Sequence: Synthetic oligonucleotide
cuggacagacaaggaaga

SEQ ID NO: 43482 - RNA, 18 nt, Artificial Sequence
  Description of Artificial Sequence: Synthetic oligonucleotide
accuccuggacagacaag

SEQ ID NO: 43483 - RNA, 18 nt, Artificial Sequence
  Description of Artificial Sequence: Synthetic oligonucleotide
cagcaaccuccuggacag

SEQ ID NO: 43484 - RNA, 18 nt, Artificial Sequence
  Description of Artificial Sequence: Synthetic oligonucleotide
aacaucagcaaccuccug

SEQ ID NO: 43485 - RNA, 18 nt, Artificial Sequence
  Description of Artificial Sequence: Synthetic oligonucleotide
gauggaacaucagcaacc

SEQ ID NO: 43486 - RNA, 18 nt, Artificial Sequence
  Description of Artificial Sequence: Synthetic oligonucleotide
ggguggauggaacaucag

SEQ ID NO: 43487 - RNA, 18 nt, Artificial Sequence
  Description of Artificial Sequence: Synthetic oligonucleotide
cagaacaguguguguggg

SEQ ID NO: 43488 - RNA, 18 nt, Artificial Sequence
  Description of Artificial Sequence: Synthetic oligonucleotide
gggucagaacagugugug

SEQ ID NO: 43489 - RNA, 18 nt, Artificial Sequence
  Description of Artificial Sequence: Synthetic oligonucleotide
ugcugaggcccagcuggg

SEQ ID NO: 43490 - RNA, 18 nt, Artificial Sequence
  Description of Artificial Sequence: Synthetic oligonucleotide
gcugcugaggcccagcug

SEQ ID NO: 43491 - RNA, 18 nt, Artificial Sequence
  Description of Artificial Sequence: Synthetic oligonucleotide
aggcugagaccggagaga

SEQ ID NO: 43492 - RNA, 18 nt, Artificial Sequence
  Description of Artificial Sequence: Synthetic oligonucleotide
uauugaggcugagaccgg

SEQ ID NO: 43493 - RNA, 18 nt, Artificial Sequence
  Description of Artificial Sequence: Synthetic oligonucleotide
caggguauugaggcugag

SEQ ID NO: 43494 - RNA, 18 nt, Artificial Sequence
  Description of Artificial Sequence: Synthetic oligonucleotide
auggucaggguauugagg

SEQ ID NO: 43495 - RNA, 18 nt, Artificial Sequence
  Description of Artificial Sequence: Synthetic oligonucleotide
agaagauggucaggguau

SEQ ID NO: 43496 - RNA, 18 nt, Artificial Sequence
  Description of Artificial Sequence: Synthetic oligonucleotide
gaaagagaagauggucag

SEQ ID NO: 43497 - RNA, 18 nt, Artificial Sequence
  Description of Artificial Sequence: Synthetic oligonucleotide
uugcagaaagagaagaug

SEQ ID NO: 43498 - RNA, 18 nt, Artificial Sequence
  Description of Artificial Sequence: Synthetic oligonucleotide
gggucuugcagaaagaga

SEQ ID NO: 43499 - RNA, 18 nt, Artificial Sequence
  Description of Artificial Sequence: Synthetic oligonucleotide
gcagggaguccgcagcuc

SEQ ID NO: 43500 - RNA, 18 nt, Artificial Sequence
  Description of Artificial Sequence: Synthetic oligonucleotide
agguggcagggaguccgc

SEQ ID NO: 43501 - RNA, 18 nt, Artificial Sequence
  Description of Artificial Sequence: Synthetic oligonucleotide
ccaguagguggcagggag

SEQ ID NO: 43502 - RNA, 18 nt, Artificial Sequence
  Description of Artificial Sequence: Synthetic oligonucleotide
cagcaccaguagguggca

SEQ ID NO: 43503 - RNA, 18 nt, Artificial Sequence
  Description of Artificial Sequence: Synthetic oligonucleotide
aagcucagcaccaguagg

SEQ ID NO: 43504 - RNA, 18 nt, Artificial Sequence
  Description of Artificial Sequence: Synthetic oligonucleotide
gagccaagcucagcacca

SEQ ID NO: 43505 - RNA, 18 nt, Artificial Sequence
  Description of Artificial Sequence: Synthetic oligonucleotide
cgcaagagccaagcucag

SEQ ID NO: 43506 - RNA, 18 nt, Artificial Sequence
  Description of Artificial Sequence: Synthetic oligonucleotide
cuguccgcaagagccaag

SEQ ID NO: 43507 - RNA, 18 nt, Artificial Sequence
  Description of Artificial Sequence: Synthetic oligonucleotide
ucccacuguccgcaagag

SEQ ID NO: 43508 - RNA, 18 nt, Artificial Sequence
  Description of Artificial Sequence: Synthetic oligonucleotide
gcugaucccacuguccgc

SEQ ID NO: 43509 - RNA, 18 nt, Artificial Sequence
  Description of Artificial Sequence: Synthetic oligonucleotide
uucaggcugaucccacug

SEQ ID NO: 43510 - RNA, 18 nt, Artificial Sequence
  Description of Artificial Sequence: Synthetic oligonucleotide
gggcauucaggcugaucc

SEQ ID NO: 43511 - RNA, 18 nt, Artificial Sequence
  Description of Artificial Sequence: Synthetic oligonucleotide
aacgagggcauucaggcu

SEQ ID NO: 43512 - RNA, 18 nt, Artificial Sequence
  Description of Artificial Sequence: Synthetic oligonucleotide
gcugcaacgagggcauuc

SEQ ID NO: 43513 - RNA, 18 nt, Artificial Sequence
  Description of Artificial Sequence: Synthetic oligonucleotide
auguggcugcaacgaggg

SEQ ID NO: 43514 - RNA, 18 nt, Artificial Sequence
  Description of Artificial Sequence: Synthetic oligonucleotide
gcuggauguggcugcaac

SEQ ID NO: 43515 - RNA, 18 nt, Artificial Sequence
  Description of Artificial Sequence: Synthetic oligonucleotide
agaaggcuggauguggcu

SEQ ID NO: 43516 - RNA, 18 nt, Artificial Sequence
  Description of Artificial Sequence: Synthetic oligonucleotide
aggcugagaccggagaga

SEQ ID NO: 43517 - RNA, 18 nt, Artificial Sequence
  Description of Artificial Sequence: Synthetic oligonucleotide
uauugaggcugagaccgg

SEQ ID NO: 43518 - RNA, 18 nt, Artificial Sequence
  Description of Artificial Sequence: Synthetic oligonucleotide
caggguauugaggcugag

SEQ ID NO: 43519 - RNA, 18 nt, Artificial Sequence
  Description of Artificial Sequence: Synthetic oligonucleotide
auggucaggguauugagg

SEQ ID NO: 43520 - RNA, 18 nt, Artificial Sequence
  Description of Artificial Sequence: Synthetic oligonucleotide
agaagauggucaggguau

SEQ ID NO: 43521 - RNA, 18 nt, Artificial Sequence
  Description of Artificial Sequence: Synthetic oligonucleotide
gaaagagaagauggucag

SEQ ID NO: 43522 - RNA, 18 nt, Artificial Sequence
  Description of Artificial Sequence: Synthetic oligonucleotide
uugcagaaagagaagaug

SEQ ID NO: 43523 - RNA, 18 nt, Artificial Sequence
  Description of Artificial Sequence: Synthetic oligonucleotide
gggucuugcagaaagaga

SEQ ID NO: 43524 - RNA, 18 nt, Artificial Sequence
  Description of Artificial Sequence: Synthetic oligonucleotide
ggaguccgcagcuccggg

SEQ ID NO: 43525 - RNA, 18 nt, Artificial Sequence
  Description of Artificial Sequence: Synthetic oligonucleotide
gcagggaguccgcagcuc

SEQ ID NO: 43526 - RNA, 18 nt, Artificial Sequence
  Description of Artificial Sequence: Synthetic oligonucleotide
agguggcagggaguccgc

SEQ ID NO: 43527 - RNA, 18 nt, Artificial Sequence
  Description of Artificial Sequence: Synthetic oligonucleotide
ccaguagguggcagggag

SEQ ID NO: 43528 - RNA, 18 nt, Artificial Sequence
  Description of Artificial Sequence: Synthetic oligonucleotide
cagcaccaguagguggca

SEQ ID NO: 43529 - RNA, 18 nt, Artificial Sequence
  Description of Artificial Sequence: Synthetic oligonucleotide
aagcucagcaccaguagg

SEQ ID NO: 43530 - RNA, 18 nt, Artificial Sequence
  Description of Artificial Sequence: Synthetic oligonucleotide
gagccaagcucagcacca

SEQ ID NO: 43531 - RNA, 18 nt, Artificial Sequence
  Description of Artificial Sequence: Synthetic oligonucleotide
cgcaagagccaagcucag

SEQ ID NO: 43532 - RNA, 18 nt, Artificial Sequence
  Description of Artificial Sequence: Synthetic oligonucleotide
cuguccgcaagagccaag

SEQ ID NO: 43533 - RNA, 18 nt, Artificial Sequence
  Description of Artificial Sequence: Synthetic oligonucleotide
ucccacuguccgcaagag

SEQ ID NO: 43534 - RNA, 18 nt, Artificial Sequence
  Description of Artificial Sequence: Synthetic oligonucleotide
gcugaucccacuguccgc

SEQ ID NO: 43535 - RNA, 18 nt, Artificial Sequence
  Description of Artificial Sequence: Synthetic oligonucleotide
uucaggcugaucccacug

SEQ ID NO: 43536 - RNA, 18 nt, Artificial Sequence
  Description of Artificial Sequence: Synthetic oligonucleotide
gggcauucaggcugaucc

SEQ ID NO: 43537 - RNA, 18 nt, Artificial Sequence
  Description of Artificial Sequence: Synthetic oligonucleotide
aacgagggcauucaggcu

SEQ ID NO: 43538 - RNA, 18 nt, Artificial Sequence
  Description of Artificial Sequence: Synthetic oligonucleotide
gcugcaacgagggcauuc

SEQ ID NO: 43539 - RNA, 18 nt, Artificial Sequence
  Description of Artificial Sequence: Synthetic oligonucleotide
auguggcugcaacgaggg

SEQ ID NO: 43540 - RNA, 18 nt, Artificial Sequence
  Description of Artificial Sequence: Synthetic oligonucleotide
gcuggauguggcugcaac

SEQ ID NO: 43541 - RNA, 18 nt, Artificial Sequence
  Description of Artificial Sequence: Synthetic oligonucleotide
agaaggcuggauguggcu

SEQ ID NO: 43542 - RNA, 18 nt, Artificial Sequence
  Description of Artificial Sequence: Synthetic oligonucleotide
ccagagccuguggacugg

SEQ ID NO: 43543 - RNA, 18 nt, Artificial Sequence
  Description of Artificial Sequence: Synthetic oligonucleotide
ggaccccagagccugugg

SEQ ID NO: 43544 - RNA, 18 nt, Artificial Sequence
  Description of Artificial Sequence: Synthetic oligonucleotide
aggcaggaccccagagcc

SEQ ID NO: 43545 - RNA, 18 nt, Artificial Sequence
  Description of Artificial Sequence: Synthetic oligonucleotide
gccccaggcaggacccca

SEQ ID NO: 43546 - RNA, 18 nt, Artificial Sequence
  Description of Artificial Sequence: Synthetic oligonucleotide
gucaggccccaggcagga

SEQ ID NO: 43547 - RNA, 18 nt, Artificial Sequence
  Description of Artificial Sequence: Synthetic oligonucleotide
gggucaggccccaggcag

SEQ ID NO: 43548 - RNA, 18 nt, Artificial Sequence
  Description of Artificial Sequence: Synthetic oligonucleotide
gcugcccagggcccaggg

SEQ ID NO: 43549 - RNA, 18 nt, Artificial Sequence
  Description of Artificial Sequence: Synthetic oligonucleotide
gccuggcugcccagggcc

SEQ ID NO: 43550 - RNA, 18 nt, Artificial Sequence
  Description of Artificial Sequence: Synthetic oligonucleotide
ccuuggccuggcugccca

SEQ ID NO: 43551 - RNA, 18 nt, Artificial Sequence
  Description of Artificial Sequence: Synthetic oligonucleotide
aaugcccuuggccuggcu

SEQ ID NO: 43552 - RNA, 18 nt, Artificial Sequence
  Description of Artificial Sequence: Synthetic oligonucleotide
guaaaaaugcccuuggcc

SEQ ID NO: 43553 - RNA, 18 nt, Artificial Sequence
  Description of Artificial Sequence: Synthetic oligonucleotide
aaguaguaaaaaugcccu

SEQ ID NO: 43554 - RNA, 18 nt, Artificial Sequence
  Description of Artificial Sequence: Synthetic oligonucleotide
ucuguaaguaguaaaaau

SEQ ID NO: 43555 - RNA, 18 nt, Artificial Sequence
  Description of Artificial Sequence: Synthetic oligonucleotide
aauuuucuguaaguagua

SEQ ID NO: 43556 - RNA, 18 nt, Artificial Sequence
  Description of Artificial Sequence: Synthetic oligonucleotide
uggccaauuuucuguaag

SEQ ID NO: 43557 - RNA, 18 nt, Artificial Sequence
  Description of Artificial Sequence: Synthetic oligonucleotide
gcccuuggccaauuuucu

SEQ ID NO: 43558 - RNA, 18 nt, Artificial Sequence
  Description of Artificial Sequence: Synthetic oligonucleotide
ccucugcccuuggccaau

SEQ ID NO: 43559 - RNA, 18 nt, Artificial Sequence
  Description of Artificial Sequence: Synthetic oligonucleotide
cccacccucugcccuugg

SEQ ID NO: 43560 - RNA, 18 nt, Artificial Sequence
  Description of Artificial Sequence: Synthetic oligonucleotide
gccugcccacccucugcc

SEQ ID NO: 43561 - RNA, 18 nt, Artificial Sequence
  Description of Artificial Sequence: Synthetic oligonucleotide
uuuuagccugcccacccu

SEQ ID NO: 43562 - RNA, 18 nt, Artificial Sequence
  Description of Artificial Sequence: Synthetic oligonucleotide
gcccauuuuagccugccc

SEQ ID NO: 43563 - RNA, 18 nt, Artificial Sequence
  Description of Artificial Sequence: Synthetic oligonucleotide
auucagcccauuuuagcc

SEQ ID NO: 43564 - RNA, 18 nt, Artificial Sequence
  Description of Artificial Sequence: Synthetic oligonucleotide
cuggaauucagcccauuu

SEQ ID NO: 43565 - RNA, 18 nt, Artificial Sequence
  Description of Artificial Sequence: Synthetic oligonucleotide
ucaaucuggaauucagcc

SEQ ID NO: 43566 - RNA, 18 nt, Artificial Sequence
  Description of Artificial Sequence: Synthetic oligonucleotide
cagaaucaaucuggaauu

SEQ ID NO: 43567 - RNA, 18 nt, Artificial Sequence
  Description of Artificial Sequence: Synthetic oligonucleotide
uucuucagaaucaaucug

SEQ ID NO: 43568 - RNA, 18 nt, Artificial Sequence
  Description of Artificial Sequence: Synthetic oligonucleotide
ugucguucuucagaauca

SEQ ID NO: 43569 - RNA, 18 nt, Artificial Sequence
  Description of Artificial Sequence: Synthetic oligonucleotide
ucagcugucguucuucag

SEQ ID NO: 43570 - RNA, 18 nt, Artificial Sequence
  Description of Artificial Sequence: Synthetic oligonucleotide
agaaaucagcugucguuc

SEQ ID NO: 43571 - RNA, 18 nt, Artificial Sequence
  Description of Artificial Sequence: Synthetic oligonucleotide
cuuccagaaaucagcugu

SEQ ID NO: 43572 - RNA, 18 nt, Artificial Sequence
  Description of Artificial Sequence: Synthetic oligonucleotide
ccugucuuccagaaauca

SEQ ID NO: 43573 - RNA, 18 nt, Artificial Sequence
  Description of Artificial Sequence: Synthetic oligonucleotide
caaccccugucuuccaga

SEQ ID NO: 43574 - RNA, 18 nt, Artificial Sequence
  Description of Artificial Sequence: Synthetic oligonucleotide
uucagcaaccccugucuu

SEQ ID NO: 43575 - RNA, 18 nt, Artificial Sequence
  Description of Artificial Sequence: Synthetic oligonucleotide
cagguuucagcaaccccu

SEQ ID NO: 43576 - RNA, 18 nt, Artificial Sequence
  Description of Artificial Sequence: Synthetic oligonucleotide
uucaucagguuucagcaa

SEQ ID NO: 43577 - RNA, 18 nt, Artificial Sequence
  Description of Artificial Sequence: Synthetic oligonucleotide
ucucuuucaucagguuuc

SEQ ID NO: 43578 - RNA, 18 nt, Artificial Sequence
  Description of Artificial Sequence: Synthetic oligonucleotide
uaccaucucuuucaucag

SEQ ID NO: 43579 - RNA, 18 nt, Artificial Sequence
  Description of Artificial Sequence: Synthetic oligonucleotide
cagccuaccaucucuuuc

SEQ ID NO: 43580 - RNA, 18 nt, Artificial Sequence
  Description of Artificial Sequence: Synthetic oligonucleotide
cucuacagccuaccaucu

SEQ ID NO: 43581 - RNA, 18 nt, Artificial Sequence
  Description of Artificial Sequence: Synthetic oligonucleotide
uugaucucuacagccuac

SEQ ID NO: 43582 - RNA, 18 nt, Artificial Sequence
  Description of Artificial Sequence: Synthetic oligonucleotide
caccauugaucucuacag

SEQ ID NO: 43583 - RNA, 18 nt, Artificial Sequence
  Description of Artificial Sequence: Synthetic oligonucleotide
acccacaccauugaucuc

SEQ ID NO: 43584 - RNA, 18 nt, Artificial Sequence
  Description of Artificial Sequence: Synthetic oligonucleotide
acagaacccacaccauug

SEQ ID NO: 43585 - RNA, 18 nt, Artificial Sequence
  Description of Artificial Sequence: Synthetic oligonucleotide
ugguuacagaacccacac

SEQ ID NO: 43586 - RNA, 18 nt, Artificial Sequence
  Description of Artificial Sequence: Synthetic oligonucleotide
uugcuugguuacagaacc

SEQ ID NO: 43587 - RNA, 18 nt, Artificial Sequence
  Description of Artificial Sequence: Synthetic oligonucleotide
cuagguugcuugguuaca

SEQ ID NO: 43588 - RNA, 18 nt, Artificial Sequence
  Description of Artificial Sequence: Synthetic oligonucleotide
caaaccuagguugcuugg

SEQ ID NO: 43589 - RNA, 18 nt, Artificial Sequence
  Description of Artificial Sequence: Synthetic oligonucleotide
gaaugcaaaccuagguug

SEQ ID NO: 43590 - RNA, 18 nt, Artificial Sequence
  Description of Artificial Sequence: Synthetic oligonucleotide
agccagaaugcaaaccua

SEQ ID NO: 43591 - RNA, 18 nt, Artificial Sequence
  Description of Artificial Sequence: Synthetic oligonucleotide
gcugaagccagaaugcaa

SEQ ID NO: 43592 - RNA, 18 nt, Artificial Sequence
  Description of Artificial Sequence: Synthetic oligonucleotide
gaaaugcugaagccagaa

SEQ ID NO: 43593 - RNA, 18 nt, Artificial Sequence
  Description of Artificial Sequence: Synthetic oligonucleotide
aacuagaaaugcugaagc

SEQ ID NO: 43594 - RNA, 18 nt, Artificial Sequence
  Description of Artificial Sequence: Synthetic oligonucleotide
cccagaacuagaaaugcu

SEQ ID NO: 43595 - RNA, 18 nt, Artificial Sequence
  Description of Artificial Sequence: Synthetic oligonucleotide
agaagcccagaacuagaa

SEQ ID NO: 43596 - RNA, 18 nt, Artificial Sequence
  Description of Artificial Sequence: Synthetic oligonucleotide
auggaagaagcccagaac

SEQ ID NO: 43597 - RNA, 18 nt, Artificial Sequence
  Description of Artificial Sequence: Synthetic oligonucleotide
gauuuauggaagaagccc

SEQ ID NO: 43598 - RNA, 18 nt, Artificial Sequence
  Description of Artificial Sequence: Synthetic oligonucleotide
uauccgauuuauggaaga

SEQ ID NO: 43599 - RNA, 18 nt, Artificial Sequence
  Description of Artificial Sequence: Synthetic oligonucleotide
aauaauauccgauuuaug

SEQ ID NO: 43600 - RNA, 18 nt, Artificial Sequence
  Description of Artificial Sequence: Synthetic oligonucleotide
uaggaaauaauauccgau

SEQ ID NO: 43601 - RNA, 18 nt, Artificial Sequence
  Description of Artificial Sequence: Synthetic oligonucleotide
ugaguuaggaaauaauau

SEQ ID NO: 43602 - RNA, 18 nt, Artificial Sequence
  Description of Artificial Sequence: Synthetic oligonucleotide
cuauaugaguuaggaaau

SEQ ID NO: 43603 - RNA, 18 nt, Artificial Sequence
  Description of Artificial Sequence: Synthetic oligonucleotide
accaccuauaugaguuag

SEQ ID NO: 43604 - RNA, 18 nt, Artificial Sequence
  Description of Artificial Sequence: Synthetic oligonucleotide
uuccaaccaccuauauga

SEQ ID NO: 43605 - RNA, 18 nt, Artificial Sequence
  Description of Artificial Sequence: Synthetic oligonucleotide
aauacuuccaaccaccua

SEQ ID NO: 43606 - RNA, 18 nt, Artificial Sequence
  Description of Artificial Sequence: Synthetic oligonucleotide
aaguaaauacuuccaacc

SEQ ID NO: 43607 - RNA, 18 nt, Artificial Sequence
  Description of Artificial Sequence: Synthetic oligonucleotide
aauagaaguaaauacuuc

SEQ ID NO: 43608 - RNA, 18 nt, Artificial Sequence
  Description of Artificial Sequence: Synthetic oligonucleotide
cacauaauagaaguaaau

SEQ ID NO: 43609 - RNA, 18 nt, Artificial Sequence
  Description of Artificial Sequence: Synthetic oligonucleotide
auuuacacauaauagaag

SEQ ID NO: 43610 - RNA, 18 nt, Artificial Sequence
  Description of Artificial Sequence: Synthetic oligonucleotide
aaguuauuuacacauaau

SEQ ID NO: 43611 - RNA, 18 nt, Artificial Sequence
  Description of Artificial Sequence: Synthetic oligonucleotide
auuuuaaguuauuuacac

SEQ ID NO: 43612 - RNA, 18 nt, Artificial Sequence
  Description of Artificial Sequence: Synthetic oligonucleotide
gcauuauuuuaaguuauu

SEQ ID NO: 43613 - RNA, 18 nt, Artificial Sequence
  Description of Artificial Sequence: Synthetic oligonucleotide
aucaagcauuauuuuaag

SEQ ID NO: 43614 - RNA, 18 nt, Artificial Sequence
  Description of Artificial Sequence: Synthetic oligonucleotide
uagguaucaagcauuauu

SEQ ID NO: 43615 - RNA, 18 nt, Artificial Sequence
  Description of Artificial Sequence: Synthetic oligonucleotide
aguccuagguaucaagca

SEQ ID NO: 43616 - RNA, 18 nt, Artificial Sequence
  Description of Artificial Sequence: Synthetic oligonucleotide
cguagaguccuagguauc

SEQ ID NO: 43617 - RNA, 18 nt, Artificial Sequence
  Description of Artificial Sequence: Synthetic oligonucleotide
acuuacguagaguccuag

SEQ ID NO: 43618 - RNA, 18 nt, Artificial Sequence
  Description of Artificial Sequence: Synthetic oligonucleotide
caaacacuuacguagagu

SEQ ID NO: 43619 - RNA, 18 nt, Artificial Sequence
  Description of Artificial Sequence: Synthetic oligonucleotide
guucacaaacacuuacgu

SEQ ID NO: 43620 - RNA, 18 nt, Artificial Sequence
  Description of Artificial Sequence: Synthetic oligonucleotide
uuuguguucacaaacacu

SEQ ID NO: 43621 - RNA, 18 nt, Artificial Sequence
  Description of Artificial Sequence: Synthetic oligonucleotide
ccccauuuguguucacaa

SEQ ID NO: 43622 - RNA, 18 nt, Artificial Sequence
  Description of Artificial Sequence: Synthetic oligonucleotide
aacgcccccauuuguguu

SEQ ID NO: 43623 - RNA, 18 nt, Artificial Sequence
  Description of Artificial Sequence: Synthetic oligonucleotide
gugauaacgcccccauuu

SEQ ID NO: 43624 - RNA, 18 nt, Artificial Sequence
  Description of Artificial Sequence: Synthetic oligonucleotide
uaguggugauaacgcccc

SEQ ID NO: 43625 - RNA, 18 nt, Artificial Sequence
  Description of Artificial Sequence: Synthetic oligonucleotide
ugcaguaguggugauaac

SEQ ID NO: 43626 - RNA, 18 nt, Artificial Sequence
  Description of Artificial Sequence: Synthetic oligonucleotide
acgggugcaguaguggug

SEQ ID NO: 43627 - RNA, 18 nt, Artificial Sequence
  Description of Artificial Sequence: Synthetic oligonucleotide
uacauacgggugcaguag

SEQ ID NO: 43628 - RNA, 18 nt, Artificial Sequence
  Description of Artificial Sequence: Synthetic oligonucleotide
ccagauacauacgggugc

SEQ ID NO: 43629 - RNA, 18 nt, Artificial Sequence
  Description of Artificial Sequence: Synthetic oligonucleotide
ggagcccagauacauacg

SEQ ID NO: 43630 - RNA, 18 nt, Artificial Sequence
  Description of Artificial Sequence: Synthetic oligonucleotide
cuccaggagcccagauac

SEQ ID NO: 43631 - RNA, 18 nt, Artificial Sequence
  Description of Artificial Sequence: Synthetic oligonucleotide
cuccacuccaggagccca

SEQ ID NO: 43632 - RNA, 18 nt, Artificial Sequence
  Description of Artificial Sequence: Synthetic oligonucleotide
ugucccuccacuccagga

SEQ ID NO: 43633 - RNA, 18 nt, Artificial Sequence
  Description of Artificial Sequence: Synthetic oligonucleotide
aucggugucccuccacuc

SEQ ID NO: 43634 - RNA, 18 nt, Artificial Sequence
  Description of Artificial Sequence: Synthetic oligonucleotide
acugcaucggugucccuc

SEQ ID NO: 43635 - RNA, 18 nt, Artificial Sequence
  Description of Artificial Sequence: Synthetic oligonucleotide
uccacacugcaucggugu

SEQ ID NO: 43636 - RNA, 18 nt, Artificial Sequence
  Description of Artificial Sequence: Synthetic oligonucleotide
uccucuccacacugcauc

SEQ ID NO: 43637 - RNA, 18 nt, Artificial Sequence
  Description of Artificial Sequence: Synthetic oligonucleotide
ucuuauccucuccacacu

SEQ ID NO: 43638 - RNA, 18 nt, Artificial Sequence
  Description of Artificial Sequence: Synthetic oligonucleotide
gggcuccagccuccgucu

SEQ ID NO: 43639 - RNA, 18 nt, Artificial Sequence
  Description of Artificial Sequence: Synthetic oligonucleotide
ugagcaugcacauccggg

SEQ ID NO: 43640 - RNA, 18 nt, Artificial Sequence
  Description of Artificial Sequence: Synthetic oligonucleotide
gcacugagcaugcacauc

SEQ ID NO: 43641 - RNA, 18 nt, Artificial Sequence
  Description of Artificial Sequence: Synthetic oligonucleotide
ggucagcacugagcaugc

SEQ ID NO: 43642 - RNA, 18 nt, Artificial Sequence
  Description of Artificial Sequence: Synthetic oligonucleotide
aggcuggucagcacugag

SEQ ID NO: 43643 - RNA, 18 nt, Artificial Sequence
  Description of Artificial Sequence: Synthetic oligonucleotide
cccccaggcuggucagca

SEQ ID NO: 43644 - RNA, 18 nt, Artificial Sequence
  Description of Artificial Sequence: Synthetic oligonucleotide
cagaccccccaggcuggu

SEQ ID NO: 43645 - RNA, 18 nt, Artificial Sequence
  Description of Artificial Sequence: Synthetic oligonucleotide
ugaugcagaccccccagg

SEQ ID NO: 43646 - RNA, 18 nt, Artificial Sequence
  Description of Artificial Sequence: Synthetic oligonucleotide
cucacugaugcagacccc

SEQ ID NO: 43647 - RNA, 18 nt, Artificial Sequence
  Description of Artificial Sequence: Synthetic oligonucleotide
gaguucucacugaugcag

SEQ ID NO: 43648 - RNA, 18 nt, Artificial Sequence
  Description of Artificial Sequence: Synthetic oligonucleotide
aggaagaguucucacuga

SEQ ID NO: 43649 - RNA, 18 nt, Artificial Sequence
  Description of Artificial Sequence: Synthetic oligonucleotide
gugggaggaagaguucuc

SEQ ID NO: 43650 - RNA, 18 nt, Artificial Sequence
  Description of Artificial Sequence: Synthetic oligonucleotide
ucucugugggaggaagag

SEQ ID NO: 43651 - RNA, 18 nt, Artificial Sequence
  Description of Artificial Sequence: Synthetic oligonucleotide
ucaauucucugugggagg

SEQ ID NO: 43652 - RNA, 18 nt, Artificial Sequence
  Description of Artificial Sequence: Synthetic oligonucleotide
aaacuucaauucucugug

SEQ ID NO: 43653 - RNA, 18 nt, Artificial Sequence
  Description of Artificial Sequence: Synthetic oligonucleotide
gguggaaacuucaauucu

SEQ ID NO: 43654 - RNA, 18 nt, Artificial Sequence
  Description of Artificial Sequence: Synthetic oligonucleotide
gcaaagguggaaacuuca

SEQ ID NO: 43655 - RNA, 18 nt, Artificial Sequence
  Description of Artificial Sequence: Synthetic oligonucleotide
ggcaagcaaagguggaaa

SEQ ID NO: 43656 - RNA, 18 nt, Artificial Sequence
  Description of Artificial Sequence: Synthetic oligonucleotide
aaaagggcaagcaaaggu

SEQ ID NO: 43657 - RNA, 18 nt, Artificial Sequence
  Description of Artificial Sequence: Synthetic oligonucleotide
agccuaaaagggcaagca

SEQ ID NO: 43658 - RNA, 18 nt, Artificial Sequence
  Description of Artificial Sequence: Synthetic oligonucleotide
uccccagccuaaaagggc

SEQ ID NO: 43659 - RNA, 18 nt, Artificial Sequence
  Description of Artificial Sequence: Synthetic oligonucleotide
aggccuccccagccuaaa

SEQ ID NO: 43660 - RNA, 18 nt, Artificial Sequence
  Description of Artificial Sequence: Synthetic oligonucleotide
aucccaggccuccccagc

SEQ ID NO: 43661 - RNA, 18 nt, Artificial Sequence
  Description of Artificial Sequence: Synthetic oligonucleotide
gggagaucccaggccucc

SEQ ID NO: 43662 - RNA, 18 nt, Artificial Sequence
  Description of Artificial Sequence: Synthetic oligonucleotide
gaaggcaaagucagaggg

SEQ ID NO: 43663 - RNA, 18 nt, Artificial Sequence
  Description of Artificial Sequence: Synthetic oligonucleotide
ugaaggcaaagucagagg

SEQ ID NO: 43664 - RNA, 18 nt, Artificial Sequence
  Description of Artificial Sequence: Synthetic oligonucleotide
gaagaugaaggcaaaguc

SEQ ID NO: 43665 - RNA, 18 nt, Artificial Sequence
  Description of Artificial Sequence: Synthetic oligonucleotide
acacagaagaugaaggca

SEQ ID NO: 43666 - RNA, 18 nt, Artificial Sequence
  Description of Artificial Sequence: Synthetic oligonucleotide
aggucacacagaagauga

SEQ ID NO: 43667 - RNA, 18 nt, Artificial Sequence
  Description of Artificial Sequence: Synthetic oligonucleotide
agccaaggucacacagaa

SEQ ID NO: 43668 - RNA, 18 nt, Artificial Sequence
  Description of Artificial Sequence: Synthetic oligonucleotide
acugaagccaaggucaca

SEQ ID NO: 43669 - RNA, 18 nt, Artificial Sequence
  Description of Artificial Sequence: Synthetic oligonucleotide
aagauacugaagccaagg

SEQ ID NO: 43670 - RNA, 18 nt, Artificial Sequence
  Description of Artificial Sequence: Synthetic oligonucleotide
aggcaaagauacugaagc

SEQ ID NO: 43671 - RNA, 18 nt, Artificial Sequence
  Description of Artificial Sequence: Synthetic oligonucleotide
caaagaggcaaagauacu

SEQ ID NO: 43672 - RNA, 18 nt, Artificial Sequence
  Description of Artificial Sequence: Synthetic oligonucleotide
acauucaaagaggcaaag

SEQ ID NO: 43673 - RNA, 18 nt, Artificial Sequence
  Description of Artificial Sequence: Synthetic oligonucleotide
aacugacauucaaagagg

SEQ ID NO: 43674 - RNA, 18 nt, Artificial Sequence
  Description of Artificial Sequence: Synthetic oligonucleotide
cuguauuugauagguggg

SEQ ID NO: 43675 - RNA, 18 nt, Artificial Sequence
  Description of Artificial Sequence: Synthetic oligonucleotide
caugccuguauuugauag

SEQ ID NO: 43676 - RNA, 18 nt, Artificial Sequence
  Description of Artificial Sequence: Synthetic oligonucleotide
gagcucaugccuguauuu

SEQ ID NO: 43677 - RNA, 18 nt, Artificial Sequence
  Description of Artificial Sequence: Synthetic oligonucleotide
caggagagcucaugccug

SEQ ID NO: 43678 - RNA, 18 nt, Artificial Sequence
  Description of Artificial Sequence: Synthetic oligonucleotide
ugucacaggagagcucau

SEQ ID NO: 43679 - RNA, 18 nt, Artificial Sequence
  Description of Artificial Sequence: Synthetic oligonucleotide
cccucugucacaggagag

SEQ ID NO: 43680 - RNA, 18 nt, Artificial Sequence
  Description of Artificial Sequence: Synthetic oligonucleotide
cagaucccucugucacag

SEQ ID NO: 43681 - RNA, 18 nt, Artificial Sequence
  Description of Artificial Sequence: Synthetic oligonucleotide
gugaucagaucccucugu

SEQ ID NO: 43682 - RNA, 18 nt, Artificial Sequence
  Description of Artificial Sequence: Synthetic oligonucleotide
ucugcgugaucagauccc

SEQ ID NO: 43683 - RNA, 18 nt, Artificial Sequence
  Description of Artificial Sequence: Synthetic oligonucleotide
cucucucugcgugaucag

SEQ ID NO: 43684 - RNA, 18 nt, Artificial Sequence
  Description of Artificial Sequence: Synthetic oligonucleotide
auaggcucucucugcgug

SEQ ID NO: 43685 - RNA, 18 nt, Artificial Sequence
  Description of Artificial Sequence: Synthetic oligonucleotide
gggccauaggcucucucu

SEQ ID NO: 43686 - RNA, 18 nt, Artificial Sequence
  Description of Artificial Sequence: Synthetic oligonucleotide
ugguugggccauaggcuc

SEQ ID NO: 43687 - RNA, 18 nt, Artificial Sequence
  Description of Artificial Sequence: Synthetic oligonucleotide
caccaugguugggccaua

SEQ ID NO: 43688 - RNA, 18 nt, Artificial Sequence
  Description of Artificial Sequence: Synthetic oligonucleotide
gacugcaccaugguuggg

SEQ ID NO: 43689 - RNA, 18 nt, Artificial Sequence
  Description of Artificial Sequence: Synthetic oligonucleotide
acuuugacugcaccaugg

SEQ ID NO: 43690 - RNA, 18 nt, Artificial Sequence
  Description of Artificial Sequence: Synthetic oligonucleotide
gggugacuuugacugcac

SEQ ID NO: 43691 - RNA, 18 nt, Artificial Sequence
  Description of Artificial Sequence: Synthetic oligonucleotide
aggcugggugacuuugac

SEQ ID NO: 43692 - RNA, 18 nt, Artificial Sequence
  Description of Artificial Sequence: Synthetic oligonucleotide
ucuccaggcugggugacu

SEQ ID NO: 43693 - RNA, 18 nt, Artificial Sequence
  Description of Artificial Sequence: Synthetic oligonucleotide
cacacucuccaggcuggg

SEQ ID NO: 43694 - RNA, 18 nt, Artificial Sequence
  Description of Artificial Sequence: Synthetic oligonucleotide
caaugcacacucuccagg

SEQ ID NO: 43695 - RNA, 18 nt, Artificial Sequence
  Description of Artificial Sequence: Synthetic oligonucleotide
gagcccaaugcacacucu

SEQ ID NO: 43696 - RNA, 18 nt, Artificial Sequence
  Description of Artificial Sequence: Synthetic oligonucleotide
ggguggagcccaaugcac

SEQ ID NO: 43697 - RNA, 18 nt, Artificial Sequence
  Description of Artificial Sequence: Synthetic oligonucleotide
aguaacugggcugaaggg

SEQ ID NO: 43698 - RNA, 18 nt, Artificial Sequence
  Description of Artificial Sequence: Synthetic oligonucleotide
aaguaacugggcugaagg

SEQ ID NO: 43699 - RNA, 18 nt, Artificial Sequence
  Description of Artificial Sequence: Synthetic oligonucleotide
agcucaaguaacugggcu

SEQ ID NO: 43700 - RNA, 18 nt, Artificial Sequence
  Description of Artificial Sequence: Synthetic oligonucleotide
guuggagcucaaguaacu

SEQ ID NO: 43701 - RNA, 18 nt, Artificial Sequence
  Description of Artificial Sequence: Synthetic oligonucleotide
gaggcguuggagcucaag

SEQ ID NO: 43702 - RNA, 18 nt, Artificial Sequence
  Description of Artificial Sequence: Synthetic oligonucleotide
ccuaugaggcguuggagc

SEQ ID NO: 43703 - RNA, 18 nt, Artificial Sequence
  Description of Artificial Sequence: Synthetic oligonucleotide
ucuuuccuaugaggcguu

SEQ ID NO: 43704 - RNA, 18 nt, Artificial Sequence
  Description of Artificial Sequence: Synthetic oligonucleotide
uggugucuuuccuaugag

SEQ ID NO: 43705 - RNA, 18 nt, Artificial Sequence
  Description of Artificial Sequence: Synthetic oligonucleotide
aauauuggugucuuuccu

SEQ ID NO: 43706 - RNA, 18 nt, Artificial Sequence
  Description of Artificial Sequence: Synthetic oligonucleotide
gccuuaauauuggugucu

SEQ ID NO: 43707 - RNA, 18 nt, Artificial Sequence
  Description of Artificial Sequence: Synthetic oligonucleotide
agagggccuuaauauugg

SEQ ID NO: 43708 - RNA, 18 nt, Artificial Sequence
  Description of Artificial Sequence: Synthetic oligonucleotide
ucugaagagggccuuaau

SEQ ID NO: 43709 - RNA, 18 nt, Artificial Sequence
  Description of Artificial Sequence: Synthetic oligonucleotide
ucuucucugaagagggcc

SEQ ID NO: 43710 - RNA, 18 nt, Artificial Sequence
  Description of Artificial Sequence: Synthetic oligonucleotide
gcccuucuucucugaaga

SEQ ID NO: 43711 - RNA, 18 nt, Artificial Sequence
  Description of Artificial Sequence: Synthetic oligonucleotide
augcugcccuucuucucu

SEQ ID NO: 43712 - RNA, 18 nt, Artificial Sequence
  Description of Artificial Sequence: Synthetic oligonucleotide
ccugaaugcugcccuucu

SEQ ID NO: 43713 - RNA, 18 nt, Artificial Sequence
  Description of Artificial Sequence: Synthetic oligonucleotide
guguuccugaaugcugcc

SEQ ID NO: 43714 - RNA, 18 nt, Artificial Sequence
  Description of Artificial Sequence: Synthetic oligonucleotide
aguguguguuccugaaug

SEQ ID NO: 43715 - RNA, 18 nt, Artificial Sequence
  Description of Artificial Sequence: Synthetic oligonucleotide
cuuggaguguguguuccu

SEQ ID NO: 43716 - RNA, 18 nt, Artificial Sequence
  Description of Artificial Sequence: Synthetic oligonucleotide
uacagcuuggagugugug

SEQ ID NO: 43717 - RNA, 18 nt, Artificial Sequence
  Description of Artificial Sequence: Synthetic oligonucleotide
ccaaguacagcuuggagu

SEQ ID NO: 43718 - RNA, 18 nt, Artificial Sequence
  Description of Artificial Sequence: Synthetic oligonucleotide
accugccaaguacagcuu

SEQ ID NO: 43719 - RNA, 18 nt, Artificial Sequence
  Description of Artificial Sequence: Synthetic oligonucleotide
cccacaccugccaaguac

SEQ ID NO: 43720 - RNA, 18 nt, Artificial Sequence
  Description of Artificial Sequence: Synthetic oligonucleotide
caccucccacaccugcca

SEQ ID NO: 43721 - RNA, 18 nt, Artificial Sequence
  Description of Artificial Sequence: Synthetic oligonucleotide
cuuuccaccucccacacc

SEQ ID NO: 43722 - RNA, 18 nt, Artificial Sequence
  Description of Artificial Sequence: Synthetic oligonucleotide
cgauccuuuccaccuccc

SEQ ID NO: 43723 - RNA, 18 nt, Artificial Sequence
  Description of Artificial Sequence: Synthetic oligonucleotide
uccuccgauccuuuccac

SEQ ID NO: 43724 - RNA, 18 nt, Artificial Sequence
  Description of Artificial Sequence: Synthetic oligonucleotide
accucuccuccgauccuu

SEQ ID NO: 43725 - RNA, 18 nt, Artificial Sequence
  Description of Artificial Sequence: Synthetic oligonucleotide
cagugaccucuccuccga

SEQ ID NO: 43726 - RNA, 18 nt, Artificial Sequence
  Description of Artificial Sequence: Synthetic oligonucleotide
ggcaccagugaccucucc

SEQ ID NO: 43727 - RNA, 18 nt, Artificial Sequence
  Description of Artificial Sequence: Synthetic oligonucleotide
cgagccguagggccagcg

SEQ ID NO: 43728 - RNA, 18 nt, Artificial Sequence
  Description of Artificial Sequence: Synthetic oligonucleotide
ccguccgagccguagggc

SEQ ID NO: 43729 - RNA, 18 nt, Artificial Sequence
  Description of Artificial Sequence: Synthetic oligonucleotide
ggcagccguccgagccgu

SEQ ID NO: 43730 - RNA, 18 nt, Artificial Sequence
  Description of Artificial Sequence: Synthetic oligonucleotide
agccuggcagccguccga

SEQ ID NO: 43731 - RNA, 18 nt, Artificial Sequence
  Description of Artificial Sequence: Synthetic oligonucleotide
ccgugagccuggcagccg

SEQ ID NO: 43732 - RNA, 18 nt, Artificial Sequence
  Description of Artificial Sequence: Synthetic oligonucleotide
ggaagccgugagccuggc

SEQ ID NO: 43733 - RNA, 18 nt, Artificial Sequence
  Description of Artificial Sequence: Synthetic oligonucleotide
gcccuggaagccgugagc

SEQ ID NO: 43734 - RNA, 18 nt, Artificial Sequence
  Description of Artificial Sequence: Synthetic oligonucleotide
acaaagcccuggaagccg

SEQ ID NO: 43735 - RNA, 18 nt, Artificial Sequence
  Description of Artificial Sequence: Synthetic oligonucleotide
cugucacaaagcccugga

SEQ ID NO: 43736 - RNA, 18 nt, Artificial Sequence
  Description of Artificial Sequence: Synthetic oligonucleotide
caacgcugucacaaagcc

SEQ ID NO: 43737 - RNA, 18 nt, Artificial Sequence
  Description of Artificial Sequence: Synthetic oligonucleotide
cuggccaacgcugucaca

SEQ ID NO: 43738 - RNA, 18 nt, Artificial Sequence
  Description of Artificial Sequence: Synthetic oligonucleotide
agaugcuggccaacgcug

SEQ ID NO: 43739 - RNA, 18 nt, Artificial Sequence
  Description of Artificial Sequence: Synthetic oligonucleotide
gcugcagaugcuggccaa

SEQ ID NO: 43740 - RNA, 18 nt, Artificial Sequence
  Description of Artificial Sequence: Synthetic oligonucleotide
gcacugcugcagaugcug

SEQ ID NO: 43741 - RNA, 18 nt, Artificial Sequence
  Description of Artificial Sequence: Synthetic oligonucleotide
uggcugcacugcugcaga

SEQ ID NO: 43742 - RNA, 18 nt, Artificial Sequence
  Description of Artificial Sequence: Synthetic oligonucleotide
ugcgauggcugcacugcu

SEQ ID NO: 43743 - RNA, 18 nt, Artificial Sequence
  Description of Artificial Sequence: Synthetic oligonucleotide
ccccaugcgauggcugca

SEQ ID NO: 43744 - RNA, 18 nt, Artificial Sequence
  Description of Artificial Sequence: Synthetic oligonucleotide
aacgcccccaugcgaugg

SEQ ID NO: 43745 - RNA, 18 nt, Artificial Sequence
  Description of Artificial Sequence: Synthetic oligonucleotide
gugauaacgcccccaugc

SEQ ID NO: 43746 - RNA, 18 nt, Artificial Sequence
  Description of Artificial Sequence: Synthetic oligonucleotide
uaguggugauaacgcccc

SEQ ID NO: 43747 - RNA, 18 nt, Artificial Sequence
  Description of Artificial Sequence: Synthetic oligonucleotide
ugcaguaguggugauaac

SEQ ID NO: 43748 - RNA, 18 nt, Artificial Sequence
  Description of Artificial Sequence: Synthetic oligonucleotide
cuggcuaucaauucauuc

SEQ ID NO: 43749 - RNA, 18 nt, Artificial Sequence
  Description of Artificial Sequence: Synthetic oligonucleotide
uguaucuggcuaucaauu

SEQ ID NO: 43750 - RNA, 18 nt, Artificial Sequence
  Description of Artificial Sequence: Synthetic oligonucleotide
uuugauguaucuggcuau

SEQ ID NO: 43751 - RNA, 18 nt, Artificial Sequence
  Description of Artificial Sequence: Synthetic oligonucleotide
cugaguuugauguaucug

SEQ ID NO: 43752 - RNA, 18 nt, Artificial Sequence
  Description of Artificial Sequence: Synthetic oligonucleotide
cuguccugaguuugaugu

SEQ ID NO: 43753 - RNA, 18 nt, Artificial Sequence
  Description of Artificial Sequence: Synthetic oligonucleotide
cuugccuguccugaguuu

SEQ ID NO: 43754 - RNA, 18 nt, Artificial Sequence
  Description of Artificial Sequence: Synthetic oligonucleotide
cucgucuugccuguccug

SEQ ID NO: 43755 - RNA, 18 nt, Artificial Sequence
  Description of Artificial Sequence: Synthetic oligonucleotide
ugguccucgucuugccug

SEQ ID NO: 43756 - RNA, 18 nt, Artificial Sequence
  Description of Artificial Sequence: Synthetic oligonucleotide
uuuucugguccucgucuu

SEQ ID NO: 43757 - RNA, 18 nt, Artificial Sequence
  Description of Artificial Sequence: Synthetic oligonucleotide
aauuuccagguggguuau

SEQ ID NO: 43758 - RNA, 18 nt, Artificial Sequence
  Description of Artificial Sequence: Synthetic oligonucleotide
ugcacaauuuccaggugg

SEQ ID NO: 43759 - RNA, 18 nt, Artificial Sequence
  Description of Artificial Sequence: Synthetic oligonucleotide
ugacaugcacaauuucca

SEQ ID NO: 43760 - RNA, 18 nt, Artificial Sequence
  Description of Artificial Sequence: Synthetic oligonucleotide
uucgcugacaugcacaau

SEQ ID NO: 43761 - RNA, 18 nt, Artificial Sequence
  Description of Artificial Sequence: Synthetic oligonucleotide
ggccauucgcugacaugc

SEQ ID NO: 43762 - RNA, 18 nt, Artificial Sequence
  Description of Artificial Sequence: Synthetic oligonucleotide
uuuugggccauucgcuga

SEQ ID NO: 43763 - RNA, 18 nt, Artificial Sequence
  Description of Artificial Sequence: Synthetic oligonucleotide
ugccuuuuugggccauuc

SEQ ID NO: 43764 - RNA, 18 nt, Artificial Sequence
  Description of Artificial Sequence: Synthetic oligonucleotide
caaaaugccuuuuugggc

SEQ ID NO: 43765 - RNA, 18 nt, Artificial Sequence
  Description of Artificial Sequence: Synthetic oligonucleotide
gcagccaaaaugccuuuu

SEQ ID NO: 43766 - RNA, 18 nt, Artificial Sequence
  Description of Artificial Sequence: Synthetic oligonucleotide
ccacugcagccaaaaugc

SEQ ID NO: 43767 - RNA, 18 nt, Artificial Sequence
  Description of Artificial Sequence: Synthetic oligonucleotide
gccagccacugcagccaa

SEQ ID NO: 43768 - RNA, 18 nt, Artificial Sequence
  Description of Artificial Sequence: Synthetic oligonucleotide
gcauagccagccacugca

SEQ ID NO: 43769 - RNA, 18 nt, Artificial Sequence
  Description of Artificial Sequence: Synthetic oligonucleotide
ccaaagcauagccagcca

SEQ ID NO: 43770 - RNA, 18 nt, Artificial Sequence
  Description of Artificial Sequence: Synthetic oligonucleotide
aggagccaaagcauagcc

SEQ ID NO: 43771 - RNA, 18 nt, Artificial Sequence
  Description of Artificial Sequence: Synthetic oligonucleotide
cuccuaggagccaaagca

SEQ ID NO: 43772 - RNA, 18 nt, Artificial Sequence
  Description of Artificial Sequence: Synthetic oligonucleotide
gggcuccuaggagccaaa

SEQ ID NO: 43773 - RNA, 18 nt, Artificial Sequence
  Description of Artificial Sequence: Synthetic oligonucleotide
cagggaacucaaauuggg

SEQ ID NO: 43774 - RNA, 18 nt, Artificial Sequence
  Description of Artificial Sequence: Synthetic oligonucleotide
ccuuacagggaacucaaa

SEQ ID NO: 43775 - RNA, 18 nt, Artificial Sequence
  Description of Artificial Sequence: Synthetic oligonucleotide
gacguccuuacagggaac

SEQ ID NO: 43776 - RNA, 18 nt, Artificial Sequence
  Description of Artificial Sequence: Synthetic oligonucleotide
acacugacguccuuacag

SEQ ID NO: 43777 - RNA, 18 nt, Artificial Sequence
  Description of Artificial Sequence: Synthetic oligonucleotide
cuccaacacugacguccu

SEQ ID NO: 43778 - RNA, 18 nt, Artificial Sequence
  Description of Artificial Sequence: Synthetic oligonucleotide
aauaccuccaacacugac

SEQ ID NO: 43779 - RNA, 18 nt, Artificial Sequence
  Description of Artificial Sequence: Synthetic oligonucleotide
uuuaaaauaccuccaaca

SEQ ID NO: 43780 - RNA, 18 nt, Artificial Sequence
  Description of Artificial Sequence: Synthetic oligonucleotide
gccaauuuaaaauaccuc

SEQ ID NO: 43781 - RNA, 18 nt, Artificial Sequence
  Description of Artificial Sequence: Synthetic oligonucleotide
acugagccaauuuaaaau

SEQ ID NO: 43782 - RNA, 18 nt, Artificial Sequence
  Description of Artificial Sequence: Synthetic oligonucleotide
ugaaaacugagccaauuu

SEQ ID NO: 43783 - RNA, 18 nt, Artificial Sequence
  Description of Artificial Sequence: Synthetic oligonucleotide
aacagugaaaacugagcc

SEQ ID NO: 43784 - RNA, 18 nt, Artificial Sequence
  Description of Artificial Sequence: Synthetic oligonucleotide
ugaugaacagugaaaacu

SEQ ID NO: 43785 - RNA, 18 nt, Artificial Sequence
  Description of Artificial Sequence: Synthetic oligonucleotide
ugaaaugaugaacaguga

SEQ ID NO: 43786 - RNA, 18 nt, Artificial Sequence
  Description of Artificial Sequence: Synthetic oligonucleotide
gucacugaaaugaugaac

SEQ ID NO: 43787 - RNA, 18 nt, Artificial Sequence
  Description of Artificial Sequence: Synthetic oligonucleotide
aaagggucacugaaauga

SEQ ID NO: 43788 - RNA, 18 nt, Artificial Sequence
  Description of Artificial Sequence: Synthetic oligonucleotide
auaauaaagggucacuga

SEQ ID NO: 43789 - RNA, 18 nt, Artificial Sequence
  Description of Artificial Sequence: Synthetic oligonucleotide
accacauaauaaaggguc

SEQ ID NO: 43790 - RNA, 18 nt, Artificial Sequence
  Description of Artificial Sequence: Synthetic oligonucleotide
guaagaccacauaauaaa

SEQ ID NO: 43791 - RNA, 18 nt, Artificial Sequence
  Description of Artificial Sequence: Synthetic oligonucleotide
aacuuguaagaccacaua

SEQ ID NO: 43792 - RNA, 18 nt, Artificial Sequence
  Description of Artificial Sequence: Synthetic oligonucleotide
aaaggaacuuguaagacc

SEQ ID NO: 43793 - RNA, 18 nt, Artificial Sequence
  Description of Artificial Sequence: Synthetic oligonucleotide
guauaaaaggaacuugua

SEQ ID NO: 43794 - RNA, 18 nt, Artificial Sequence
  Description of Artificial Sequence: Synthetic oligonucleotide
ugugaguauaaaaggaac

SEQ ID NO: 43795 - RNA, 18 nt, Artificial Sequence
  Description of Artificial Sequence: Synthetic oligonucleotide
ucccaugugaguauaaaa

SEQ ID NO: 43796 - RNA, 18 nt, Artificial Sequence
  Description of Artificial Sequence: Synthetic oligonucleotide
cauuuucccaugugagua

SEQ ID NO: 43797 - RNA, 18 nt, Artificial Sequence
  Description of Artificial Sequence: Synthetic oligonucleotide
agugacauuuucccaugu

SEQ ID NO: 43798 - RNA, 18 nt, Artificial Sequence
  Description of Artificial Sequence: Synthetic oligonucleotide
uuagcagugacauuuucc

SEQ ID NO: 43799 - RNA, 18 nt, Artificial Sequence
  Description of Artificial Sequence: Synthetic oligonucleotide
cguccuuagcagugacau

SEQ ID NO: 43800 - RNA, 18 nt, Artificial Sequence
  Description of Artificial Sequence: Synthetic oligonucleotide
uacaccguccuuagcagu

SEQ ID NO: 43801 - RNA, 18 nt, Artificial Sequence
  Description of Artificial Sequence: Synthetic oligonucleotide
guucauacaccguccuua

SEQ ID NO: 43802 - RNA, 18 nt, Artificial Sequence
  Description of Artificial Sequence: Synthetic oligonucleotide
gagcgguucauacaccgu

SEQ ID NO: 43803 - RNA, 18 nt, Artificial Sequence
  Description of Artificial Sequence: Synthetic oligonucleotide
uacaggagcgguucauac

SEQ ID NO: 43804 - RNA, 18 nt, Artificial Sequence
  Description of Artificial Sequence: Synthetic oligonucleotide
uacaguacaggagcgguu

SEQ ID NO: 43805 - RNA, 18 nt, Artificial Sequence
  Description of Artificial Sequence: Synthetic oligonucleotide
ugaaauacaguacaggag

SEQ ID NO: 43806 - RNA, 18 nt, Artificial Sequence
  Description of Artificial Sequence: Synthetic oligonucleotide
agcuuugaaauacaguac

SEQ ID NO: 43807 - RNA, 18 nt, Artificial Sequence
  Description of Artificial Sequence: Synthetic oligonucleotide
augucagcuuugaaauac

SEQ ID NO: 43808 - RNA, 18 nt, Artificial Sequence
  Description of Artificial Sequence: Synthetic oligonucleotide
aagaaaugucagcuuuga

SEQ ID NO: 43809 - RNA, 18 nt, Artificial Sequence
  Description of Artificial Sequence: Synthetic oligonucleotide
ugggaaagaaaugucagc

SEQ ID NO: 43810 - RNA, 18 nt, Artificial Sequence
  Description of Artificial Sequence: Synthetic oligonucleotide
cauuuugggaaagaaaug

SEQ ID NO: 43811 - RNA, 18 nt, Artificial Sequence
  Description of Artificial Sequence: Synthetic oligonucleotide
gugcacauuuugggaaag

SEQ ID NO: 43812 - RNA, 18 nt, Artificial Sequence
  Description of Artificial Sequence: Synthetic oligonucleotide
cacaggugcacauuuugg

SEQ ID NO: 43813 - RNA, 18 nt, Artificial Sequence
  Description of Artificial Sequence: Synthetic oligonucleotide
guguucacaggugcacau

SEQ ID NO: 43814 - RNA, 18 nt, Artificial Sequence
  Description of Artificial Sequence: Synthetic oligonucleotide
uugcaguguucacaggug

SEQ ID NO: 43815 - RNA, 18 nt, Artificial Sequence
  Description of Artificial Sequence: Synthetic oligonucleotide
aguuuuugcaguguucac

SEQ ID NO: 43816 - RNA, 18 nt, Artificial Sequence
  Description of Artificial Sequence: Synthetic oligonucleotide
cuugcaguuuuugcagug

SEQ ID NO: 43817 - RNA, 18 nt, Artificial Sequence
  Description of Artificial Sequence: Synthetic oligonucleotide
uugcacuugcaguuuuug

SEQ ID NO: 43818 - RNA, 18 nt, Artificial Sequence
  Description of Artificial Sequence: Synthetic oligonucleotide
ugcauuugcacuugcagu

SEQ ID NO: 43819 - RNA, 18 nt, Artificial Sequence
  Description of Artificial Sequence: Synthetic oligonucleotide
gcaagugcauuugcacuu

SEQ ID NO: 43820 - RNA, 18 nt, Artificial Sequence
  Description of Artificial Sequence: Synthetic oligonucleotide
gaccugcaagugcauuug

SEQ ID NO: 43821 - RNA, 18 nt, Artificial Sequence
  Description of Artificial Sequence: Synthetic oligonucleotide
uucaugaccugcaagugc

SEQ ID NO: 43822 - RNA, 18 nt, Artificial Sequence
  Description of Artificial Sequence: Synthetic oligonucleotide
aaaauuucaugaccugca

SEQ ID NO: 43823 - RNA, 18 nt, Artificial Sequence
  Description of Artificial Sequence: Synthetic oligonucleotide
accucaaaauuucaugac

SEQ ID NO: 43824 - RNA, 18 nt, Artificial Sequence
  Description of Artificial Sequence: Synthetic oligonucleotide
acaaaaccucaaaauuuc

SEQ ID NO: 43825 - RNA, 18 nt, Artificial Sequence
  Description of Artificial Sequence: Synthetic oligonucleotide
aaugcacaaaaccucaaa

SEQ ID NO: 43826 - RNA, 18 nt, Artificial Sequence
  Description of Artificial Sequence: Synthetic oligonucleotide
uuuacaaugcacaaaacc

SEQ ID NO: 43827 - RNA, 18 nt, Artificial Sequence
  Description of Artificial Sequence: Synthetic oligonucleotide
aggauuuuacaaugcaca

SEQ ID NO: 43828 - RNA, 18 nt, Artificial Sequence
  Description of Artificial Sequence: Synthetic oligonucleotide
gcuccaggauuuuacaau

SEQ ID NO: 43829 - RNA, 18 nt, Artificial Sequence
  Description of Artificial Sequence: Synthetic oligonucleotide
uaaucgcuccaggauuuu

SEQ ID NO: 43830 - RNA, 18 nt, Artificial Sequence
  Description of Artificial Sequence: Synthetic oligonucleotide
auauauaaucgcuccagg

SEQ ID NO: 43831 - RNA, 18 nt, Artificial Sequence
  Description of Artificial Sequence: Synthetic oligonucleotide
gacuaauauauaaucgcu

SEQ ID NO: 43832 - RNA, 18 nt, Artificial Sequence
  Description of Artificial Sequence: Synthetic oligonucleotide
auuaugacuaauauauaa

SEQ ID NO: 43833 - RNA, 18 nt, Artificial Sequence
  Description of Artificial Sequence: Synthetic oligonucleotide
uugaaauuaugacuaaua

SEQ ID NO: 43834 - RNA, 18 nt, Artificial Sequence
  Description of Artificial Sequence: Synthetic oligonucleotide
uuucauugaaauuaugac

SEQ ID NO: 43835 - RNA, 18 nt, Artificial Sequence
  Description of Artificial Sequence: Synthetic oligonucleotide
uacuuuuucauugaaauu

SEQ ID NO: 43836 - RNA, 18 nt, Artificial Sequence
  Description of Artificial Sequence: Synthetic oligonucleotide
ggcguuacuuuuucauug

SEQ ID NO: 43837 - RNA, 18 nt, Artificial Sequence
  Description of Artificial Sequence: Synthetic oligonucleotide
cugcuggcguuacuuuuu

SEQ ID NO: 43838 - RNA, 18 nt, Artificial Sequence
  Description of Artificial Sequence: Synthetic oligonucleotide
caaggcugcuggcguuac

SEQ ID NO: 43839 - RNA, 18 nt, Artificial Sequence
  Description of Artificial Sequence: Synthetic oligonucleotide
auacucaaggcugcuggc

SEQ ID NO: 43840 - RNA, 18 nt, Artificial Sequence
  Description of Artificial Sequence: Synthetic oligonucleotide
ggccaauacucaaggcug

SEQ ID NO: 43841 - RNA, 18 nt, Artificial Sequence
  Description of Artificial Sequence: Synthetic oligonucleotide
auucaggccaauacucaa

SEQ ID NO: 43842 - RNA, 18 nt, Artificial Sequence
  Description of Artificial Sequence: Synthetic oligonucleotide
auuacauucaggccaaua

SEQ ID NO: 43843 - RNA, 18 nt, Artificial Sequence
  Description of Artificial Sequence: Synthetic oligonucleotide
uuagcauuacauucaggc

SEQ ID NO: 43844 - RNA, 18 nt, Artificial Sequence
  Description of Artificial Sequence: Synthetic oligonucleotide
aucauuuagcauuacauu

SEQ ID NO: 43845 - RNA, 18 nt, Artificial Sequence
  Description of Artificial Sequence: Synthetic oligonucleotide
cgcacaucauuuagcauu

SEQ ID NO: 43846 - RNA, 18 nt, Artificial Sequence
  Description of Artificial Sequence: Synthetic oligonucleotide
cuggacgcacaucauuua

SEQ ID NO: 43847 - RNA, 18 nt, Artificial Sequence
  Description of Artificial Sequence: Synthetic oligonucleotide
guucccuggacgcacauc

SEQ ID NO: 43848 - RNA, 18 nt, Artificial Sequence
  Description of Artificial Sequence: Synthetic oligonucleotide
caacaguucccuggacgc

SEQ ID NO: 43849 - RNA, 18 nt, Artificial Sequence
  Description of Artificial Sequence: Synthetic oligonucleotide
aaaagcaacaguucccug

SEQ ID NO: 43850 - RNA, 18 nt, Artificial Sequence
  Description of Artificial Sequence: Synthetic oligonucleotide
gcuuaaaaagcaacaguu

SEQ ID NO: 43851 - RNA, 18 nt, Artificial Sequence
  Description of Artificial Sequence: Synthetic oligonucleotide
ccaucgcuuaaaaagcaa

SEQ ID NO: 43852 - RNA, 18 nt, Artificial Sequence
  Description of Artificial Sequence: Synthetic oligonucleotide
aaaagccaucgcuuaaaa

SEQ ID NO: 43853 - RNA, 18 nt, Artificial Sequence
  Description of Artificial Sequence: Synthetic oligonucleotide
ugacaaaaagccaucgcu

SEQ ID NO: 43854 - RNA, 18 nt, Artificial Sequence
  Description of Artificial Sequence: Synthetic oligonucleotide
uaaaauuaaaaagguggg

SEQ ID NO: 43855 - RNA, 18 nt, Artificial Sequence
  Description of Artificial Sequence: Synthetic oligonucleotide
cauucuaaaauuaaaaag

SEQ ID NO: 43856 - RNA, 18 nt, Artificial Sequence
  Description of Artificial Sequence: Synthetic oligonucleotide
guuuucauucuaaaauua

SEQ ID NO: 43857 - RNA, 18 nt, Artificial Sequence
  Description of Artificial Sequence: Synthetic oligonucleotide
gggcuguuuucauucuaa

SEQ ID NO: 43858 - RNA, 18 nt, Artificial Sequence
  Description of Artificial Sequence: Synthetic oligonucleotide
uugggagggaugagaggg

SEQ ID NO: 43859 - RNA, 18 nt, Artificial Sequence
  Description of Artificial Sequence: Synthetic oligonucleotide
uuugggagggaugagagg

SEQ ID NO: 43860 - RNA, 18 nt, Artificial Sequence
  Description of Artificial Sequence: Synthetic oligonucleotide
cuaauuuugggagggaug

SEQ ID NO: 43861 - RNA, 18 nt, Artificial Sequence
  Description of Artificial Sequence: Synthetic oligonucleotide
aaaaacuaauuuugggag

SEQ ID NO: 43862 - RNA, 18 nt, Artificial Sequence
  Description of Artificial Sequence: Synthetic oligonucleotide
cugggaaaaacuaauuuu

SEQ ID NO: 43863 - RNA, 18 nt, Artificial Sequence
  Description of Artificial Sequence: Synthetic oligonucleotide
gggcacugggaaaaacua

SEQ ID NO: 43864 - RNA, 18 nt, Artificial Sequence
  Description of Artificial Sequence: Synthetic oligonucleotide
aucaugggcacugggaaa

SEQ ID NO: 43865 - RNA, 18 nt, Artificial Sequence
  Description of Artificial Sequence: Synthetic oligonucleotide
gagaaaucaugggcacug

SEQ ID NO: 43866 - RNA, 18 nt, Artificial Sequence
  Description of Artificial Sequence: Synthetic oligonucleotide
cccaagagaaaucauggg

SEQ ID NO: 43867 - RNA, 18 nt, Artificial Sequence
  Description of Artificial Sequence: Synthetic oligonucleotide
ucccacccaagagaaauc

SEQ ID NO: 43868 - RNA, 18 nt, Artificial Sequence
  Description of Artificial Sequence: Synthetic oligonucleotide
agucuucccacccaagag

SEQ ID NO: 43869 - RNA, 18 nt, Artificial Sequence
  Description of Artificial Sequence: Synthetic oligonucleotide
aucuuagucuucccaccc

SEQ ID NO: 43870 - RNA, 18 nt, Artificial Sequence
  Description of Artificial Sequence: Synthetic oligonucleotide
gacucaucuuagucuucc

SEQ ID NO: 43871 - RNA, 18 nt, Artificial Sequence
  Description of Artificial Sequence: Synthetic oligonucleotide
guuaagacucaucuuagu

SEQ ID NO: 43872 - RNA, 18 nt, Artificial Sequence
  Description of Artificial Sequence: Synthetic oligonucleotide
ugaaaguuaagacucauc

SEQ ID NO: 43873 - RNA, 18 nt, Artificial Sequence
  Description of Artificial Sequence: Synthetic oligonucleotide
caggaugaaaguuaagac

SEQ ID NO: 43874 - RNA, 18 nt, Artificial Sequence
  Description of Artificial Sequence: Synthetic oligonucleotide
ugauucaggaugaaaguu

SEQ ID NO: 43875 - RNA, 18 nt, Artificial Sequence
  Description of Artificial Sequence: Synthetic oligonucleotide
ugacuugauucaggauga

SEQ ID NO: 43876 - RNA, 18 nt, Artificial Sequence
  Description of Artificial Sequence: Synthetic oligonucleotide
ugcagugacuugauucag

SEQ ID NO: 43877 - RNA, 18 nt, Artificial Sequence
  Description of Artificial Sequence: Synthetic oligonucleotide
aucacugcagugacuuga

SEQ ID NO: 43878 - RNA, 18 nt, Artificial Sequence
  Description of Artificial Sequence: Synthetic oligonucleotide
gggucaucacugcaguga

SEQ ID NO: 43879 - RNA, 18 nt, Artificial Sequence
  Description of Artificial Sequence: Synthetic oligonucleotide
auacugggucaucacugc

SEQ ID NO: 43880 - RNA, 18 nt, Artificial Sequence
  Description of Artificial Sequence: Synthetic oligonucleotide
uuuucauacugggucauc

SEQ ID NO: 43881 - RNA, 18 nt, Artificial Sequence
  Description of Artificial Sequence: Synthetic oligonucleotide
uaagcuuuucauacuggg

SEQ ID NO: 43882 - RNA, 18 nt, Artificial Sequence
  Description of Artificial Sequence: Synthetic oligonucleotide
ugcucuaagcuuuucaua

SEQ ID NO: 43883 - RNA, 18 nt, Artificial Sequence
  Description of Artificial Sequence: Synthetic oligonucleotide
agcgcugcucuaagcuuu

SEQ ID NO: 43884 - RNA, 18 nt, Artificial Sequence
  Description of Artificial Sequence: Synthetic oligonucleotide
cccccagcgcugcucuaa

SEQ ID NO: 43885 - RNA, 18 nt, Artificial Sequence
  Description of Artificial Sequence: Synthetic oligonucleotide
acaagcccccagcgcugc

SEQ ID NO: 43886 - RNA, 18 nt, Artificial Sequence
  Description of Artificial Sequence: Synthetic oligonucleotide
cagacacaagcccccagc

SEQ ID NO: 43887 - RNA, 18 nt, Artificial Sequence
  Description of Artificial Sequence: Synthetic oligonucleotide
ccagccagacacaagccc

SEQ ID NO: 43888 - RNA, 18 nt, Artificial Sequence
  Description of Artificial Sequence: Synthetic oligonucleotide
cagucccagccagacaca

SEQ ID NO: 43889 - RNA, 18 nt, Artificial Sequence
  Description of Artificial Sequence: Synthetic oligonucleotide
auacacagucccagccag

SEQ ID NO: 43890 - RNA, 18 nt, Artificial Sequence
  Description of Artificial Sequence: Synthetic oligonucleotide
uaggaauacacaguccca

SEQ ID NO: 43891 - RNA, 18 nt, Artificial Sequence
  Description of Artificial Sequence: Synthetic oligonucleotide
gcaguuaggaauacacag

SEQ ID NO: 43892 - RNA, 18 nt, Artificial Sequence
  Description of Artificial Sequence: Synthetic oligonucleotide
gcucugcaguuaggaaua

SEQ ID NO: 43893 - RNA, 18 nt, Artificial Sequence
  Description of Artificial Sequence: Synthetic oligonucleotide
acaaagcucugcaguuag

SEQ ID NO: 43894 - RNA, 18 nt, Artificial Sequence
  Description of Artificial Sequence: Synthetic oligonucleotide
ucucaacaaagcucugca

SEQ ID NO: 43895 - RNA, 18 nt, Artificial Sequence
  Description of Artificial Sequence: Synthetic oligonucleotide
uugcaucucaacaaagcu

SEQ ID NO: 43896 - RNA, 18 nt, Artificial Sequence
  Description of Artificial Sequence: Synthetic oligonucleotide
guuauuugcaucucaaca

SEQ ID NO: 43897 - RNA, 18 nt, Artificial Sequence
  Description of Artificial Sequence: Synthetic oligonucleotide
gggugguuauuugcaucu

SEQ ID NO: 43898 - RNA, 18 nt, Artificial Sequence
  Description of Artificial Sequence: Synthetic oligonucleotide
cuuugggaggguuuuggg

SEQ ID NO: 43899 - RNA, 18 nt, Artificial Sequence
  Description of Artificial Sequence: Synthetic oligonucleotide
acucuuugggaggguuuu

SEQ ID NO: 43900 - RNA, 18 nt, Artificial Sequence
  Description of Artificial Sequence: Synthetic oligonucleotide
ucgcuacucuuugggagg

SEQ ID NO: 43901 - RNA, 18 nt, Artificial Sequence
  Description of Artificial Sequence: Synthetic oligonucleotide
uaaaaucgcuacucuuug

SEQ ID NO: 43902 - RNA, 18 nt, Artificial Sequence
  Description of Artificial Sequence: Synthetic oligonucleotide
aaauauaaaaucgcuacu

SEQ ID NO: 43903 - RNA, 18 nt, Artificial Sequence
  Description of Artificial Sequence: Synthetic oligonucleotide
aaaucaaauauaaaaucg

SEQ ID NO: 43904 - RNA, 18 nt, Artificial Sequence
  Description of Artificial Sequence: Synthetic oligonucleotide
aaaggaaaucaaauauaa

SEQ ID NO: 43905 - RNA, 18 nt, Artificial Sequence
  Description of Artificial Sequence: Synthetic oligonucleotide
acaaaaaaggaaaucaaa

SEQ ID NO: 43906 - RNA, 18 nt, Artificial Sequence
  Description of Artificial Sequence: Synthetic oligonucleotide
acaaaacaaaaaaggaaa

SEQ ID NO: 43907 - RNA, 18 nt, Artificial Sequence
  Description of Artificial Sequence: Synthetic oligonucleotide
acaaaacaaaacaaaaaa

SEQ ID NO: 43908 - RNA, 18 nt, Artificial Sequence
  Description of Artificial Sequence: Synthetic oligonucleotide
acaaaacaaaacaaaaca

SEQ ID NO: 43909 - RNA, 18 nt, Artificial Sequence
  Description of Artificial Sequence: Synthetic oligonucleotide
acaaaacaaaacaaaaca

SEQ ID NO: 43910 - RNA, 18 nt, Artificial Sequence
  Description of Artificial Sequence: Synthetic oligonucleotide
acaaaacaaaacaaaaca

SEQ ID NO: 43911 - RNA, 18 nt, Artificial Sequence
  Description of Artificial Sequence: Synthetic oligonucleotide
acaaaacaaaacaaaaca

SEQ ID NO: 43912 - RNA, 18 nt, Artificial Sequence
  Description of Artificial Sequence: Synthetic oligonucleotide
acaaaacaaaacaaaaca

SEQ ID NO: 43913 - RNA, 18 nt, Artificial Sequence
  Description of Artificial Sequence: Synthetic oligonucleotide
gggaaacaaaacaaaaca

SEQ ID NO: 43914 - RNA, 18 nt, Artificial Sequence
  Description of Artificial Sequence: Synthetic oligonucleotide
uguucggguuuaugaggg

SEQ ID NO: 43915 - RNA, 18 nt, Artificial Sequence
  Description of Artificial Sequence: Synthetic oligonucleotide
cauuguucggguuuauga

SEQ ID NO: 43916 - RNA, 18 nt, Artificial Sequence
  Description of Artificial Sequence: Synthetic oligonucleotide
accuacauuguucggguu

SEQ ID NO: 43917 - RNA, 18 nt, Artificial Sequence
  Description of Artificial Sequence: Synthetic oligonucleotide
uagacaccuacauuguuc

SEQ ID NO: 43918 - RNA, 18 nt, Artificial Sequence
  Description of Artificial Sequence: Synthetic oligonucleotide
augacuagacaccuacau

SEQ ID NO: 43919 - RNA, 18 nt, Artificial Sequence
  Description of Artificial Sequence: Synthetic oligonucleotide
uguauaugacuagacacc

SEQ ID NO: 43920 - RNA, 18 nt, Artificial Sequence
  Description of Artificial Sequence: Synthetic oligonucleotide
agaccuguauaugacuag

SEQ ID NO: 43921 - RNA, 18 nt, Artificial Sequence
  Description of Artificial Sequence: Synthetic oligonucleotide
ugcuaagaccuguauaug

SEQ ID NO: 43922 - RNA, 18 nt, Artificial Sequence
  Description of Artificial Sequence: Synthetic oligonucleotide
uuucuugcuaagaccugu

SEQ ID NO: 43923 - RNA, 18 nt, Artificial Sequence
  Description of Artificial Sequence: Synthetic oligonucleotide
cuuucuuucuugcuaaga

SEQ ID NO: 43924 - RNA, 18 nt, Artificial Sequence
  Description of Artificial Sequence: Synthetic oligonucleotide
ucgaacuuucuuucuugc

SEQ ID NO: 43925 - RNA, 18 nt, Artificial Sequence
  Description of Artificial Sequence: Synthetic oligonucleotide
auuucucgaacuuucuuu

SEQ ID NO: 43926 - RNA, 18 nt, Artificial Sequence
  Description of Artificial Sequence: Synthetic oligonucleotide
cuugaauuucucgaacuu

SEQ ID NO: 43927 - RNA, 18 nt, Artificial Sequence
  Description of Artificial Sequence: Synthetic oligonucleotide
ggcggcuugaauuucucg

SEQ ID NO: 43928 - RNA, 18 nt, Artificial Sequence
  Description of Artificial Sequence: Synthetic oligonucleotide
uuaauggcggcuugaauu

SEQ ID NO: 43929 - RNA, 18 nt, Artificial Sequence
  Description of Artificial Sequence: Synthetic oligonucleotide
guaccuuaauggcggcuu

SEQ ID NO: 43930 - RNA, 18 nt, Artificial Sequence
  Description of Artificial Sequence: Synthetic oligonucleotide
cagacguaccuuaauggc

SEQ ID NO: 43931 - RNA, 18 nt, Artificial Sequence
  Description of Artificial Sequence: Synthetic oligonucleotide
caagccagacguaccuua

SEQ ID NO: 43932 - RNA, 18 nt, Artificial Sequence
  Description of Artificial Sequence: Synthetic oligonucleotide
gugggcaagccagacgua

SEQ ID NO: 43933 - RNA, 18 nt, Artificial Sequence
  Description of Artificial Sequence: Synthetic oligonucleotide
uacaagugggcaagccag

SEQ ID NO: 43934 - RNA, 18 nt, Artificial Sequence
  Description of Artificial Sequence: Synthetic oligonucleotide
cccccuacaagugggcaa

SEQ ID NO: 43935 - RNA, 18 nt, Artificial Sequence
  Description of Artificial Sequence: Synthetic oligonucleotide
aaaagcccccuacaagug

SEQ ID NO: 43936 - RNA, 18 nt, Artificial Sequence
  Description of Artificial Sequence: Synthetic oligonucleotide
agaugaaaagcccccuac

SEQ ID NO: 43937 - RNA, 18 nt, Artificial Sequence
  Description of Artificial Sequence: Synthetic oligonucleotide
cauggagaugaaaagccc

SEQ ID NO: 43938 - RNA, 18 nt, Artificial Sequence
  Description of Artificial Sequence: Synthetic oligonucleotide
guaaccauggagaugaaa

SEQ ID NO: 43939 - RNA, 18 nt, Artificial Sequence
  Description of Artificial Sequence: Synthetic oligonucleotide
agccuguaaccauggaga

SEQ ID NO: 43940 - RNA, 18 nt, Artificial Sequence
  Description of Artificial Sequence: Synthetic oligonucleotide
ggaaaagccuguaaccau

SEQ ID NO: 43941 - RNA, 18 nt, Artificial Sequence
  Description of Artificial Sequence: Synthetic oligonucleotide
acaaaggaaaagccugua

SEQ ID NO: 43942 - RNA, 18 nt, Artificial Sequence
  Description of Artificial Sequence: Synthetic oligonucleotide
ggaaaacaaaggaaaagc

SEQ ID NO: 43943 - RNA, 18 nt, Artificial Sequence
  Description of Artificial Sequence: Synthetic oligonucleotide
agggaggaaaacaaagga

SEQ ID NO: 43944 - RNA, 18 nt, Artificial Sequence
  Description of Artificial Sequence: Synthetic oligonucleotide
ccugaaugugacuagaca

SEQ ID NO: 43945 - RNA, 18 nt, Artificial Sequence
  Description of Artificial Sequence: Synthetic oligonucleotide
aagaaccugaaugugacu

SEQ ID NO: 43946 - RNA, 18 nt, Artificial Sequence
  Description of Artificial Sequence: Synthetic oligonucleotide
cuggcaagaaccugaaug

SEQ ID NO: 43947 - RNA, 18 nt, Artificial Sequence
  Description of Artificial Sequence: Synthetic oligonucleotide
uccuucuggcaagaaccu

SEQ ID NO: 43948 - RNA, 18 nt, Artificial Sequence
  Description of Artificial Sequence: Synthetic oligonucleotide
agauuuccuucuggcaag

SEQ ID NO: 43949 - RNA, 18 nt, Artificial Sequence
  Description of Artificial Sequence: Synthetic oligonucleotide
ucacgagauuuccuucug

SEQ ID NO: 43950 - RNA, 18 nt, Artificial Sequence
  Description of Artificial Sequence: Synthetic oligonucleotide
gaaaaucacgagauuucc

SEQ ID NO: 43951 - RNA, 18 nt, Artificial Sequence
  Description of Artificial Sequence: Synthetic oligonucleotide
ggaaugaaaaucacgaga

SEQ ID NO: 43952 - RNA, 18 nt, Artificial Sequence
  Description of Artificial Sequence: Synthetic oligonucleotide
agcuuggaaugaaaauca

SEQ ID NO: 43953 - RNA, 18 nt, Artificial Sequence
  Description of Artificial Sequence: Synthetic oligonucleotide
cuuuugcaucugcauggg

SEQ ID NO: 43954 - RNA, 18 nt, Artificial Sequence
  Description of Artificial Sequence: Synthetic oligonucleotide
uuggacuuuugcaucugc

SEQ ID NO: 43955 - RNA, 18 nt, Artificial Sequence
  Description of Artificial Sequence: Synthetic oligonucleotide
agcacuuggacuuuugca

SEQ ID NO: 43956 - RNA, 18 nt, Artificial Sequence
  Description of Artificial Sequence: Synthetic oligonucleotide
uguccagcacuuggacuu

SEQ ID NO: 43957 - RNA, 18 nt, Artificial Sequence
  Description of Artificial Sequence: Synthetic oligonucleotide
uugauuguccagcacuug

SEQ ID NO: 43958 - RNA, 18 nt, Artificial Sequence
  Description of Artificial Sequence: Synthetic oligonucleotide
gcauuaaacaaugacaag

SEQ ID NO: 43959 - RNA, 18 nt, Artificial Sequence
  Description of Artificial Sequence: Synthetic oligonucleotide
aguaugcauuaaacaaug

SEQ ID NO: 43960 - RNA, 18 nt, Artificial Sequence
  Description of Artificial Sequence: Synthetic oligonucleotide
guuuaaguaugcauuaaa

SEQ ID NO: 43961 - RNA, 18 nt, Artificial Sequence
  Description of Artificial Sequence: Synthetic oligonucleotide
aaauuguuuaaguaugca

SEQ ID NO: 43962 - RNA, 18 nt, Artificial Sequence
  Description of Artificial Sequence: Synthetic oligonucleotide
aaauaaaauuguuuaagu

SEQ ID NO: 43963 - RNA, 18 nt, Artificial Sequence
  Description of Artificial Sequence: Synthetic oligonucleotide
gacaaaaauaaaauuguu

SEQ ID NO: 43964 - RNA, 18 nt, Artificial Sequence
  Description of Artificial Sequence: Synthetic oligonucleotide
uucaagacaaaaauaaaa

SEQ ID NO: 43965 - RNA, 18 nt, Artificial Sequence
  Description of Artificial Sequence: Synthetic oligonucleotide
auaauuucaagacaaaaa

SEQ ID NO: 43966 - RNA, 18 nt, Artificial Sequence
  Description of Artificial Sequence: Synthetic oligonucleotide
uauuaauaauuucaagac

SEQ ID NO: 43967 - RNA, 18 nt, Artificial Sequence
  Description of Artificial Sequence: Synthetic oligonucleotide
cacauuauuaauaauuuc

SEQ ID NO: 43968 - RNA, 18 nt, Artificial Sequence
  Description of Artificial Sequence: Synthetic oligonucleotide
aaaaccacauuauuaaua

SEQ ID NO: 43969 - RNA, 18 nt, Artificial Sequence
  Description of Artificial Sequence: Synthetic oligonucleotide
gacagaaaaccacauuau

SEQ ID NO: 43970 - RNA, 18 nt, Artificial Sequence
  Description of Artificial Sequence: Synthetic oligonucleotide
uguuuaaguaugcauuaa

SEQ ID NO: 43971 - RNA, 18 nt, Artificial Sequence
  Description of Artificial Sequence: Synthetic oligonucleotide
aaaauuguuuaaguaugc

SEQ ID NO: 43972 - RNA, 18 nt, Artificial Sequence
  Description of Artificial Sequence: Synthetic oligonucleotide
aaaauaaaauuguuuaag

SEQ ID NO: 43973 - RNA, 18 nt, Artificial Sequence
  Description of Artificial Sequence: Synthetic oligonucleotide
agacaaaaauaaaauugu

SEQ ID NO: 43974 - RNA, 18 nt, Artificial Sequence
  Description of Artificial Sequence: Synthetic oligonucleotide
uuucaagacaaaaauaaa

SEQ ID NO: 43975 - RNA, 18 nt, Artificial Sequence
  Description of Artificial Sequence: Synthetic oligonucleotide
aauaauuucaagacaaaa

SEQ ID NO: 43976 - RNA, 18 nt, Artificial Sequence
  Description of Artificial Sequence: Synthetic oligonucleotide
uuauuaauaauuucaaga

SEQ ID NO: 43977 - RNA, 18 nt, Artificial Sequence
  Description of Artificial Sequence: Synthetic oligonucleotide
ccacauuauuaauaauuu

SEQ ID NO: 43978 - RNA, 18 nt, Artificial Sequence
  Description of Artificial Sequence: Synthetic oligonucleotide
gaaaaccacauuauuaau

SEQ ID NO: 43979 - RNA, 18 nt, Artificial Sequence
  Description of Artificial Sequence: Synthetic oligonucleotide
ggacagaaaaccacauua

SEQ ID NO: 43980 - RNA, 18 nt, Artificial Sequence
  Description of Artificial Sequence: Synthetic oligonucleotide
ucacacauccguuggaca

SEQ ID NO: 43981 - RNA, 18 nt, Artificial Sequence
  Description of Artificial Sequence: Synthetic oligonucleotide
uuuacucacacauccguu

SEQ ID NO: 43982 - RNA, 18 nt, Artificial Sequence
  Description of Artificial Sequence: Synthetic oligonucleotide
agaauuuuacucacacau

SEQ ID NO: 43983 - RNA, 18 nt, Artificial Sequence
  Description of Artificial Sequence: Synthetic oligonucleotide
ugcccagaauuuuacuca

SEQ ID NO: 43984 - RNA, 18 nt, Artificial Sequence
  Description of Artificial Sequence: Synthetic oligonucleotide
auaccugcccagaauuuu

SEQ ID NO: 43985 - RNA, 18 nt, Artificial Sequence
  Description of Artificial Sequence: Synthetic oligonucleotide
ucguaauaccugcccaga

SEQ ID NO: 43986 - RNA, 18 nt, Artificial Sequence
  Description of Artificial Sequence: Synthetic oligonucleotide
cagucucguaauaccugc

SEQ ID NO: 43987 - RNA, 18 nt, Artificial Sequence
  Description of Artificial Sequence: Synthetic oligonucleotide
ggagccagucucguaaua

SEQ ID NO: 43988 - RNA, 18 nt, Artificial Sequence
  Description of Artificial Sequence: Synthetic oligonucleotide
cugauggagccagucucg

SEQ ID NO: 43989 - RNA, 18 nt, Artificial Sequence
  Description of Artificial Sequence: Synthetic oligonucleotide
ugggucugauggagccag

SEQ ID NO: 43990 - RNA, 18 nt, Artificial Sequence
  Description of Artificial Sequence: Synthetic oligonucleotide
ugcccugggucugaugga

SEQ ID NO: 43991 - RNA, 18 nt, Artificial Sequence
  Description of Artificial Sequence: Synthetic oligonucleotide
ccgauugcccugggucug

SEQ ID NO: 43992 - RNA, 18 nt, Artificial Sequence
  Description of Artificial Sequence: Synthetic oligonucleotide
uaccaccgauugcccugg

SEQ ID NO: 43993 - RNA, 18 nt, Artificial Sequence
  Description of Artificial Sequence: Synthetic oligonucleotide
uuuacuaccaccgauugc

SEQ ID NO: 43994 - RNA, 18 nt, Artificial Sequence
  Description of Artificial Sequence: Synthetic oligonucleotide
cucgguuuacuaccaccg

SEQ ID NO: 43995 - RNA, 18 nt, Artificial Sequence
  Description of Artificial Sequence: Synthetic oligonucleotide
cuacucucgguuuacuac

SEQ ID NO: 43996 - RNA, 18 nt, Artificial Sequence
  Description of Artificial Sequence: Synthetic oligonucleotide
agucgcuacucucgguuu

SEQ ID NO: 43997 - RNA, 18 nt, Artificial Sequence
  Description of Artificial Sequence: Synthetic oligonucleotide
ucuggagucgcuacucuc

SEQ ID NO: 43998 - RNA, 18 nt, Artificial Sequence
  Description of Artificial Sequence: Synthetic oligonucleotide
caacuucuggagucgcua

SEQ ID NO: 43999 - RNA, 18 nt, Artificial Sequence
  Description of Artificial Sequence: Synthetic oligonucleotide
gcuuacaacuucuggagu

SEQ ID NO: 44000 - RNA, 18 nt, Artificial Sequence
  Description of Artificial Sequence: Synthetic oligonucleotide
auuuugcuuacaacuucu

SEQ ID NO: 44001 - RNA, 18 nt, Artificial Sequence
  Description of Artificial Sequence: Synthetic oligonucleotide
gggcuauuuugcuuacaa

SEQ ID NO: 44002 - RNA, 18 nt, Artificial Sequence
  Description of Artificial Sequence: Synthetic oligonucleotide
auacugggcuauuuugcu

SEQ ID NO: 44003 - RNA, 18 nt, Artificial Sequence
  Description of Artificial Sequence: Synthetic oligonucleotide
cgcuuauacugggcuauu

SEQ ID NO: 44004 - RNA, 18 nt, Artificial Sequence
  Description of Artificial Sequence: Synthetic oligonucleotide
acucccgcuuauacuggg

SEQ ID NO: 44005 - RNA, 18 nt, Artificial Sequence
  Description of Artificial Sequence: Synthetic oligonucleotide
cgggcacucccgcuuaua

SEQ ID NO: 44006 - RNA, 18 nt, Artificial Sequence
  Description of Artificial Sequence: Synthetic oligonucleotide
auggacgggcacucccgc

SEQ ID NO: 44007 - RNA, 18 nt, Artificial Sequence
  Description of Artificial Sequence: Synthetic oligonucleotide
caaagauggacgggcacu

SEQ ID NO: 44008 - RNA, 18 nt, Artificial Sequence
  Description of Artificial Sequence: Synthetic oligonucleotide
ccaagcaaagauggacgg

SEQ ID NO: 44009 - RNA, 18 nt, Artificial Sequence
  Description of Artificial Sequence: Synthetic oligonucleotide
auuucccaagcaaagaug

SEQ ID NO: 44010 - RNA, 18 nt, Artificial Sequence
  Description of Artificial Sequence: Synthetic oligonucleotide
cucggauuucccaagcaa

SEQ ID NO: 44011 - RNA, 18 nt, Artificial Sequence
  Description of Artificial Sequence: Synthetic oligonucleotide
ucugucucggauuuccca

SEQ ID NO: 44012 - RNA, 18 nt, Artificial Sequence
  Description of Artificial Sequence: Synthetic oligonucleotide
aguaaucugucucggauu

SEQ ID NO: 44013 - RNA, 18 nt, Artificial Sequence
  Description of Artificial Sequence: Synthetic oligonucleotide
cggacaguaaucugucuc

SEQ ID NO: 44014 - RNA, 18 nt, Artificial Sequence
  Description of Artificial Sequence: Synthetic oligonucleotide
ccccucggacaguaaucu

SEQ ID NO: 44015 - RNA, 18 nt, Artificial Sequence
  Description of Artificial Sequence: Synthetic oligonucleotide
cagacccccucggacagu

SEQ ID NO: 44016 - RNA, 18 nt, Artificial Sequence
  Description of Artificial Sequence: Synthetic oligonucleotide
ugguacagacccccucgg

SEQ ID NO: 44017 - RNA, 18 nt, Artificial Sequence
  Description of Artificial Sequence: Synthetic oligonucleotide
aucguugguacagacccc

SEQ ID NO: 44018 - RNA, 18 nt, Artificial Sequence
  Description of Artificial Sequence: Synthetic oligonucleotide
auguuaucguugguacag

SEQ ID NO: 44019 - RNA, 18 nt, Artificial Sequence
  Description of Artificial Sequence: Synthetic oligonucleotide
uugguauguuaucguugg

SEQ ID NO: 44020 - RNA, 18 nt, Artificial Sequence
  Description of Artificial Sequence: Synthetic oligonucleotide
uacgcuugguauguuauc

SEQ ID NO: 44021 - RNA, 18 nt, Artificial Sequence
  Description of Artificial Sequence: Synthetic oligonucleotide
gaacuuacgcuugguaug

SEQ ID NO: 44022 - RNA, 18 nt, Artificial Sequence
  Description of Artificial Sequence: Synthetic oligonucleotide
ucaaugaacuuacgcuug

SEQ ID NO: 44023 - RNA, 18 nt, Artificial Sequence
  Description of Artificial Sequence: Synthetic oligonucleotide
uguucucaaugaacuuac

SEQ ID NO: 44024 - RNA, 18 nt, Artificial Sequence
  Description of Artificial Sequence: Synthetic oligonucleotide
gcagauguucucaaugaa

SEQ ID NO: 44025 - RNA, 18 nt, Artificial Sequence
  Description of Artificial Sequence: Synthetic oligonucleotide
ggagggcagauguucuca

SEQ ID NO: 44026 - RNA, 18 nt, Artificial Sequence
  Description of Artificial Sequence: Synthetic oligonucleotide
ggcagggagggcagaugu

SEQ ID NO: 44027 - RNA, 18 nt, Artificial Sequence
  Description of Artificial Sequence: Synthetic oligonucleotide
cuuagggcagggagggca

SEQ ID NO: 44028 - RNA, 18 nt, Artificial Sequence
  Description of Artificial Sequence: Synthetic oligonucleotide
uugggcuuagggcaggga

SEQ ID NO: 44029 - RNA, 18 nt, Artificial Sequence
  Description of Artificial Sequence: Synthetic oligonucleotide
gagcauugggcuuagggc

SEQ ID NO: 44030 - RNA, 18 nt, Artificial Sequence
  Description of Artificial Sequence: Synthetic oligonucleotide
ggagagagcauugggcuu

SEQ ID NO: 44031 - RNA, 18 nt, Artificial Sequence
  Description of Artificial Sequence: Synthetic oligonucleotide
aaagaggagagagcauug

SEQ ID NO: 44032 - RNA, 18 nt, Artificial Sequence
  Description of Artificial Sequence: Synthetic oligonucleotide
gagguaaagaggagagag

SEQ ID NO: 44033 - RNA, 18 nt, Artificial Sequence
  Description of Artificial Sequence: Synthetic oligonucleotide
gggaggagguaaagagga

SEQ ID NO: 44034 - RNA, 18 nt, Artificial Sequence
  Description of Artificial Sequence: Synthetic oligonucleotide
agggugggaggagguaaa

SEQ ID NO: 44035 - RNA, 18 nt, Artificial Sequence
  Description of Artificial Sequence: Synthetic oligonucleotide
gagagagggugggaggag

SEQ ID NO: 44036 - RNA, 18 nt, Artificial Sequence
  Description of Artificial Sequence: Synthetic oligonucleotide
guggagagagaggguggg

SEQ ID NO: 44037 - RNA, 18 nt, Artificial Sequence
  Description of Artificial Sequence: Synthetic oligonucleotide
agacaguggagagagagg

SEQ ID NO: 44038 - RNA, 18 nt, Artificial Sequence
  Description of Artificial Sequence: Synthetic oligonucleotide
cuaagagacaguggagag

SEQ ID NO: 44039 - RNA, 18 nt, Artificial Sequence
  Description of Artificial Sequence: Synthetic oligonucleotide
acagacuaagagacagug

SEQ ID NO: 44040 - RNA, 18 nt, Artificial Sequence
  Description of Artificial Sequence: Synthetic oligonucleotide
aggacacagacuaagaga

SEQ ID NO: 44041 - RNA, 18 nt, Artificial Sequence
  Description of Artificial Sequence: Synthetic oligonucleotide
gggagaggacacagacua

SEQ ID NO: 44042 - RNA, 18 nt, Artificial Sequence
  Description of Artificial Sequence: Synthetic oligonucleotide
gagcagggagaggacaca

SEQ ID NO: 44043 - RNA, 18 nt, Artificial Sequence
  Description of Artificial Sequence: Synthetic oligonucleotide
auguggagcagggagagg

SEQ ID NO: 44044 - RNA, 18 nt, Artificial Sequence
  Description of Artificial Sequence: Synthetic oligonucleotide
gacaaauguggagcaggg

SEQ ID NO: 44045 - RNA, 18 nt, Artificial Sequence
  Description of Artificial Sequence: Synthetic oligonucleotide
aaggagacaaauguggag

SEQ ID NO: 44046 - RNA, 18 nt, Artificial Sequence
  Description of Artificial Sequence: Synthetic oligonucleotide
guacaaaggagacaaaug

SEQ ID NO: 44047 - RNA, 18 nt, Artificial Sequence
  Description of Artificial Sequence: Synthetic oligonucleotide
cccagguacaaaggagac

SEQ ID NO: 44048 - RNA, 18 nt, Artificial Sequence
  Description of Artificial Sequence: Synthetic oligonucleotide
guucccccagguacaaag

SEQ ID NO: 44049 - RNA, 18 nt, Artificial Sequence
  Description of Artificial Sequence: Synthetic oligonucleotide
ucucuguucccccaggua

SEQ ID NO: 44050 - RNA, 18 nt, Artificial Sequence
  Description of Artificial Sequence: Synthetic oligonucleotide
auuccucucuguuccccc

SEQ ID NO: 44051 - RNA, 18 nt, Artificial Sequence
  Description of Artificial Sequence: Synthetic oligonucleotide
agggcauuccucucuguu

SEQ ID NO: 44052 - RNA, 18 nt, Artificial Sequence
  Description of Artificial Sequence: Synthetic oligonucleotide
aagucagggcauuccucu

SEQ ID NO: 44053 - RNA, 18 nt, Artificial Sequence
  Description of Artificial Sequence: Synthetic oligonucleotide
aagaaaagucagggcauu

SEQ ID NO: 44054 - RNA, 18 nt, Artificial Sequence
  Description of Artificial Sequence: Synthetic oligonucleotide
agucaaagaaaagucagg

SEQ ID NO: 44055 - RNA, 18 nt, Artificial Sequence
  Description of Artificial Sequence: Synthetic oligonucleotide
cagacagucaaagaaaag

SEQ ID NO: 44056 - RNA, 18 nt, Artificial Sequence
  Description of Artificial Sequence: Synthetic oligonucleotide
uuuuccagacagucaaag

SEQ ID NO: 44057 - RNA, 18 nt, Artificial Sequence
  Description of Artificial Sequence: Synthetic oligonucleotide
ucccauuuuccagacagu

SEQ ID NO: 44058 - RNA, 18 nt, Artificial Sequence
  Description of Artificial Sequence: Synthetic oligonucleotide
uugacucccauuuuccag

SEQ ID NO: 44059 - RNA, 18 nt, Artificial Sequence
  Description of Artificial Sequence: Synthetic oligonucleotide
cacacuugacucccauuu

SEQ ID NO: 44060 - RNA, 18 nt, Artificial Sequence
  Description of Artificial Sequence: Synthetic oligonucleotide
cuccccacacuugacucc

SEQ ID NO: 44061 - RNA, 18 nt, Artificial Sequence
  Description of Artificial Sequence: Synthetic oligonucleotide
aaugacuccccacacuug

SEQ ID NO: 44062 - RNA, 18 nt, Artificial Sequence
  Description of Artificial Sequence: Synthetic oligonucleotide
aagugaaugacuccccac

SEQ ID NO: 44063 - RNA, 18 nt, Artificial Sequence
  Description of Artificial Sequence: Synthetic oligonucleotide
aaaugaagugaaugacuc

SEQ ID NO: 44064 - RNA, 18 nt, Artificial Sequence
  Description of Artificial Sequence: Synthetic oligonucleotide
caugcaaaugaagugaau

SEQ ID NO: 44065 - RNA, 18 nt, Artificial Sequence
  Description of Artificial Sequence: Synthetic oligonucleotide
ugcagcaugcaaaugaag

SEQ ID NO: 44066 - RNA, 18 nt, Artificial Sequence
  Description of Artificial Sequence: Synthetic oligonucleotide
uguuuugcagcaugcaaa

SEQ ID NO: 44067 - RNA, 18 nt, Artificial Sequence
  Description of Artificial Sequence: Synthetic oligonucleotide
cccucuguuuugcagcau

SEQ ID NO: 44068 - RNA, 18 nt, Artificial Sequence
  Description of Artificial Sequence: Synthetic oligonucleotide
cuccgcccucuguuuugc

SEQ ID NO: 44069 - RNA, 18 nt, Artificial Sequence
  Description of Artificial Sequence: Synthetic oligonucleotide
ggugccuccgcccucugu

SEQ ID NO: 44070 - RNA, 18 nt, Artificial Sequence
  Description of Artificial Sequence: Synthetic oligonucleotide
ucccuggugccuccgccc

SEQ ID NO: 44071 - RNA, 18 nt, Artificial Sequence
  Description of Artificial Sequence: Synthetic oligonucleotide
gccuuucccuggugccuc

SEQ ID NO: 44072 - RNA, 18 nt, Artificial Sequence
  Description of Artificial Sequence: Synthetic oligonucleotide
caagugccuuucccuggu

SEQ ID NO: 44073 - RNA, 18 nt, Artificial Sequence
  Description of Artificial Sequence: Synthetic oligonucleotide
ucauucaagugccuuucc

SEQ ID NO: 44074 - RNA, 18 nt, Artificial Sequence
  Description of Artificial Sequence: Synthetic oligonucleotide
cuucuucauucaagugcc

SEQ ID NO: 44075 - RNA, 18 nt, Artificial Sequence
  Description of Artificial Sequence: Synthetic oligonucleotide
uuuuccuucuucauucaa

SEQ ID NO: 44076 - RNA, 18 nt, Artificial Sequence
  Description of Artificial Sequence: Synthetic oligonucleotide
ucucauuuuccuucuuca

SEQ ID NO: 44077 - RNA, 18 nt, Artificial Sequence
  Description of Artificial Sequence: Synthetic oligonucleotide
cugguucucauuuuccuu

SEQ ID NO: 44078 - RNA, 18 nt, Artificial Sequence
  Description of Artificial Sequence: Synthetic oligonucleotide
acaaucugguucucauuu

SEQ ID NO: 44079 - RNA, 18 nt, Artificial Sequence
  Description of Artificial Sequence: Synthetic oligonucleotide
aaguuacaaucugguucu

SEQ ID NO: 44080 - RNA, 18 nt, Artificial Sequence
  Description of Artificial Sequence: Synthetic oligonucleotide
ggacgaaguuacaaucug

SEQ ID NO: 44081 - RNA, 18 nt, Artificial Sequence
  Description of Artificial Sequence: Synthetic oligonucleotide
gauuaggacgaaguuaca

SEQ ID NO: 44082 - RNA, 18 nt, Artificial Sequence
  Description of Artificial Sequence: Synthetic oligonucleotide
agguggauuaggacgaag

SEQ ID NO: 44083 - RNA, 18 nt, Artificial Sequence
  Description of Artificial Sequence: Synthetic oligonucleotide
cuggcagguggauuagga

SEQ ID NO: 44084 - RNA, 18 nt, Artificial Sequence
  Description of Artificial Sequence: Synthetic oligonucleotide
aaguucuggcagguggau

SEQ ID NO: 44085 - RNA, 18 nt, Artificial Sequence
  Description of Artificial Sequence: Synthetic oligonucleotide
aaggaaaguucuggcagg

SEQ ID NO: 44086 - RNA, 18 nt, Artificial Sequence
  Description of Artificial Sequence: Synthetic oligonucleotide
ucacacauccguuggaca

SEQ ID NO: 44087 - RNA, 18 nt, Artificial Sequence
  Description of Artificial Sequence: Synthetic oligonucleotide
uuuacucacacauccguu

SEQ ID NO: 44088 - RNA, 18 nt, Artificial Sequence
  Description of Artificial Sequence: Synthetic oligonucleotide
agaauuuuacucacacau

SEQ ID NO: 44089 - RNA, 18 nt, Artificial Sequence
  Description of Artificial Sequence: Synthetic oligonucleotide
ugcccagaauuuuacuca

SEQ ID NO: 44090 - RNA, 18 nt, Artificial Sequence
  Description of Artificial Sequence: Synthetic oligonucleotide
auaccugcccagaauuuu

SEQ ID NO: 44091 - RNA, 18 nt, Artificial Sequence
  Description of Artificial Sequence: Synthetic oligonucleotide
ucguaauaccugcccaga

SEQ ID NO: 44092 - RNA, 18 nt, Artificial Sequence
  Description of Artificial Sequence: Synthetic oligonucleotide
cagucucguaauaccugc

SEQ ID NO: 44093 - RNA, 18 nt, Artificial Sequence
  Description of Artificial Sequence: Synthetic oligonucleotide
ggagccagucucguaaua

SEQ ID NO: 44094 - RNA, 18 nt, Artificial Sequence
  Description of Artificial Sequence: Synthetic oligonucleotide
cugauggagccagucucg

SEQ ID NO: 44095 - RNA, 18 nt, Artificial Sequence
  Description of Artificial Sequence: Synthetic oligonucleotide
ugggucugauggagccag

SEQ ID NO: 44096 - RNA, 18 nt, Artificial Sequence
  Description of Artificial Sequence: Synthetic oligonucleotide
ugcccugggucugaugga

SEQ ID NO: 44097 - RNA, 18 nt, Artificial Sequence
  Description of Artificial Sequence: Synthetic oligonucleotide
ccgauugcccugggucug

SEQ ID NO: 44098 - RNA, 18 nt, Artificial Sequence
  Description of Artificial Sequence: Synthetic oligonucleotide
uaccaccgauugcccugg

SEQ ID NO: 44099 - RNA, 18 nt, Artificial Sequence
  Description of Artificial Sequence: Synthetic oligonucleotide
uuuacuaccaccgauugc

SEQ ID NO: 44100 - RNA, 18 nt, Artificial Sequence
  Description of Artificial Sequence: Synthetic oligonucleotide
cucgguuuacuaccaccg

SEQ ID NO: 44101 - RNA, 18 nt, Artificial Sequence
  Description of Artificial Sequence: Synthetic oligonucleotide
cuacucucgguuuacuac

SEQ ID NO: 44102 - RNA, 18 nt, Artificial Sequence
  Description of Artificial Sequence: Synthetic oligonucleotide
agucgcuacucucgguuu

SEQ ID NO: 44103 - RNA, 18 nt, Artificial Sequence
  Description of Artificial Sequence: Synthetic oligonucleotide
ucuggagucgcuacucuc

SEQ ID NO: 44104 - RNA, 18 nt, Artificial Sequence
  Description of Artificial Sequence: Synthetic oligonucleotide
caacuucuggagucgcua

SEQ ID NO: 44105 - RNA, 18 nt, Artificial Sequence
  Description of Artificial Sequence: Synthetic oligonucleotide
gcuuacaacuucuggagu

SEQ ID NO: 44106 - RNA, 18 nt, Artificial Sequence
  Description of Artificial Sequence: Synthetic oligonucleotide
auuuugcuuacaacuucu

SEQ ID NO: 44107 - RNA, 18 nt, Artificial Sequence
  Description of Artificial Sequence: Synthetic oligonucleotide
gggcuauuuugcuuacaa

SEQ ID NO: 44108 - RNA, 18 nt, Artificial Sequence
  Description of Artificial Sequence: Synthetic oligonucleotide
auacugggcuauuuugcu

SEQ ID NO: 44109 - RNA, 18 nt, Artificial Sequence
  Description of Artificial Sequence: Synthetic oligonucleotide
cgcuuauacugggcuauu

SEQ ID NO: 44110 - RNA, 18 nt, Artificial Sequence
  Description of Artificial Sequence: Synthetic oligonucleotide
acucccgcuuauacuggg

SEQ ID NO: 44111 - RNA, 18 nt, Artificial Sequence
  Description of Artificial Sequence: Synthetic oligonucleotide
cgggcacucccgcuuaua

SEQ ID NO: 44112 - RNA, 18 nt, Artificial Sequence
  Description of Artificial Sequence: Synthetic oligonucleotide
auggacgggcacucccgc

SEQ ID NO: 44113 - RNA, 18 nt, Artificial Sequence
  Description of Artificial Sequence: Synthetic oligonucleotide
caaagauggacgggcacu

SEQ ID NO: 44114 - RNA, 18 nt, Artificial Sequence
  Description of Artificial Sequence: Synthetic oligonucleotide
ccaagcaaagauggacgg

SEQ ID NO: 44115 - RNA, 18 nt, Artificial Sequence
  Description of Artificial Sequence: Synthetic oligonucleotide
auuucccaagcaaagaug

SEQ ID NO: 44116 - RNA, 18 nt, Artificial Sequence
  Description of Artificial Sequence: Synthetic oligonucleotide
cucggauuucccaagcaa

SEQ ID NO: 44117 - RNA, 18 nt, Artificial Sequence
  Description of Artificial Sequence: Synthetic oligonucleotide
ucugucucggauuuccca

SEQ ID NO: 44118 - RNA, 18 nt, Artificial Sequence
  Description of Artificial Sequence: Synthetic oligonucleotide
aguaaucugucucggauu

SEQ ID NO: 44119 - RNA, 18 nt, Artificial Sequence
  Description of Artificial Sequence: Synthetic oligonucleotide
cggacaguaaucugucuc

SEQ ID NO: 44120 - RNA, 18 nt, Artificial Sequence
  Description of Artificial Sequence: Synthetic oligonucleotide
ccccucggacaguaaucu

SEQ ID NO: 44121 - RNA, 18 nt, Artificial Sequence
  Description of Artificial Sequence: Synthetic oligonucleotide
cagacccccucggacagu

SEQ ID NO: 44122 - RNA, 18 nt, Artificial Sequence
  Description of Artificial Sequence: Synthetic oligonucleotide
ugguacagacccccucgg

SEQ ID NO: 44123 - RNA, 18 nt, Artificial Sequence
  Description of Artificial Sequence: Synthetic oligonucleotide
aucguugguacagacccc

SEQ ID NO: 44124 - RNA, 18 nt, Artificial Sequence
  Description of Artificial Sequence: Synthetic oligonucleotide
auguuaucguugguacag

SEQ ID NO: 44125 - RNA, 18 nt, Artificial Sequence
  Description of Artificial Sequence: Synthetic oligonucleotide
uugguauguuaucguugg

SEQ ID NO: 44126 - RNA, 18 nt, Artificial Sequence
  Description of Artificial Sequence: Synthetic oligonucleotide
uacgcuugguauguuauc

SEQ ID NO: 44127 - RNA, 18 nt, Artificial Sequence
  Description of Artificial Sequence: Synthetic oligonucleotide
gaacuuacgcuugguaug

SEQ ID NO: 44128 - RNA, 18 nt, Artificial Sequence
  Description of Artificial Sequence: Synthetic oligonucleotide
ucaaugaacuuacgcuug

SEQ ID NO: 44129 - RNA, 18 nt, Artificial Sequence
  Description of Artificial Sequence: Synthetic oligonucleotide
uguucucaaugaacuuac

SEQ ID NO: 44130 - RNA, 18 nt, Artificial Sequence
  Description of Artificial Sequence: Synthetic oligonucleotide
gcagauguucucaaugaa

SEQ ID NO: 44131 - RNA, 18 nt, Artificial Sequence
  Description of Artificial Sequence: Synthetic oligonucleotide
ggagggcagauguucuca

SEQ ID NO: 44132 - RNA, 18 nt, Artificial Sequence
  Description of Artificial Sequence: Synthetic oligonucleotide
ggcagggagggcagaugu

SEQ ID NO: 44133 - RNA, 18 nt, Artificial Sequence
  Description of Artificial Sequence: Synthetic oligonucleotide
cuuagggcagggagggca

SEQ ID NO: 44134 - RNA, 18 nt, Artificial Sequence
  Description of Artificial Sequence: Synthetic oligonucleotide
uugggcuuagggcaggga

SEQ ID NO: 44135 - RNA, 18 nt, Artificial Sequence
  Description of Artificial Sequence: Synthetic oligonucleotide
gagcauugggcuuagggc

SEQ ID NO: 44136 - RNA, 18 nt, Artificial Sequence
  Description of Artificial Sequence: Synthetic oligonucleotide
ggagagagcauugggcuu

SEQ ID NO: 44137 - RNA, 18 nt, Artificial Sequence
  Description of Artificial Sequence: Synthetic oligonucleotide
aaagaggagagagcauug

SEQ ID NO: 44138 - RNA, 18 nt, Artificial Sequence
  Description of Artificial Sequence: Synthetic oligonucleotide
gagguaaagaggagagag

SEQ ID NO: 44139 - RNA, 18 nt, Artificial Sequence
  Description of Artificial Sequence: Synthetic oligonucleotide
gggaggagguaaagagga

SEQ ID NO: 44140 - RNA, 18 nt, Artificial Sequence
  Description of Artificial Sequence: Synthetic oligonucleotide
agggugggaggagguaaa

SEQ ID NO: 44141 - RNA, 18 nt, Artificial Sequence
  Description of Artificial Sequence: Synthetic oligonucleotide
gagagagggugggaggag

SEQ ID NO: 44142 - RNA, 18 nt, Artificial Sequence
  Description of Artificial Sequence: Synthetic oligonucleotide
guggagagagaggguggg

SEQ ID NO: 44143 - RNA, 18 nt, Artificial Sequence
  Description of Artificial Sequence: Synthetic oligonucleotide
agacaguggagagagagg

SEQ ID NO: 44144 - RNA, 18 nt, Artificial Sequence
  Description of Artificial Sequence: Synthetic oligonucleotide
cuaagagacaguggagag

SEQ ID NO: 44145 - RNA, 18 nt, Artificial Sequence
  Description of Artificial Sequence: Synthetic oligonucleotide
acagacuaagagacagug

SEQ ID NO: 44146 - RNA, 18 nt, Artificial Sequence
  Description of Artificial Sequence: Synthetic oligonucleotide
aggacacagacuaagaga

SEQ ID NO: 44147 - RNA, 18 nt, Artificial Sequence
  Description of Artificial Sequence: Synthetic oligonucleotide
gggagaggacacagacua

SEQ ID NO: 44148 - RNA, 18 nt, Artificial Sequence
  Description of Artificial Sequence: Synthetic oligonucleotide
gagcagggagaggacaca

SEQ ID NO: 44149 - RNA, 18 nt, Artificial Sequence
  Description of Artificial Sequence: Synthetic oligonucleotide
auguggagcagggagagg

SEQ ID NO: 44150 - RNA, 18 nt, Artificial Sequence
  Description of Artificial Sequence: Synthetic oligonucleotide
gacaaauguggagcaggg

SEQ ID NO: 44151 - RNA, 18 nt, Artificial Sequence
  Description of Artificial Sequence: Synthetic oligonucleotide
aaggagacaaauguggag

SEQ ID NO: 44152 - RNA, 18 nt, Artificial Sequence
  Description of Artificial Sequence: Synthetic oligonucleotide
guacaaaggagacaaaug

SEQ ID NO: 44153 - RNA, 18 nt, Artificial Sequence
  Description of Artificial Sequence: Synthetic oligonucleotide
cccagguacaaaggagac

SEQ ID NO: 44154 - RNA, 18 nt, Artificial Sequence
  Description of Artificial Sequence: Synthetic oligonucleotide
guucccccagguacaaag

SEQ ID NO: 44155 - RNA, 18 nt, Artificial Sequence
  Description of Artificial Sequence: Synthetic oligonucleotide
ucucuguucccccaggua

SEQ ID NO: 44156 - RNA, 18 nt, Artificial Sequence
  Description of Artificial Sequence: Synthetic oligonucleotide
auuccucucuguuccccc

SEQ ID NO: 44157 - RNA, 18 nt, Artificial Sequence
  Description of Artificial Sequence: Synthetic oligonucleotide
agggcauuccucucuguu

SEQ ID NO: 44158 - RNA, 18 nt, Artificial Sequence
  Description of Artificial Sequence: Synthetic oligonucleotide
aagucagggcauuccucu

SEQ ID NO: 44159 - RNA, 18 nt, Artificial Sequence
  Description of Artificial Sequence: Synthetic oligonucleotide
aagaaaagucagggcauu

SEQ ID NO: 44160 - RNA, 18 nt, Artificial Sequence
  Description of Artificial Sequence: Synthetic oligonucleotide
agucaaagaaaagucagg

SEQ ID NO: 44161 - RNA, 18 nt, Artificial Sequence
  Description of Artificial Sequence: Synthetic oligonucleotide
cagacagucaaagaaaag

SEQ ID NO: 44162 - RNA, 18 nt, Artificial Sequence
  Description of Artificial Sequence: Synthetic oligonucleotide
uuuuccagacagucaaag

SEQ ID NO: 44163 - RNA, 18 nt, Artificial Sequence
  Description of Artificial Sequence: Synthetic oligonucleotide
ucccauuuuccagacagu

SEQ ID NO: 44164 - RNA, 18 nt, Artificial Sequence
  Description of Artificial Sequence: Synthetic oligonucleotide
uugacucccauuuuccag

SEQ ID NO: 44165 - RNA, 18 nt, Artificial Sequence
  Description of Artificial Sequence: Synthetic oligonucleotide
cacacuugacucccauuu

SEQ ID NO: 44166 - RNA, 18 nt, Artificial Sequence
  Description of Artificial Sequence: Synthetic oligonucleotide
cuccccacacuugacucc

SEQ ID NO: 44167 - RNA, 18 nt, Artificial Sequence
  Description of Artificial Sequence: Synthetic oligonucleotide
aaugacuccccacacuug

SEQ ID NO: 44168 - RNA, 18 nt, Artificial Sequence
  Description of Artificial Sequence: Synthetic oligonucleotide
aagugaaugacuccccac

SEQ ID NO: 44169 - RNA, 18 nt, Artificial Sequence
  Description of Artificial Sequence: Synthetic oligonucleotide
aaaugaagugaaugacuc

SEQ ID NO: 44170 - RNA, 18 nt, Artificial Sequence
  Description of Artificial Sequence: Synthetic oligonucleotide
caugcaaaugaagugaau

SEQ ID NO: 44171 - RNA, 18 nt, Artificial Sequence
  Description of Artificial Sequence: Synthetic oligonucleotide
ugcagcaugcaaaugaag

SEQ ID NO: 44172 - RNA, 18 nt, Artificial Sequence
  Description of Artificial Sequence: Synthetic oligonucleotide
uguuuugcagcaugcaaa

SEQ ID NO: 44173 - RNA, 18 nt, Artificial Sequence
  Description of Artificial Sequence: Synthetic oligonucleotide
cccucuguuuugcagcau

SEQ ID NO: 44174 - RNA, 18 nt, Artificial Sequence
  Description of Artificial Sequence: Synthetic oligonucleotide
cuccgcccucuguuuugc

SEQ ID NO: 44175 - RNA, 18 nt, Artificial Sequence
  Description of Artificial Sequence: Synthetic oligonucleotide
ggugccuccgcccucugu

SEQ ID NO: 44176 - RNA, 18 nt, Artificial Sequence
  Description of Artificial Sequence: Synthetic oligonucleotide
ucccuggugccuccgccc

SEQ ID NO: 44177 - RNA, 18 nt, Artificial Sequence
  Description of Artificial Sequence: Synthetic oligonucleotide
gccuuucccuggugccuc

SEQ ID NO: 44178 - RNA, 18 nt, Artificial Sequence
  Description of Artificial Sequence: Synthetic oligonucleotide
caagugccuuucccuggu

SEQ ID NO: 44179 - RNA, 18 nt, Artificial Sequence
  Description of Artificial Sequence: Synthetic oligonucleotide
ucauucaagugccuuucc

SEQ ID NO: 44180 - RNA, 18 nt, Artificial Sequence
  Description of Artificial Sequence: Synthetic oligonucleotide
cuucuucauucaagugcc

SEQ ID NO: 44181 - RNA, 18 nt, Artificial Sequence
  Description of Artificial Sequence: Synthetic oligonucleotide
uuuuccuucuucauucaa

SEQ ID NO: 44182 - RNA, 18 nt, Artificial Sequence
  Description of Artificial Sequence: Synthetic oligonucleotide
ucucauuuuccuucuuca

SEQ ID NO: 44183 - RNA, 18 nt, Artificial Sequence
  Description of Artificial Sequence: Synthetic oligonucleotide
cugguucucauuuuccuu

SEQ ID NO: 44184 - RNA, 18 nt, Artificial Sequence
  Description of Artificial Sequence: Synthetic oligonucleotide
acaaucugguucucauuu

SEQ ID NO: 44185 - RNA, 18 nt, Artificial Sequence
  Description of Artificial Sequence: Synthetic oligonucleotide
aaguuacaaucugguucu

SEQ ID NO: 44186 - RNA, 18 nt, Artificial Sequence
  Description of Artificial Sequence: Synthetic oligonucleotide
ggacgaaguuacaaucug

SEQ ID NO: 44187 - RNA, 18 nt, Artificial Sequence
  Description of Artificial Sequence: Synthetic oligonucleotide
gauuaggacgaaguuaca

SEQ ID NO: 44188 - RNA, 18 nt, Artificial Sequence
  Description of Artificial Sequence: Synthetic oligonucleotide
agguggauuaggacgaag

SEQ ID NO: 44189 - RNA, 18 nt, Artificial Sequence
  Description of Artificial Sequence: Synthetic oligonucleotide
cuggcagguggauuagga

SEQ ID NO: 44190 - RNA, 18 nt, Artificial Sequence
  Description of Artificial Sequence: Synthetic oligonucleotide
aaguucuggcagguggau

SEQ ID NO: 44191 - RNA, 18 nt, Artificial Sequence
  Description of Artificial Sequence: Synthetic oligonucleotide
aaggaaaguucuggcagg

SEQ ID NO: 44192 - RNA, 18 nt, Artificial Sequence
  Description of Artificial Sequence: Synthetic oligonucleotide
ggauggaaauggaugugu

SEQ ID NO: 44193 - RNA, 18 nt, Artificial Sequence
  Description of Artificial Sequence: Synthetic oligonucleotide
uauuaggauggaaaugga

SEQ ID NO: 44194 - RNA, 18 nt, Artificial Sequence
  Description of Artificial Sequence: Synthetic oligonucleotide
uuuaauauuaggauggaa

SEQ ID NO: 44195 - RNA, 18 nt, Artificial Sequence
  Description of Artificial Sequence: Synthetic oligonucleotide
uauuguuuaauauuagga

SEQ ID NO: 44196 - RNA, 18 nt, Artificial Sequence
  Description of Artificial Sequence: Synthetic oligonucleotide
cauuauauuguuuaauau

SEQ ID NO: 44197 - RNA, 18 nt, Artificial Sequence
  Description of Artificial Sequence: Synthetic oligonucleotide
ucuuucauuauauuguuu

SEQ ID NO: 44198 - RNA, 18 nt, Artificial Sequence
  Description of Artificial Sequence: Synthetic oligonucleotide
agcuuucuuucauuauau

SEQ ID NO: 44199 - RNA, 18 nt, Artificial Sequence
  Description of Artificial Sequence: Synthetic oligonucleotide
uguaaagcuuucuuucau

SEQ ID NO: 44200 - RNA, 18 nt, Artificial Sequence
  Description of Artificial Sequence: Synthetic oligonucleotide
cuuguuguaaagcuuucu

SEQ ID NO: 44201 - RNA, 18 nt, Artificial Sequence
  Description of Artificial Sequence: Synthetic oligonucleotide
uuagacuuguuguaaagc

SEQ ID NO: 44202 - RNA, 18 nt, Artificial Sequence
  Description of Artificial Sequence: Synthetic oligonucleotide
acuauuuagacuuguugu

SEQ ID NO: 44203 - RNA, 18 nt, Artificial Sequence
  Description of Artificial Sequence: Synthetic oligonucleotide
uaaaaacuauuuagacuu

SEQ ID NO: 44204 - RNA, 18 nt, Artificial Sequence
  Description of Artificial Sequence: Synthetic oligonucleotide
gaaaauaaaaacuauuua

SEQ ID NO: 44205 - RNA, 18 nt, Artificial Sequence
  Description of Artificial Sequence: Synthetic oligonucleotide
ugcccgaaaauaaaaacu

SEQ ID NO: 44206 - RNA, 18 nt, Artificial Sequence
  Description of Artificial Sequence: Synthetic oligonucleotide
aagacugcccgaaaauaa

SEQ ID NO: 44207 - RNA, 18 nt, Artificial Sequence
  Description of Artificial Sequence: Synthetic oligonucleotide
guuaaaagacugcccgaa

SEQ ID NO: 44208 - RNA, 18 nt, Artificial Sequence
  Description of Artificial Sequence: Synthetic oligonucleotide
gcuuuguuaaaagacugc

SEQ ID NO: 44209 - RNA, 18 nt, Artificial Sequence
  Description of Artificial Sequence: Synthetic oligonucleotide
gcuuugcuuuguuaaaag

SEQ ID NO: 44210 - RNA, 18 nt, Artificial Sequence
  Description of Artificial Sequence: Synthetic oligonucleotide
cgguugcuuugcuuuguu

SEQ ID NO: 44211 - RNA, 18 nt, Artificial Sequence
  Description of Artificial Sequence: Synthetic oligonucleotide
ucacacgguugcuuugcu

SEQ ID NO: 44212 - RNA, 18 nt, Artificial Sequence
  Description of Artificial Sequence: Synthetic oligonucleotide
cuaacucacacgguugcu

SEQ ID NO: 44213 - RNA, 18 nt, Artificial Sequence
  Description of Artificial Sequence: Synthetic oligonucleotide
gugaccuaacucacacgg

SEQ ID NO: 44214 - RNA, 18 nt, Artificial Sequence
  Description of Artificial Sequence: Synthetic oligonucleotide
cucuggugaccuaacuca

SEQ ID NO: 44215 - RNA, 18 nt, Artificial Sequence
  Description of Artificial Sequence: Synthetic oligonucleotide
ggugucucuggugaccua

SEQ ID NO: 44216 - RNA, 18 nt, Artificial Sequence
  Description of Artificial Sequence: Synthetic oligonucleotide
ugcuuggugucucuggug

SEQ ID NO: 44217 - RNA, 18 nt, Artificial Sequence
  Description of Artificial Sequence: Synthetic oligonucleotide
accauugcuuggugucuc

SEQ ID NO: 44218 - RNA, 18 nt, Artificial Sequence
  Description of Artificial Sequence: Synthetic oligonucleotide
ccuucaccauugcuuggu

SEQ ID NO: 44219 - RNA, 18 nt, Artificial Sequence
  Description of Artificial Sequence: Synthetic oligonucleotide
ggguccuucaccauugcu

SEQ ID NO: 44220 - RNA, 18 nt, Artificial Sequence
  Description of Artificial Sequence: Synthetic oligonucleotide
agagaauugggcggaggg

SEQ ID NO: 44221 - RNA, 18 nt, Artificial Sequence
  Description of Artificial Sequence: Synthetic oligonucleotide
uggauagagaauugggcg

SEQ ID NO: 44222 - RNA, 18 nt, Artificial Sequence
  Description of Artificial Sequence: Synthetic oligonucleotide
uuaguuggauagagaauu

SEQ ID NO: 44223 - RNA, 18 nt, Artificial Sequence
  Description of Artificial Sequence: Synthetic oligonucleotide
gaaauuuaguuggauaga

SEQ ID NO: 44224 - RNA, 18 nt, Artificial Sequence
  Description of Artificial Sequence: Synthetic oligonucleotide
gcauggaaauuuaguugg

SEQ ID NO: 44225 - RNA, 18 nt, Artificial Sequence
  Description of Artificial Sequence: Synthetic oligonucleotide
uuugggcauggaaauuua

SEQ ID NO: 44226 - RNA, 18 nt, Artificial Sequence
  Description of Artificial Sequence: Synthetic oligonucleotide
aucacuuugggcauggaa

SEQ ID NO: 44227 - RNA, 18 nt, Artificial Sequence
  Description of Artificial Sequence: Synthetic oligonucleotide
uagcuaucacuuugggca

SEQ ID NO: 44228 - RNA, 18 nt, Artificial Sequence
  Description of Artificial Sequence: Synthetic oligonucleotide
aaugauagcuaucacuuu

SEQ ID NO: 44229 - RNA, 18 nt, Artificial Sequence
  Description of Artificial Sequence: Synthetic oligonucleotide
agagaauugggcggaggg

SEQ ID NO: 44230 - RNA, 18 nt, Artificial Sequence
  Description of Artificial Sequence: Synthetic oligonucleotide
ggauagagaauugggcgg

SEQ ID NO: 44231 - RNA, 18 nt, Artificial Sequence
  Description of Artificial Sequence: Synthetic oligonucleotide
uaguuggauagagaauug

SEQ ID NO: 44232 - RNA, 18 nt, Artificial Sequence
  Description of Artificial Sequence: Synthetic oligonucleotide
aaauuuaguuggauagag

SEQ ID NO: 44233 - RNA, 18 nt, Artificial Sequence
  Description of Artificial Sequence: Synthetic oligonucleotide
cauggaaauuuaguugga

SEQ ID NO: 44234 - RNA, 18 nt, Artificial Sequence
  Description of Artificial Sequence: Synthetic oligonucleotide
uugggcauggaaauuuag

SEQ ID NO: 44235 - RNA, 18 nt, Artificial Sequence
  Description of Artificial Sequence: Synthetic oligonucleotide
ucacuuugggcauggaaa

SEQ ID NO: 44236 - RNA, 18 nt, Artificial Sequence
  Description of Artificial Sequence: Synthetic oligonucleotide
agcuaucacuuugggcau

SEQ ID NO: 44237 - RNA, 18 nt, Artificial Sequence
  Description of Artificial Sequence: Synthetic oligonucleotide
augauagcuaucacuuug

SEQ ID NO: 44238 - RNA, 18 nt, Artificial Sequence
  Description of Artificial Sequence: Synthetic oligonucleotide
aaaaaaugauagcuauca

SEQ ID NO: 44239 - RNA, 18 nt, Artificial Sequence
  Description of Artificial Sequence: Synthetic oligonucleotide
cguggaaaaaaugauagc

SEQ ID NO: 44240 - RNA, 18 nt, Artificial Sequence
  Description of Artificial Sequence: Synthetic oligonucleotide
uacaccguggaaaaaaug

SEQ ID NO: 44241 - RNA, 18 nt, Artificial Sequence
  Description of Artificial Sequence: Synthetic oligonucleotide
gcagauacaccguggaaa

SEQ ID NO: 44242 - RNA, 18 nt, Artificial Sequence
  Description of Artificial Sequence: Synthetic oligonucleotide
gauuugcagauacaccgu

SEQ ID NO: 44243 - RNA, 18 nt, Artificial Sequence
  Description of Artificial Sequence: Synthetic oligonucleotide
ggguggauuugcagauac

SEQ ID NO: 44244 - RNA, 18 nt, Artificial Sequence
  Description of Artificial Sequence: Synthetic oligonucleotide
acaguggguggauuugca

SEQ ID NO: 44245 - RNA, 18 nt, Artificial Sequence
  Description of Artificial Sequence: Synthetic oligonucleotide
ccgggacaguggguggau

SEQ ID NO: 44246 - RNA, 18 nt, Artificial Sequence
  Description of Artificial Sequence: Synthetic oligonucleotide
ccaccccgggacaguggg

SEQ ID NO: 44247 - RNA, 18 nt, Artificial Sequence
  Description of Artificial Sequence: Synthetic oligonucleotide
cccagccaccccgggaca

SEQ ID NO: 44248 - RNA, 18 nt, Artificial Sequence
  Description of Artificial Sequence: Synthetic oligonucleotide
aagcucccagccaccccg

SEQ ID NO: 44249 - RNA, 18 nt, Artificial Sequence
  Description of Artificial Sequence: Synthetic oligonucleotide
uuaaaaagcucccagcca

SEQ ID NO: 44250 - RNA, 18 nt, Artificial Sequence
  Description of Artificial Sequence: Synthetic oligonucleotide
acccguuaaaaagcuccc

SEQ ID NO: 44251 - RNA, 18 nt, Artificial Sequence
  Description of Artificial Sequence: Synthetic oligonucleotide
ucucaacccguuaaaaag

SEQ ID NO: 44252 - RNA, 18 nt, Artificial Sequence
  Description of Artificial Sequence: Synthetic oligonucleotide
gcaacucucaacccguua

SEQ ID NO: 44253 - RNA, 18 nt, Artificial Sequence
  Description of Artificial Sequence: Synthetic oligonucleotide
aaaaagcaacucucaacc

SEQ ID NO: 44254 - RNA, 18 nt, Artificial Sequence
  Description of Artificial Sequence: Synthetic oligonucleotide
accuuaaaaagcaacucu

SEQ ID NO: 44255 - RNA, 18 nt, Artificial Sequence
  Description of Artificial Sequence: Synthetic oligonucleotide
ccacaaccuuaaaaagca

SEQ ID NO: 44256 - RNA, 18 nt, Artificial Sequence
  Description of Artificial Sequence: Synthetic oligonucleotide
cucacccacaaccuuaaa

SEQ ID NO: 44257 - RNA, 18 nt, Artificial Sequence
  Description of Artificial Sequence: Synthetic oligonucleotide
cucagcucacccacaacc

SEQ ID NO: 44258 - RNA, 18 nt, Artificial Sequence
  Description of Artificial Sequence: Synthetic oligonucleotide
cccaucucagcucaccca

SEQ ID NO: 44259 - RNA, 18 nt, Artificial Sequence
  Description of Artificial Sequence: Synthetic oligonucleotide
agucacccaucucagcuc

SEQ ID NO: 44260 - RNA, 18 nt, Artificial Sequence
  Description of Artificial Sequence: Synthetic oligonucleotide
gacacagucacccaucuc

SEQ ID NO: 44261 - RNA, 18 nt, Artificial Sequence
  Description of Artificial Sequence: Synthetic oligonucleotide
cugaagacacagucaccc

SEQ ID NO: 44262 - RNA, 18 nt, Artificial Sequence
  Description of Artificial Sequence: Synthetic oligonucleotide
gucuccugaagacacagu

SEQ ID NO: 44263 - RNA, 18 nt, Artificial Sequence
  Description of Artificial Sequence: Synthetic oligonucleotide
guagugucuccugaagac

SEQ ID NO: 44264 - RNA, 18 nt, Artificial Sequence
  Description of Artificial Sequence: Synthetic oligonucleotide
aaaugguagugucuccug

SEQ ID NO: 44265 - RNA, 18 nt, Artificial Sequence
  Description of Artificial Sequence: Synthetic oligonucleotide
aaaccaaaugguaguguc

SEQ ID NO: 44266 - RNA, 18 nt, Artificial Sequence
  Description of Artificial Sequence: Synthetic oligonucleotide
aaaucaaaccaaauggua

SEQ ID NO: 44267 - RNA, 18 nt, Artificial Sequence
  Description of Artificial Sequence: Synthetic oligonucleotide
cucuguuuauugaugaca

SEQ ID NO: 44268 - RNA, 18 nt, Artificial Sequence
  Description of Artificial Sequence: Synthetic oligonucleotide
aagaacucuguuuauuga

SEQ ID NO: 44269 - RNA, 18 nt, Artificial Sequence
  Description of Artificial Sequence: Synthetic oligonucleotide
uugcgaagaacucuguuu

SEQ ID NO: 44270 - RNA, 18 nt, Artificial Sequence
  Description of Artificial Sequence: Synthetic oligonucleotide
ccagguugcgaagaacuc

SEQ ID NO: 44271 - RNA, 18 nt, Artificial Sequence
  Description of Artificial Sequence: Synthetic oligonucleotide
gcuagccagguugcgaag

SEQ ID NO: 44272 - RNA, 18 nt, Artificial Sequence
  Description of Artificial Sequence: Synthetic oligonucleotide
uuuucgcuagccagguug

SEQ ID NO: 44273 - RNA, 18 nt, Artificial Sequence
  Description of Artificial Sequence: Synthetic oligonucleotide
guugcuuuucgcuagcca

SEQ ID NO: 44274 - RNA, 18 nt, Artificial Sequence
  Description of Artificial Sequence: Synthetic oligonucleotide
caucuguugcuuuucgcu

SEQ ID NO: 44275 - RNA, 18 nt, Artificial Sequence
  Description of Artificial Sequence: Synthetic oligonucleotide
gcgcccaucuguugcuuu

SEQ ID NO: 44276 - RNA, 18 nt, Artificial Sequence
  Description of Artificial Sequence: Synthetic oligonucleotide
cgucugcgcccaucuguu

SEQ ID NO: 44277 - RNA, 18 nt, Artificial Sequence
  Description of Artificial Sequence: Synthetic oligonucleotide
caugccgucugcgcccau

SEQ ID NO: 44278 - RNA, 18 nt, Artificial Sequence
  Description of Artificial Sequence: Synthetic oligonucleotide
ucauacaugccgucugcg

SEQ ID NO: 44279 - RNA, 18 nt, Artificial Sequence
  Description of Artificial Sequence: Synthetic oligonucleotide
guuuaucauacaugccgu

SEQ ID NO: 44280 - RNA, 18 nt, Artificial Sequence
  Description of Artificial Sequence: Synthetic oligonucleotide
ccuuaguuuaucauacau

SEQ ID NO: 44281 - RNA, 18 nt, Artificial Sequence
  Description of Artificial Sequence: Synthetic oligonucleotide
aacauccuuaguuuauca

SEQ ID NO: 44282 - RNA, 18 nt, Artificial Sequence
  Description of Artificial Sequence: Synthetic oligonucleotide
cguucaacauccuuaguu

SEQ ID NO: 44283 - RNA, 18 nt, Artificial Sequence
  Description of Artificial Sequence: Synthetic oligonucleotide
cugcccguucaacauccu

SEQ ID NO: 44284 - RNA, 18 nt, Artificial Sequence
  Description of Artificial Sequence: Synthetic oligonucleotide
ccggucugcccguucaac

SEQ ID NO: 44285 - RNA, 18 nt, Artificial Sequence
  Description of Artificial Sequence: Synthetic oligonucleotide
agcuuccggucugcccgu

SEQ ID NO: 44286 - RNA, 18 nt, Artificial Sequence
  Description of Artificial Sequence: Synthetic oligonucleotide
gccccagcuuccggucug

SEQ ID NO: 44287 - RNA, 18 nt, Artificial Sequence
  Description of Artificial Sequence: Synthetic oligonucleotide
cgggugccccagcuuccg

SEQ ID NO: 44288 - RNA, 18 nt, Artificial Sequence
  Description of Artificial Sequence: Synthetic oligonucleotide
cagggcgggugccccagc

SEQ ID NO: 44289 - RNA, 18 nt, Artificial Sequence
  Description of Artificial Sequence: Synthetic oligonucleotide
ccaaccagggcgggugcc

SEQ ID NO: 44290 - RNA, 18 nt, Artificial Sequence
  Description of Artificial Sequence: Synthetic oligonucleotide
ggauaccaaccagggcgg

SEQ ID NO: 44291 - RNA, 18 nt, Artificial Sequence
  Description of Artificial Sequence: Synthetic oligonucleotide
uccccggauaccaaccag

SEQ ID NO: 44292 - RNA, 18 nt, Artificial Sequence
  Description of Artificial Sequence: Synthetic oligonucleotide
cgaaguccccggauacca

SEQ ID NO: 44293 - RNA, 18 nt, Artificial Sequence
  Description of Artificial Sequence: Synthetic oligonucleotide
ggcaccgaaguccccgga

SEQ ID NO: 44294 - RNA, 18 nt, Artificial Sequence
  Description of Artificial Sequence: Synthetic oligonucleotide
gcccuggcaccgaagucc

SEQ ID NO: 44295 - RNA, 18 nt, Artificial Sequence
  Description of Artificial Sequence: Synthetic oligonucleotide
agguugcccuggcaccga

SEQ ID NO: 44296 - RNA, 18 nt, Artificial Sequence
  Description of Artificial Sequence: Synthetic oligonucleotide
ugcguagguugcccuggc

SEQ ID NO: 44297 - RNA, 18 nt, Artificial Sequence
  Description of Artificial Sequence: Synthetic oligonucleotide
ggaaggcuaauugaaaag

SEQ ID NO: 44298 - RNA, 18 nt, Artificial Sequence
  Description of Artificial Sequence: Synthetic oligonucleotide
ugcauggaaggcuaauug

SEQ ID NO: 44299 - RNA, 18 nt, Artificial Sequence
  Description of Artificial Sequence: Synthetic oligonucleotide
gaucaugcauggaaggcu

SEQ ID NO: 44300 - RNA, 18 nt, Artificial Sequence
  Description of Artificial Sequence: Synthetic oligonucleotide
cuccggaucaugcaugga

SEQ ID NO: 44301 - RNA, 18 nt, Artificial Sequence
  Description of Artificial Sequence: Synthetic oligonucleotide
agucgcuccggaucaugc

SEQ ID NO: 44302 - RNA, 18 nt, Artificial Sequence
  Description of Artificial Sequence: Synthetic oligonucleotide
gcggaagucgcuccggau

SEQ ID NO: 44303 - RNA, 18 nt, Artificial Sequence
  Description of Artificial Sequence: Synthetic oligonucleotide
aauaggcggaagucgcuc

SEQ ID NO: 44304 - RNA, 18 nt, Artificial Sequence
  Description of Artificial Sequence: Synthetic oligonucleotide
cuggaaauaggcggaagu

SEQ ID NO: 44305 - RNA, 18 nt, Artificial Sequence
  Description of Artificial Sequence: Synthetic oligonucleotide
aauuucuggaaauaggcg

SEQ ID NO: 44306 - RNA, 18 nt, Artificial Sequence
  Description of Artificial Sequence: Synthetic oligonucleotide
agcuuaauuucuggaaau

SEQ ID NO: 44307 - RNA, 18 nt, Artificial Sequence
  Description of Artificial Sequence: Synthetic oligonucleotide
guuugagcuuaauuucug

SEQ ID NO: 44308 - RNA, 18 nt, Artificial Sequence
  Description of Artificial Sequence: Synthetic oligonucleotide
gucaaguuugagcuuaau

SEQ ID NO: 44309 - RNA, 18 nt, Artificial Sequence
  Description of Artificial Sequence: Synthetic oligonucleotide
ugcacgucaaguuugagc

SEQ ID NO: 44310 - RNA, 18 nt, Artificial Sequence
  Description of Artificial Sequence: Synthetic oligonucleotide
cuagcugcacgucaaguu

SEQ ID NO: 44311 - RNA, 18 nt, Artificial Sequence
  Description of Artificial Sequence: Synthetic oligonucleotide
uaaaacuagcugcacguc

SEQ ID NO: 44312 - RNA, 18 nt, Artificial Sequence
  Description of Artificial Sequence: Synthetic oligonucleotide
uaaaauaaaacuagcugc

SEQ ID NO: 44313 - RNA, 18 nt, Artificial Sequence
  Description of Artificial Sequence: Synthetic oligonucleotide
gucuuuaaaauaaaacua

SEQ ID NO: 44314 - RNA, 18 nt, Artificial Sequence
  Description of Artificial Sequence: Synthetic oligonucleotide
cauuugucuuuaaaauaa

SEQ ID NO: 44315 - RNA, 18 nt, Artificial Sequence
  Description of Artificial Sequence: Synthetic oligonucleotide
ucugacauuugucuuuaa

SEQ ID NO: 44316 - RNA, 18 nt, Artificial Sequence
  Description of Artificial Sequence: Synthetic oligonucleotide
gccucucugacauuuguc

SEQ ID NO: 44317 - RNA, 18 nt, Artificial Sequence
  Description of Artificial Sequence: Synthetic oligonucleotide
gaugagccucucugacau

SEQ ID NO: 44318 - RNA, 18 nt, Artificial Sequence
  Description of Artificial Sequence: Synthetic oligonucleotide
aauaugaugagccucucu

SEQ ID NO: 44319 - RNA, 18 nt, Artificial Sequence
  Description of Artificial Sequence: Synthetic oligonucleotide
gggaaaauaugaugagcc

SEQ ID NO: 44320 - RNA, 18 nt, Artificial Sequence
  Description of Artificial Sequence: Synthetic oligonucleotide
uccaaauauagaagaggg

SEQ ID NO: 44321 - RNA, 18 nt, Artificial Sequence
  Description of Artificial Sequence: Synthetic oligonucleotide
gcuccaaauauagaagag

SEQ ID NO: 44322 - RNA, 18 nt, Artificial Sequence
  Description of Artificial Sequence: Synthetic oligonucleotide
aauaagcuccaaauauag

SEQ ID NO: 44323 - RNA, 18 nt, Artificial Sequence
  Description of Artificial Sequence: Synthetic oligonucleotide
caauaaauaagcuccaaa

SEQ ID NO: 44324 - RNA, 18 nt, Artificial Sequence
  Description of Artificial Sequence: Synthetic oligonucleotide
cuuagcaauaaauaagcu

SEQ ID NO: 44325 - RNA, 18 nt, Artificial Sequence
  Description of Artificial Sequence: Synthetic oligonucleotide
agcuucuuagcaauaaau

SEQ ID NO: 44326 - RNA, 18 nt, Artificial Sequence
  Description of Artificial Sequence: Synthetic oligonucleotide
gccugagcuucuuagcaa

SEQ ID NO: 44327 - RNA, 18 nt, Artificial Sequence
  Description of Artificial Sequence: Synthetic oligonucleotide
caggagccugagcuucuu

SEQ ID NO: 44328 - RNA, 18 nt, Artificial Sequence
  Description of Artificial Sequence: Synthetic oligonucleotide
gacgccaggagccugagc

SEQ ID NO: 44329 - RNA, 18 nt, Artificial Sequence
  Description of Artificial Sequence: Synthetic oligonucleotide
aaauugacgccaggagcc

SEQ ID NO: 44330 - RNA, 18 nt, Artificial Sequence
  Description of Artificial Sequence: Synthetic oligonucleotide
cugauaaauugacgccag

SEQ ID NO: 44331 - RNA, 18 nt, Artificial Sequence
  Description of Artificial Sequence: Synthetic oligonucleotide
gccuacugauaaauugac

SEQ ID NO: 44332 - RNA, 18 nt, Artificial Sequence
  Description of Artificial Sequence: Synthetic oligonucleotide
uuggagccuacugauaaa

SEQ ID NO: 44333 - RNA, 18 nt, Artificial Sequence
  Description of Artificial Sequence: Synthetic oligonucleotide
ucuccuuggagccuacug

SEQ ID NO: 44334 - RNA, 18 nt, Artificial Sequence
  Description of Artificial Sequence: Synthetic oligonucleotide
ucucuucuccuuggagcc

SEQ ID NO: 44335 - RNA, 18 nt, Artificial Sequence
  Description of Artificial Sequence: Synthetic oligonucleotide
ucuccucucuucuccuug

SEQ ID NO: 44336 - RNA, 18 nt, Artificial Sequence
  Description of Artificial Sequence: Synthetic oligonucleotide
ucuccucuccucucuucu

SEQ ID NO: 44337 - RNA, 18 nt, Artificial Sequence
  Description of Artificial Sequence: Synthetic oligonucleotide
ucuccucuccucuccucu

SEQ ID NO: 44338 - RNA, 18 nt, Artificial Sequence
  Description of Artificial Sequence: Synthetic oligonucleotide
ucagcucuccucuccucu

SEQ ID NO: 44339 - RNA, 18 nt, Artificial Sequence
  Description of Artificial Sequence: Synthetic oligonucleotide
ccuguucagcucuccucu

SEQ ID NO: 44340 - RNA, 18 nt, Artificial Sequence
  Description of Artificial Sequence: Synthetic oligonucleotide
ggcucccuguucagcucu

SEQ ID NO: 44341 - RNA, 18 nt, Artificial Sequence
  Description of Artificial Sequence: Synthetic oligonucleotide
gacguggcucccuguuca

SEQ ID NO: 44342 - RNA, 18 nt, Artificial Sequence
  Description of Artificial Sequence: Synthetic oligonucleotide
gaaaagacguggcucccu

SEQ ID NO: 44343 - RNA, 18 nt, Artificial Sequence
  Description of Artificial Sequence: Synthetic oligonucleotide
cccaggaaaagacguggc

SEQ ID NO: 44344 - RNA, 18 nt, Artificial Sequence
  Description of Artificial Sequence: Synthetic oligonucleotide
gcccucccaggaaaagac

SEQ ID NO: 44345 - RNA, 18 nt, Artificial Sequence
  Description of Artificial Sequence: Synthetic oligonucleotide
uagcagcccucccaggaa

SEQ ID NO: 44346 - RNA, 18 nt, Artificial Sequence
  Description of Artificial Sequence: Synthetic oligonucleotide
uuagauagcagcccuccc

SEQ ID NO: 44347 - RNA, 18 nt, Artificial Sequence
  Description of Artificial Sequence: Synthetic oligonucleotide
ccgacuuagauagcagcc

SEQ ID NO: 44348 - RNA, 18 nt, Artificial Sequence
  Description of Artificial Sequence: Synthetic oligonucleotide
cagccccgacuuagauag

SEQ ID NO: 44349 - RNA, 18 nt, Artificial Sequence
  Description of Artificial Sequence: Synthetic oligonucleotide
ccacuuccuuaaaaaucu

SEQ ID NO: 44350 - RNA, 18 nt, Artificial Sequence
  Description of Artificial Sequence: Synthetic oligonucleotide
aauuuccacuuccuuaaa

SEQ ID NO: 44351 - RNA, 18 nt, Artificial Sequence
  Description of Artificial Sequence: Synthetic oligonucleotide
uugccaauuuccacuucc

SEQ ID NO: 44352 - RNA, 18 nt, Artificial Sequence
  Description of Artificial Sequence: Synthetic oligonucleotide
gccaauugccaauuucca

SEQ ID NO: 44353 - RNA, 18 nt, Artificial Sequence
  Description of Artificial Sequence: Synthetic oligonucleotide
acaaagccaauugccaau

SEQ ID NO: 44354 - RNA, 18 nt, Artificial Sequence
  Description of Artificial Sequence: Synthetic oligonucleotide
gacacacaaagccaauug

SEQ ID NO: 44355 - RNA, 18 nt, Artificial Sequence
  Description of Artificial Sequence: Synthetic oligonucleotide
ccacagacacacaaagcc

SEQ ID NO: 44356 - RNA, 18 nt, Artificial Sequence
  Description of Artificial Sequence: Synthetic oligonucleotide
aaaaaccacagacacaca

SEQ ID NO: 44357 - RNA, 18 nt, Artificial Sequence
  Description of Artificial Sequence: Synthetic oligonucleotide
uccccaaaaaccacagac

SEQ ID NO: 44358 - RNA, 18 nt, Artificial Sequence
  Description of Artificial Sequence: Synthetic oligonucleotide
cccccuccccaaaaacca

SEQ ID NO: 44359 - RNA, 18 nt, Artificial Sequence
  Description of Artificial Sequence: Synthetic oligonucleotide
guagucccccuccccaaa

SEQ ID NO: 44360 - RNA, 18 nt, Artificial Sequence
  Description of Artificial Sequence: Synthetic oligonucleotide
ucuuuguagucccccucc

SEQ ID NO: 44361 - RNA, 18 nt, Artificial Sequence
  Description of Artificial Sequence: Synthetic oligonucleotide
gccccucuuuguaguccc

SEQ ID NO: 44362 - RNA, 18 nt, Artificial Sequence
  Description of Artificial Sequence: Synthetic oligonucleotide
aguuagccccucuuugua

SEQ ID NO: 44363 - RNA, 18 nt, Artificial Sequence
  Description of Artificial Sequence: Synthetic oligonucleotide
gagggaguuagccccucu

SEQ ID NO: 44364 - RNA, 18 nt, Artificial Sequence
  Description of Artificial Sequence: Synthetic oligonucleotide
agggagagggaguuagcc

SEQ ID NO: 44365 - RNA, 18 nt, Artificial Sequence
  Description of Artificial Sequence: Synthetic oligonucleotide
agaauagggagagggagu

SEQ ID NO: 44366 - RNA, 18 nt, Artificial Sequence
  Description of Artificial Sequence: Synthetic oligonucleotide
cuuagagaauagggagag

SEQ ID NO: 44367 - RNA, 18 nt, Artificial Sequence
  Description of Artificial Sequence: Synthetic oligonucleotide
ccaaccuuagagaauagg

SEQ ID NO: 44368 - RNA, 18 nt, Artificial Sequence
  Description of Artificial Sequence: Synthetic oligonucleotide
gugguccaaccuuagaga

SEQ ID NO: 44369 - RNA, 18 nt, Artificial Sequence
  Description of Artificial Sequence: Synthetic oligonucleotide
ucccugugguccaaccuu

SEQ ID NO: 44370 - RNA, 18 nt, Artificial Sequence
  Description of Artificial Sequence: Synthetic oligonucleotide
ccucaucccuguggucca

SEQ ID NO: 44371 - RNA, 18 nt, Artificial Sequence
  Description of Artificial Sequence: Synthetic oligonucleotide
cacaaccucaucccugug

SEQ ID NO: 44372 - RNA, 18 nt, Artificial Sequence
  Description of Artificial Sequence: Synthetic oligonucleotide
uaucucacaaccucaucc

SEQ ID NO: 44373 - RNA, 18 nt, Artificial Sequence
  Description of Artificial Sequence: Synthetic oligonucleotide
cuuuguaucucacaaccu

SEQ ID NO: 44374 - RNA, 18 nt, Artificial Sequence
  Description of Artificial Sequence: Synthetic oligonucleotide
uuuaucuuuguaucucac

SEQ ID NO: 44375 - RNA, 18 nt, Artificial Sequence
  Description of Artificial Sequence: Synthetic oligonucleotide
ccuccuuuaucuuuguau

SEQ ID NO: 44376 - RNA, 18 nt, Artificial Sequence
  Description of Artificial Sequence: Synthetic oligonucleotide
ccaucccuccuuuaucuu

SEQ ID NO: 44377 - RNA, 18 nt, Artificial Sequence
  Description of Artificial Sequence: Synthetic oligonucleotide
guuccccaucccuccuuu

SEQ ID NO: 44378 - RNA, 18 nt, Artificial Sequence
  Description of Artificial Sequence: Synthetic oligonucleotide
auaguguuccccaucccu

SEQ ID NO: 44379 - RNA, 18 nt, Artificial Sequence
  Description of Artificial Sequence: Synthetic oligonucleotide
acaucauaguguucccca

SEQ ID NO: 44380 - RNA, 18 nt, Artificial Sequence
  Description of Artificial Sequence: Synthetic oligonucleotide
auaccacaucauaguguu

SEQ ID NO: 44381 - RNA, 18 nt, Artificial Sequence
  Description of Artificial Sequence: Synthetic oligonucleotide
gaaaaauaccacaucaua

SEQ ID NO: 44382 - RNA, 18 nt, Artificial Sequence
  Description of Artificial Sequence: Synthetic oligonucleotide
gaaaagaaaaauaccaca

SEQ ID NO: 44383 - RNA, 18 nt, Artificial Sequence
  Description of Artificial Sequence: Synthetic oligonucleotide
aaacagaaaagaaaaaua

SEQ ID NO: 44384 - RNA, 18 nt, Artificial Sequence
  Description of Artificial Sequence: Synthetic oligonucleotide
agaaaaaacagaaaagaa

SEQ ID NO: 44385 - RNA, 18 nt, Artificial Sequence
  Description of Artificial Sequence: Synthetic oligonucleotide
caaaaagaaaaaacagaa

SEQ ID NO: 44386 - RNA, 18 nt, Artificial Sequence
  Description of Artificial Sequence: Synthetic oligonucleotide
auuaucaaaaagaaaaaa

SEQ ID NO: 44387 - RNA, 18 nt, Artificial Sequence
  Description of Artificial Sequence: Synthetic oligonucleotide
uagauauuaucaaaaaga

SEQ ID NO: 44388 - RNA, 18 nt, Artificial Sequence
  Description of Artificial Sequence: Synthetic oligonucleotide
aaggauagauauuaucaa

SEQ ID NO: 44389 - RNA, 18 nt, Artificial Sequence
  Description of Artificial Sequence: Synthetic oligonucleotide
uagccaaggauagauauu

SEQ ID NO: 44390 - RNA, 18 nt, Artificial Sequence
  Description of Artificial Sequence: Synthetic oligonucleotide
ccccuuagccaaggauag

SEQ ID NO: 44391 - RNA, 18 nt, Artificial Sequence
  Description of Artificial Sequence: Synthetic oligonucleotide
gcccuccccuuagccaag

SEQ ID NO: 44392 - RNA, 18 nt, Artificial Sequence
  Description of Artificial Sequence: Synthetic oligonucleotide
acuccgcccuccccuuag

SEQ ID NO: 44393 - RNA, 18 nt, Artificial Sequence
  Description of Artificial Sequence: Synthetic oligonucleotide
gcugaacuccgcccuccc

SEQ ID NO: 44394 - RNA, 18 nt, Artificial Sequence
  Description of Artificial Sequence: Synthetic oligonucleotide
ccgccgcugaacuccgcc

SEQ ID NO: 44395 - RNA, 18 nt, Artificial Sequence
  Description of Artificial Sequence: Synthetic oligonucleotide
uauuuccgccgcugaacu

SEQ ID NO: 44396 - RNA, 18 nt, Artificial Sequence
  Description of Artificial Sequence: Synthetic oligonucleotide
cgcuuuauuuccgccgcu

SEQ ID NO: 44397 - RNA, 18 nt, Artificial Sequence
  Description of Artificial Sequence: Synthetic oligonucleotide
cugcucgcuuuauuuccg

SEQ ID NO: 44398 - RNA, 18 nt, Artificial Sequence
  Description of Artificial Sequence: Synthetic oligonucleotide
agccacugcucgcuuuau

SEQ ID NO: 44399 - RNA, 18 nt, Artificial Sequence
  Description of Artificial Sequence: Synthetic oligonucleotide
gcaccagccacugcucgc

SEQ ID NO: 44400 - RNA, 18 nt, Artificial Sequence
  Description of Artificial Sequence: Synthetic oligonucleotide
gguucgcaccagccacug

SEQ ID NO: 44401 - RNA, 18 nt, Artificial Sequence
  Description of Artificial Sequence: Synthetic oligonucleotide
gagucgguucgcaccagc

SEQ ID NO: 44402 - RNA, 18 nt, Artificial Sequence
  Description of Artificial Sequence: Synthetic oligonucleotide
gccgggagucgguucgca

SEQ ID NO: 44403 - RNA, 18 nt, Artificial Sequence
  Description of Artificial Sequence: Synthetic oligonucleotide
uuagagccgggagucggu

SEQ ID NO: 44404 - RNA, 18 nt, Artificial Sequence
  Description of Artificial Sequence: Synthetic oligonucleotide
aaggcuuagagccgggag

SEQ ID NO: 44405 - RNA, 18 nt, Artificial Sequence
  Description of Artificial Sequence: Synthetic oligonucleotide
caaguaaggcuuagagcc

SEQ ID NO: 44406 - RNA, 18 nt, Artificial Sequence
  Description of Artificial Sequence: Synthetic oligonucleotide
caccgcaaguaaggcuua

SEQ ID NO: 44407 - RNA, 18 nt, Artificial Sequence
  Description of Artificial Sequence: Synthetic oligonucleotide
ccggccaccgcaaguaag

SEQ ID NO: 44408 - RNA, 18 nt, Artificial Sequence
  Description of Artificial Sequence: Synthetic oligonucleotide
caaguccggccaccgcaa

SEQ ID NO: 44409 - RNA, 18 nt, Artificial Sequence
  Description of Artificial Sequence: Synthetic oligonucleotide
acagacaaguccggccac

SEQ ID NO: 44410 - RNA, 18 nt, Artificial Sequence
  Description of Artificial Sequence: Synthetic oligonucleotide
cagccacagacaaguccg

SEQ ID NO: 44411 - RNA, 18 nt, Artificial Sequence
  Description of Artificial Sequence: Synthetic oligonucleotide
ggcuucagccacagacaa

SEQ ID NO: 44412 - RNA, 18 nt, Artificial Sequence
  Description of Artificial Sequence: Synthetic oligonucleotide
ggcucggcuucagccaca

SEQ ID NO: 44413 - RNA, 18 nt, Artificial Sequence
  Description of Artificial Sequence: Synthetic oligonucleotide
gcccgggcucggcuucag

SEQ ID NO: 44414 - RNA, 18 nt, Artificial Sequence
  Description of Artificial Sequence: Synthetic oligonucleotide
ucagagcccgggcucggc

SEQ ID NO: 44415 - RNA, 18 nt, Artificial Sequence
  Description of Artificial Sequence: Synthetic oligonucleotide
gagagucagagcccgggc

SEQ ID NO: 44416 - RNA, 18 nt, Artificial Sequence
  Description of Artificial Sequence: Synthetic oligonucleotide
gacgugagagucagagcc

SEQ ID NO: 44417 - RNA, 18 nt, Artificial Sequence
  Description of Artificial Sequence: Synthetic oligonucleotide
gugcagacgugagaguca

SEQ ID NO: 44418 - RNA, 18 nt, Artificial Sequence
  Description of Artificial Sequence: Synthetic oligonucleotide
cuccagugcagacgugag

SEQ ID NO: 44419 - RNA, 18 nt, Artificial Sequence
  Description of Artificial Sequence: Synthetic oligonucleotide
cgcaccuccagugcagac

SEQ ID NO: 44420 - RNA, 18 nt, Artificial Sequence
  Description of Artificial Sequence: Synthetic oligonucleotide
guuuccgcaccuccagug

SEQ ID NO: 44421 - RNA, 18 nt, Artificial Sequence
  Description of Artificial Sequence: Synthetic oligonucleotide
uccagguuuccgcaccuc

SEQ ID NO: 44422 - RNA, 18 nt, Artificial Sequence
  Description of Artificial Sequence: Synthetic oligonucleotide
cccaguccagguuuccgc

SEQ ID NO: 44423 - RNA, 18 nt, Artificial Sequence
  Description of Artificial Sequence: Synthetic oligonucleotide
ugaaccccaguccagguu

SEQ ID NO: 44424 - RNA, 18 nt, Artificial Sequence
  Description of Artificial Sequence: Synthetic oligonucleotide
gcuggugaaccccagucc

SEQ ID NO: 44425 - RNA, 18 nt, Artificial Sequence
  Description of Artificial Sequence: Synthetic oligonucleotide
auguggcuggugaacccc

SEQ ID NO: 44426 - RNA, 18 nt, Artificial Sequence
  Description of Artificial Sequence: Synthetic oligonucleotide
ccaguauguggcugguga

SEQ ID NO: 44427 - RNA, 18 nt, Artificial Sequence
  Description of Artificial Sequence: Synthetic oligonucleotide
agcagccaguauguggcu

SEQ ID NO: 44428 - RNA, 18 nt, Artificial Sequence
  Description of Artificial Sequence: Synthetic oligonucleotide
accagagcagccaguaug

SEQ ID NO: 44429 - RNA, 18 nt, Artificial Sequence
  Description of Artificial Sequence: Synthetic oligonucleotide
gaacaaccagagcagcca

SEQ ID NO: 44430 - RNA, 18 nt, Artificial Sequence
  Description of Artificial Sequence: Synthetic oligonucleotide
ggagagaacaaccagagc

SEQ ID NO: 44431 - RNA, 18 nt, Artificial Sequence
  Description of Artificial Sequence: Synthetic oligonucleotide
gaagaggagagaacaacc

SEQ ID NO: 44432 - RNA, 18 nt, Artificial Sequence
  Description of Artificial Sequence: Synthetic oligonucleotide
agaaggaagaggagagaa

SEQ ID NO: 44433 - RNA, 18 nt, Artificial Sequence
  Description of Artificial Sequence: Synthetic oligonucleotide
auagaagaaggaagagga

SEQ ID NO: 44434 - RNA, 18 nt, Artificial Sequence
  Description of Artificial Sequence: Synthetic oligonucleotide
uuagaauagaagaaggaa

SEQ ID NO: 44435 - RNA, 18 nt, Artificial Sequence
  Description of Artificial Sequence: Synthetic oligonucleotide
uuugguuagaauagaaga

SEQ ID NO: 44436 - RNA, 18 nt, Artificial Sequence
  Description of Artificial Sequence: Synthetic oligonucleotide
uuuuguuugguuagaaua

SEQ ID NO: 44437 - RNA, 18 nt, Artificial Sequence
  Description of Artificial Sequence: Synthetic oligonucleotide
uuggguuuuguuugguua

SEQ ID NO: 44438 - RNA, 18 nt, Artificial Sequence
  Description of Artificial Sequence: Synthetic oligonucleotide
ucgaguuggguuuuguuu

SEQ ID NO: 44439 - RNA, 18 nt, Artificial Sequence
  Description of Artificial Sequence: Synthetic oligonucleotide
aagcaucgaguuggguuu

SEQ ID NO: 44440 - RNA, 18 nt, Artificial Sequence
  Description of Artificial Sequence: Synthetic oligonucleotide
ggcacaagcaucgaguug

SEQ ID NO: 44441 - RNA, 18 nt, Artificial Sequence
  Description of Artificial Sequence: Synthetic oligonucleotide
ggccuggcacaagcaucg

SEQ ID NO: 44442 - RNA, 18 nt, Artificial Sequence
  Description of Artificial Sequence: Synthetic oligonucleotide
gccaaggccuggcacaag

SEQ ID NO: 44443 - RNA, 18 nt, Artificial Sequence
  Description of Artificial Sequence: Synthetic oligonucleotide
aacuggccaaggccuggc

SEQ ID NO: 44444 - RNA, 18 nt, Artificial Sequence
  Description of Artificial Sequence: Synthetic oligonucleotide
guccaaacuggccaaggc

SEQ ID NO: 44445 - RNA, 18 nt, Artificial Sequence
  Description of Artificial Sequence: Synthetic oligonucleotide
ucaccguccaaacuggcc

SEQ ID NO: 44446 - RNA, 18 nt, Artificial Sequence
  Description of Artificial Sequence: Synthetic oligonucleotide
uuccaucaccguccaaac

SEQ ID NO: 44447 - RNA, 18 nt, Artificial Sequence
  Description of Artificial Sequence: Synthetic oligonucleotide
aauguuuccaucaccguc

SEQ ID NO: 44448 - RNA, 18 nt, Artificial Sequence
  Description of Artificial Sequence: Synthetic oligonucleotide
uggguucuacagauccca

SEQ ID NO: 44449 - RNA, 18 nt, Artificial Sequence
  Description of Artificial Sequence: Synthetic oligonucleotide
aaccauggguucuacaga

SEQ ID NO: 44450 - RNA, 18 nt, Artificial Sequence
  Description of Artificial Sequence: Synthetic oligonucleotide
ccgcaaaccauggguucu

SEQ ID NO: 44451 - RNA, 18 nt, Artificial Sequence
  Description of Artificial Sequence: Synthetic oligonucleotide
ugucaccgcaaaccaugg

SEQ ID NO: 44452 - RNA, 18 nt, Artificial Sequence
  Description of Artificial Sequence: Synthetic oligonucleotide
cugagugucaccgcaaac

SEQ ID NO: 44453 - RNA, 18 nt, Artificial Sequence
  Description of Artificial Sequence: Synthetic oligonucleotide
ccccucugagugucaccg

SEQ ID NO: 44454 - RNA, 18 nt, Artificial Sequence
  Description of Artificial Sequence: Synthetic oligonucleotide
aagauccccucugagugu

SEQ ID NO: 44455 - RNA, 18 nt, Artificial Sequence
  Description of Artificial Sequence: Synthetic oligonucleotide
ucccaaagauccccucug

SEQ ID NO: 44456 - RNA, 18 nt, Artificial Sequence
  Description of Artificial Sequence: Synthetic oligonucleotide
aaaucucccaaagauccc

SEQ ID NO: 44457 - RNA, 18 nt, Artificial Sequence
  Description of Artificial Sequence: Synthetic oligonucleotide
ucuauaaaucucccaaag

SEQ ID NO: 44458 - RNA, 18 nt, Artificial Sequence
  Description of Artificial Sequence: Synthetic oligonucleotide
ccggcucuauaaaucucc

SEQ ID NO: 44459 - RNA, 18 nt, Artificial Sequence
  Description of Artificial Sequence: Synthetic oligonucleotide
aagaaccggcucuauaaa

SEQ ID NO: 44460 - RNA, 18 nt, Artificial Sequence
  Description of Artificial Sequence: Synthetic oligonucleotide
gcgcuaagaaccggcucu

SEQ ID NO: 44461 - RNA, 18 nt, Artificial Sequence
  Description of Artificial Sequence: Synthetic oligonucleotide
acaaagcgcuaagaaccg

SEQ ID NO: 44462 - RNA, 18 nt, Artificial Sequence
  Description of Artificial Sequence: Synthetic oligonucleotide
aacccacaaagcgcuaag

SEQ ID NO: 44463 - RNA, 18 nt, Artificial Sequence
  Description of Artificial Sequence: Synthetic oligonucleotide
cucugaacccacaaagcg

SEQ ID NO: 44464 - RNA, 18 nt, Artificial Sequence
  Description of Artificial Sequence: Synthetic oligonucleotide
ccagccucugaacccaca

SEQ ID NO: 44465 - RNA, 18 nt, Artificial Sequence
  Description of Artificial Sequence: Synthetic oligonucleotide
ugcagccagccucugaac

SEQ ID NO: 44466 - RNA, 18 nt, Artificial Sequence
  Description of Artificial Sequence: Synthetic oligonucleotide
aacacugcagccagccuc

SEQ ID NO: 44467 - RNA, 18 nt, Artificial Sequence
  Description of Artificial Sequence: Synthetic oligonucleotide
ucauaaacacugcagcca

SEQ ID NO: 44468 - RNA, 18 nt, Artificial Sequence
  Description of Artificial Sequence: Synthetic oligonucleotide
ccucuucauaaacacugc

SEQ ID NO: 44469 - RNA, 18 nt, Artificial Sequence
  Description of Artificial Sequence: Synthetic oligonucleotide
cugccccucuucauaaac

SEQ ID NO: 44470 - RNA, 18 nt, Artificial Sequence
  Description of Artificial Sequence: Synthetic oligonucleotide
gcccacugccccucuuca

SEQ ID NO: 44471 - RNA, 18 nt, Artificial Sequence
  Description of Artificial Sequence: Synthetic oligonucleotide
ccccagcccacugccccu

SEQ ID NO: 44472 - RNA, 18 nt, Artificial Sequence
  Description of Artificial Sequence: Synthetic oligonucleotide
aguguccccagcccacug

SEQ ID NO: 44473 - RNA, 18 nt, Artificial Sequence
  Description of Artificial Sequence: Synthetic oligonucleotide
ccagcaguguccccagcc

SEQ ID NO: 44474 - RNA, 18 nt, Artificial Sequence
  Description of Artificial Sequence: Synthetic oligonucleotide
uaaccccagcaguguccc

SEQ ID NO: 44475 - RNA, 18 nt, Artificial Sequence
  Description of Artificial Sequence: Synthetic oligonucleotide
agccauaaccccagcagu

SEQ ID NO: 44476 - RNA, 18 nt, Artificial Sequence
  Description of Artificial Sequence: Synthetic oligonucleotide
acuacagccauaacccca

SEQ ID NO: 44477 - RNA, 18 nt, Artificial Sequence
  Description of Artificial Sequence: Synthetic oligonucleotide
accucacuacagccauaa

SEQ ID NO: 44478 - RNA, 18 nt, Artificial Sequence
  Description of Artificial Sequence: Synthetic oligonucleotide
cauggaccucacuacagc

SEQ ID NO: 44479 - RNA, 18 nt, Artificial Sequence
  Description of Artificial Sequence: Synthetic oligonucleotide
guacacauggaccucacu

SEQ ID NO: 44480 - RNA, 18 nt, Artificial Sequence
  Description of Artificial Sequence: Synthetic oligonucleotide
aacaaguacacauggacc

SEQ ID NO: 44481 - RNA, 18 nt, Artificial Sequence
  Description of Artificial Sequence: Synthetic oligonucleotide
caaggaacaaguacacau

SEQ ID NO: 44482 - RNA, 18 nt, Artificial Sequence
  Description of Artificial Sequence: Synthetic oligonucleotide
caugccaaggaacaagua

SEQ ID NO: 44483 - RNA, 18 nt, Artificial Sequence
  Description of Artificial Sequence: Synthetic oligonucleotide
agacacaugccaaggaac

SEQ ID NO: 44484 - RNA, 18 nt, Artificial Sequence
  Description of Artificial Sequence: Synthetic oligonucleotide
gagucagacacaugccaa

SEQ ID NO: 44485 - RNA, 18 nt, Artificial Sequence
  Description of Artificial Sequence: Synthetic oligonucleotide
acacagagucagacacau

SEQ ID NO: 44486 - RNA, 18 nt, Artificial Sequence
  Description of Artificial Sequence: Synthetic oligonucleotide
cagcaacacagagucaga

SEQ ID NO: 44487 - RNA, 18 nt, Artificial Sequence
  Description of Artificial Sequence: Synthetic oligonucleotide
ugcagcagcaacacagag

SEQ ID NO: 44488 - RNA, 18 nt, Artificial Sequence
  Description of Artificial Sequence: Synthetic oligonucleotide
uguacugcagcagcaaca

SEQ ID NO: 44489 - RNA, 18 nt, Artificial Sequence
  Description of Artificial Sequence: Synthetic oligonucleotide
cccacuguacugcagcag

SEQ ID NO: 44490 - RNA, 18 nt, Artificial Sequence
  Description of Artificial Sequence: Synthetic oligonucleotide
cccugcccacuguacugc

SEQ ID NO: 44491 - RNA, 18 nt, Artificial Sequence
  Description of Artificial Sequence: Synthetic oligonucleotide
cgugccccugcccacugu

SEQ ID NO: 44492 - RNA, 18 nt, Artificial Sequence
  Description of Artificial Sequence: Synthetic oligonucleotide
gcaaccgugccccugccc

SEQ ID NO: 44493 - RNA, 18 nt, Artificial Sequence
  Description of Artificial Sequence: Synthetic oligonucleotide
uccaagcaaccgugcccc

SEQ ID NO: 44494 - RNA, 18 nt, Artificial Sequence
  Description of Artificial Sequence: Synthetic oligonucleotide
cccaguccaagcaaccgu

SEQ ID NO: 44495 - RNA, 18 nt, Artificial Sequence
  Description of Artificial Sequence: Synthetic oligonucleotide
ggcagcccaguccaagca

SEQ ID NO: 44496 - RNA, 18 nt, Artificial Sequence
  Description of Artificial Sequence: Synthetic oligonucleotide
caucgggcagcccagucc

SEQ ID NO: 44497 - RNA, 18 nt, Artificial Sequence
  Description of Artificial Sequence: Synthetic oligonucleotide
ccagacaucgggcagccc

SEQ ID NO: 44498 - RNA, 18 nt, Artificial Sequence
  Description of Artificial Sequence: Synthetic oligonucleotide
ccaugccagacaucgggc

SEQ ID NO: 44499 - RNA, 18 nt, Artificial Sequence
  Description of Artificial Sequence: Synthetic oligonucleotide
accagccaugccagacau

SEQ ID NO: 44500 - RNA, 18 nt, Artificial Sequence
  Description of Artificial Sequence: Synthetic oligonucleotide
ggaccaccagccaugcca

SEQ ID NO: 44501 - RNA, 18 nt, Artificial Sequence
  Description of Artificial Sequence: Synthetic oligonucleotide
caacaggaccaccagcca

SEQ ID NO: 44502 - RNA, 18 nt, Artificial Sequence
  Description of Artificial Sequence: Synthetic oligonucleotide
aaggacaacaggaccacc

SEQ ID NO: 44503 - RNA, 18 nt, Artificial Sequence
  Description of Artificial Sequence: Synthetic oligonucleotide
aaauaaaggacaacagga

SEQ ID NO: 44504 - RNA, 18 nt, Artificial Sequence
  Description of Artificial Sequence: Synthetic oligonucleotide
cgaucaaauaaaggacaa

SEQ ID NO: 44505 - RNA, 18 nt, Artificial Sequence
  Description of Artificial Sequence: Synthetic oligonucleotide
gcuaucgaucaaauaaag

SEQ ID NO: 44506 - RNA, 18 nt, Artificial Sequence
  Description of Artificial Sequence: Synthetic oligonucleotide
ucccugcuaucgaucaaa

SEQ ID NO: 44507 - RNA, 18 nt, Artificial Sequence
  Description of Artificial Sequence: Synthetic oligonucleotide
ucaguucccugcuaucga

SEQ ID NO: 44508 - RNA, 18 nt, Artificial Sequence
  Description of Artificial Sequence: Synthetic oligonucleotide
ggcggucaguucccugcu

SEQ ID NO: 44509 - RNA, 18 nt, Artificial Sequence
  Description of Artificial Sequence: Synthetic oligonucleotide
accucggcggucaguucc

SEQ ID NO: 44510 - RNA, 18 nt, Artificial Sequence
  Description of Artificial Sequence: Synthetic oligonucleotide
ugccaaccucggcgguca

SEQ ID NO: 44511 - RNA, 18 nt, Artificial Sequence
  Description of Artificial Sequence: Synthetic oligonucleotide
accugugccaaccucggc

SEQ ID NO: 44512 - RNA, 18 nt, Artificial Sequence
  Description of Artificial Sequence: Synthetic oligonucleotide
ugccaaccugugccaacc

SEQ ID NO: 44513 - RNA, 18 nt, Artificial Sequence
  Description of Artificial Sequence: Synthetic oligonucleotide
cccccugccaaccugugc

SEQ ID NO: 44514 - RNA, 18 nt, Artificial Sequence
  Description of Artificial Sequence: Synthetic oligonucleotide
cucaucccccugccaacc

SEQ ID NO: 44515 - RNA, 18 nt, Artificial Sequence
  Description of Artificial Sequence: Synthetic oligonucleotide
gcauccucaucccccugc

SEQ ID NO: 44516 - RNA, 18 nt, Artificial Sequence
  Description of Artificial Sequence: Synthetic oligonucleotide
acaaugcauccucauccc

SEQ ID NO: 44517 - RNA, 18 nt, Artificial Sequence
  Description of Artificial Sequence: Synthetic oligonucleotide
caaccacaaugcauccuc

SEQ ID NO: 44518 - RNA, 18 nt, Artificial Sequence
  Description of Artificial Sequence: Synthetic oligonucleotide
ggagacaaccacaaugca

SEQ ID NO: 44519 - RNA, 18 nt, Artificial Sequence
  Description of Artificial Sequence: Synthetic oligonucleotide
gaggaggagacaaccaca

SEQ ID NO: 44520 - RNA, 18 nt, Artificial Sequence
  Description of Artificial Sequence: Synthetic oligonucleotide
gagaggaggaggagacaa

SEQ ID NO: 44521 - RNA, 18 nt, Artificial Sequence
  Description of Artificial Sequence: Synthetic oligonucleotide
agaaggagaggaggagga

SEQ ID NO: 44522 - RNA, 18 nt, Artificial Sequence
  Description of Artificial Sequence: Synthetic oligonucleotide
gaggaagaaggagaggag

SEQ ID NO: 44523 - RNA, 18 nt, Artificial Sequence
  Description of Artificial Sequence: Synthetic oligonucleotide
gggaagaggaagaaggag

SEQ ID NO: 44524 - RNA, 18 nt, Artificial Sequence
  Description of Artificial Sequence: Synthetic oligonucleotide
aaaggagaggaggaaggg

SEQ ID NO: 44525 - RNA, 18 nt, Artificial Sequence
  Description of Artificial Sequence: Synthetic oligonucleotide
agaaaggagaggaggaag

SEQ ID NO: 44526 - RNA, 18 nt, Artificial Sequence
  Description of Artificial Sequence: Synthetic oligonucleotide
agaacagaaaggagagga

SEQ ID NO: 44527 - RNA, 18 nt, Artificial Sequence
  Description of Artificial Sequence: Synthetic oligonucleotide
gaacaagaacagaaagga

SEQ ID NO: 44528 - RNA, 18 nt, Artificial Sequence
  Description of Artificial Sequence: Synthetic oligonucleotide
agggagaacaagaacaga

SEQ ID NO: 44529 - RNA, 18 nt, Artificial Sequence
  Description of Artificial Sequence: Synthetic oligonucleotide
agaugagggagaacaaga

SEQ ID NO: 44530 - RNA, 18 nt, Artificial Sequence
  Description of Artificial Sequence: Synthetic oligonucleotide
gaggaagaugagggagaa

SEQ ID NO: 44531 - RNA, 18 nt, Artificial Sequence
  Description of Artificial Sequence: Synthetic oligonucleotide
aggaagaggaagaugagg

SEQ ID NO: 44532 - RNA, 18 nt, Artificial Sequence
  Description of Artificial Sequence: Synthetic oligonucleotide
gaagaaggaagaggaaga

SEQ ID NO: 44533 - RNA, 18 nt, Artificial Sequence
  Description of Artificial Sequence: Synthetic oligonucleotide
agggagaagaaggaagag

SEQ ID NO: 44534 - RNA, 18 nt, Artificial Sequence
  Description of Artificial Sequence: Synthetic oligonucleotide
agaagagggagaagaagg

SEQ ID NO: 44535 - RNA, 18 nt, Artificial Sequence
  Description of Artificial Sequence: Synthetic oligonucleotide
gaggaagaagagggagaa

SEQ ID NO: 44536 - RNA, 18 nt, Artificial Sequence
  Description of Artificial Sequence: Synthetic oligonucleotide
gugaagaggaagaagagg

SEQ ID NO: 44537 - RNA, 18 nt, Artificial Sequence
  Description of Artificial Sequence: Synthetic oligonucleotide
gcagagugaagaggaaga

SEQ ID NO: 44538 - RNA, 18 nt, Artificial Sequence
  Description of Artificial Sequence: Synthetic oligonucleotide
agagagcagagugaagag

SEQ ID NO: 44539 - RNA, 18 nt, Artificial Sequence
  Description of Artificial Sequence: Synthetic oligonucleotide
agagaagagagcagagug

SEQ ID NO: 44540 - RNA, 18 nt, Artificial Sequence
  Description of Artificial Sequence: Synthetic oligonucleotide
aaagaagagaagagagca

SEQ ID NO: 44541 - RNA, 18 nt, Artificial Sequence
  Description of Artificial Sequence: Synthetic oligonucleotide
ugauucacuccgcuguga

SEQ ID NO: 44542 - RNA, 18 nt, Artificial Sequence
  Description of Artificial Sequence: Synthetic oligonucleotide
cgagcugauucacuccgc

SEQ ID NO: 44543 - RNA, 18 nt, Artificial Sequence
  Description of Artificial Sequence: Synthetic oligonucleotide
accaccgagcugauucac

SEQ ID NO: 44544 - RNA, 18 nt, Artificial Sequence
  Description of Artificial Sequence: Synthetic oligonucleotide
aagacaccaccgagcuga

SEQ ID NO: 44545 - RNA, 18 nt, Artificial Sequence
  Description of Artificial Sequence: Synthetic oligonucleotide
ugacaaagacaccaccga

SEQ ID NO: 44546 - RNA, 18 nt, Artificial Sequence
  Description of Artificial Sequence: Synthetic oligonucleotide
cccguugacaaagacacc

SEQ ID NO: 44547 - RNA, 18 nt, Artificial Sequence
  Description of Artificial Sequence: Synthetic oligonucleotide
ggccgcccguugacaaag

SEQ ID NO: 44548 - RNA, 18 nt, Artificial Sequence
  Description of Artificial Sequence: Synthetic oligonucleotide
gcaguggccgcccguuga

SEQ ID NO: 44549 - RNA, 18 nt, Artificial Sequence
  Description of Artificial Sequence: Synthetic oligonucleotide
guccggcaguggccgccc

SEQ ID NO: 44550 - RNA, 18 nt, Artificial Sequence
  Description of Artificial Sequence: Synthetic oligonucleotide
guggaguccggcaguggc

SEQ ID NO: 44551 - RNA, 18 nt, Artificial Sequence
  Description of Artificial Sequence: Synthetic oligonucleotide
gccggguggaguccggca

SEQ ID NO: 44552 - RNA, 18 nt, Artificial Sequence
  Description of Artificial Sequence: Synthetic oligonucleotide
cuucugccggguggaguc

SEQ ID NO: 44553 - RNA, 18 nt, Artificial Sequence
  Description of Artificial Sequence: Synthetic oligonucleotide
acaaucuucugccgggug

SEQ ID NO: 44554 - RNA, 18 nt, Artificial Sequence
  Description of Artificial Sequence: Synthetic oligonucleotide
gcucuacaaucuucugcc

SEQ ID NO: 44555 - RNA, 18 nt, Artificial Sequence
  Description of Artificial Sequence: Synthetic oligonucleotide
agcuagcucuacaaucuu

SEQ ID NO: 44556 - RNA, 18 nt, Artificial Sequence
  Description of Artificial Sequence: Synthetic oligonucleotide
cugugagcuagcucuaca

SEQ ID NO: 44557 - RNA, 18 nt, Artificial Sequence
  Description of Artificial Sequence: Synthetic oligonucleotide
ccccgcugugagcuagcu

SEQ ID NO: 44558 - RNA, 18 nt, Artificial Sequence
  Description of Artificial Sequence: Synthetic oligonucleotide
ccgggccccgcugugagc

SEQ ID NO: 44559 - RNA, 18 nt, Artificial Sequence
  Description of Artificial Sequence: Synthetic oligonucleotide
cacggccgggccccgcug

SEQ ID NO: 44560 - RNA, 18 nt, Artificial Sequence
  Description of Artificial Sequence: Synthetic oligonucleotide
ugucgcacggccgggccc

SEQ ID NO: 44561 - RNA, 18 nt, Artificial Sequence
  Description of Artificial Sequence: Synthetic oligonucleotide
ggaaaugucgcacggccg

SEQ ID NO: 44562 - RNA, 18 nt, Artificial Sequence
  Description of Artificial Sequence: Synthetic oligonucleotide
auucgggaaaugucgcac

SEQ ID NO: 44563 - RNA, 18 nt, Artificial Sequence
  Description of Artificial Sequence: Synthetic oligonucleotide
gcagaauucgggaaaugu

SEQ ID NO: 44564 - RNA, 18 nt, Artificial Sequence
  Description of Artificial Sequence: Synthetic oligonucleotide
cuuuugcaucugcauggg

SEQ ID NO: 44565 - RNA, 18 nt, Artificial Sequence
  Description of Artificial Sequence: Synthetic oligonucleotide
uuggacuuuugcaucugc

SEQ ID NO: 44566 - RNA, 18 nt, Artificial Sequence
  Description of Artificial Sequence: Synthetic oligonucleotide
agcacuuggacuuuugca

SEQ ID NO: 44567 - RNA, 18 nt, Artificial Sequence
  Description of Artificial Sequence: Synthetic oligonucleotide
uguccagcacuuggacuu

SEQ ID NO: 44568 - RNA, 18 nt, Artificial Sequence
  Description of Artificial Sequence: Synthetic oligonucleotide
uugauuguccagcacuug

SEQ ID NO: 44569 - RNA, 18 nt, Artificial Sequence
  Description of Artificial Sequence: Synthetic oligonucleotide
gcauuaaacaaugacaag

SEQ ID NO: 44570 - RNA, 18 nt, Artificial Sequence
  Description of Artificial Sequence: Synthetic oligonucleotide
aguaugcauuaaacaaug

SEQ ID NO: 44571 - RNA, 18 nt, Artificial Sequence
  Description of Artificial Sequence: Synthetic oligonucleotide
guuuaaguaugcauuaaa

SEQ ID NO: 44572 - RNA, 18 nt, Artificial Sequence
  Description of Artificial Sequence: Synthetic oligonucleotide
aaauuguuuaaguaugca

SEQ ID NO: 44573 - RNA, 18 nt, Artificial Sequence
  Description of Artificial Sequence: Synthetic oligonucleotide
aaauaaaauuguuuaagu

SEQ ID NO: 44574 - RNA, 18 nt, Artificial Sequence
  Description of Artificial Sequence: Synthetic oligonucleotide
gacaaaaauaaaauuguu

SEQ ID NO: 44575 - RNA, 18 nt, Artificial Sequence
  Description of Artificial Sequence: Synthetic oligonucleotide
uucaagacaaaaauaaaa

SEQ ID NO: 44576 - RNA, 18 nt, Artificial Sequence
  Description of Artificial Sequence: Synthetic oligonucleotide
auaauuucaagacaaaaa

SEQ ID NO: 44577 - RNA, 18 nt, Artificial Sequence
  Description of Artificial Sequence: Synthetic oligonucleotide
uauuaauaauuucaagac

SEQ ID NO: 44578 - RNA, 18 nt, Artificial Sequence
  Description of Artificial Sequence: Synthetic oligonucleotide
cacauuauuaauaauuuc

SEQ ID NO: 44579 - RNA, 18 nt, Artificial Sequence
  Description of Artificial Sequence: Synthetic oligonucleotide
aaaaccacauuauuaaua

SEQ ID NO: 44580 - RNA, 18 nt, Artificial Sequence
  Description of Artificial Sequence: Synthetic oligonucleotide
gacagaaaaccacauuau

SEQ ID NO: 44581 - RNA, 18 nt, Artificial Sequence
  Description of Artificial Sequence: Synthetic oligonucleotide
uguuuaaguaugcauuaa

SEQ ID NO: 44582 - RNA, 18 nt, Artificial Sequence
  Description of Artificial Sequence: Synthetic oligonucleotide
aaaauuguuuaaguaugc

SEQ ID NO: 44583 - RNA, 18 nt, Artificial Sequence
  Description of Artificial Sequence: Synthetic oligonucleotide
aaaauaaaauuguuuaag

SEQ ID NO: 44584 - RNA, 18 nt, Artificial Sequence
  Description of Artificial Sequence: Synthetic oligonucleotide
agacaaaaauaaaauugu

SEQ ID NO: 44585 - RNA, 18 nt, Artificial Sequence
  Description of Artificial Sequence: Synthetic oligonucleotide
uuucaagacaaaaauaaa

SEQ ID NO: 44586 - RNA, 18 nt, Artificial Sequence
  Description of Artificial Sequence: Synthetic oligonucleotide
aauaauuucaagacaaaa

SEQ ID NO: 44587 - RNA, 18 nt, Artificial Sequence
  Description of Artificial Sequence: Synthetic oligonucleotide
uuauuaauaauuucaaga

SEQ ID NO: 44588 - RNA, 18 nt, Artificial Sequence
  Description of Artificial Sequence: Synthetic oligonucleotide
ccacauuauuaauaauuu

SEQ ID NO: 44589 - RNA, 18 nt, Artificial Sequence
  Description of Artificial Sequence: Synthetic oligonucleotide
gaaaaccacauuauuaau

SEQ ID NO: 44590 - RNA, 18 nt, Artificial Sequence
  Description of Artificial Sequence: Synthetic oligonucleotide
ggacagaaaaccacauua

SEQ ID NO: 44591 - RNA, 18 nt, Artificial Sequence
  Description of Artificial Sequence: Synthetic oligonucleotide
ucacacauccguuggaca

SEQ ID NO: 44592 - RNA, 18 nt, Artificial Sequence
  Description of Artificial Sequence: Synthetic oligonucleotide
uuuacucacacauccguu

SEQ ID NO: 44593 - RNA, 18 nt, Artificial Sequence
  Description of Artificial Sequence: Synthetic oligonucleotide
agaauuuuacucacacau

SEQ ID NO: 44594 - RNA, 18 nt, Artificial Sequence
  Description of Artificial Sequence: Synthetic oligonucleotide
ugcccagaauuuuacuca

SEQ ID NO: 44595 - RNA, 18 nt, Artificial Sequence
  Description of Artificial Sequence: Synthetic oligonucleotide
auaccugcccagaauuuu

SEQ ID NO: 44596 - RNA, 18 nt, Artificial Sequence
  Description of Artificial Sequence: Synthetic oligonucleotide
ucguaauaccugcccaga

SEQ ID NO: 44597 - RNA, 18 nt, Artificial Sequence
  Description of Artificial Sequence: Synthetic oligonucleotide
cagucucguaauaccugc

SEQ ID NO: 44598 - RNA, 18 nt, Artificial Sequence
  Description of Artificial Sequence: Synthetic oligonucleotide
ggagccagucucguaaua

SEQ ID NO: 44599 - RNA, 18 nt, Artificial Sequence
  Description of Artificial Sequence: Synthetic oligonucleotide
cugauggagccagucucg

SEQ ID NO: 44600 - RNA, 18 nt, Artificial Sequence
  Description of Artificial Sequence: Synthetic oligonucleotide
ugggucugauggagccag

SEQ ID NO: 44601 - RNA, 18 nt, Artificial Sequence
  Description of Artificial Sequence: Synthetic oligonucleotide
ugcccugggucugaugga

SEQ ID NO: 44602 - RNA, 18 nt, Artificial Sequence
  Description of Artificial Sequence: Synthetic oligonucleotide
ccgauugcccugggucug

SEQ ID NO: 44603 - RNA, 18 nt, Artificial Sequence
  Description of Artificial Sequence: Synthetic oligonucleotide
uaccaccgauugcccugg

SEQ ID NO: 44604 - RNA, 18 nt, Artificial Sequence
  Description of Artificial Sequence: Synthetic oligonucleotide
uuuacuaccaccgauugc

SEQ ID NO: 44605 - RNA, 18 nt, Artificial Sequence
  Description of Artificial Sequence: Synthetic oligonucleotide
cucgguuuacuaccaccg

SEQ ID NO: 44606 - RNA, 18 nt, Artificial Sequence
  Description of Artificial Sequence: Synthetic oligonucleotide
cuacucucgguuuacuac

SEQ ID NO: 44607 - RNA, 18 nt, Artificial Sequence
  Description of Artificial Sequence: Synthetic oligonucleotide
agucgcuacucucgguuu

SEQ ID NO: 44608 - RNA, 18 nt, Artificial Sequence
  Description of Artificial Sequence: Synthetic oligonucleotide
ucuggagucgcuacucuc

SEQ ID NO: 44609 - RNA, 18 nt, Artificial Sequence
  Description of Artificial Sequence: Synthetic oligonucleotide
caacuucuggagucgcua

SEQ ID NO: 44610 - RNA, 18 nt, Artificial Sequence
  Description of Artificial Sequence: Synthetic oligonucleotide
gcuuacaacuucuggagu

SEQ ID NO: 44611 - RNA, 18 nt, Artificial Sequence
  Description of Artificial Sequence: Synthetic oligonucleotide
auuuugcuuacaacuucu

SEQ ID NO: 44612 - RNA, 18 nt, Artificial Sequence
  Description of Artificial Sequence: Synthetic oligonucleotide
gggcuauuuugcuuacaa

SEQ ID NO: 44613 - RNA, 18 nt, Artificial Sequence
  Description of Artificial Sequence: Synthetic oligonucleotide
auacugggcuauuuugcu

SEQ ID NO: 44614 - RNA, 18 nt, Artificial Sequence
  Description of Artificial Sequence: Synthetic oligonucleotide
cgcuuauacugggcuauu

SEQ ID NO: 44615 - RNA, 18 nt, Artificial Sequence
  Description of Artificial Sequence: Synthetic oligonucleotide
acucccgcuuauacuggg

SEQ ID NO: 44616 - RNA, 18 nt, Artificial Sequence
  Description of Artificial Sequence: Synthetic oligonucleotide
cgggcacucccgcuuaua

SEQ ID NO: 44617 - RNA, 18 nt, Artificial Sequence
  Description of Artificial Sequence: Synthetic oligonucleotide
auggacgggcacucccgc

SEQ ID NO: 44618 - RNA, 18 nt, Artificial Sequence
  Description of Artificial Sequence: Synthetic oligonucleotide
caaagauggacgggcacu

SEQ ID NO: 44619 - RNA, 18 nt, Artificial Sequence
  Description of Artificial Sequence: Synthetic oligonucleotide
ccaagcaaagauggacgg

SEQ ID NO: 44620 - RNA, 18 nt, Artificial Sequence
  Description of Artificial Sequence: Synthetic oligonucleotide
auuucccaagcaaagaug

SEQ ID NO: 44621 - RNA, 18 nt, Artificial Sequence
  Description of Artificial Sequence: Synthetic oligonucleotide
cucggauuucccaagcaa

SEQ ID NO: 44622 - RNA, 18 nt, Artificial Sequence
  Description of Artificial Sequence: Synthetic oligonucleotide
ucugucucggauuuccca

SEQ ID NO: 44623 - RNA, 18 nt, Artificial Sequence
  Description of Artificial Sequence: Synthetic oligonucleotide
aguaaucugucucggauu

SEQ ID NO: 44624 - RNA, 18 nt, Artificial Sequence
  Description of Artificial Sequence: Synthetic oligonucleotide
cggacaguaaucugucuc

SEQ ID NO: 44625 - RNA, 18 nt, Artificial Sequence
  Description of Artificial Sequence: Synthetic oligonucleotide
ccccucggacaguaaucu

SEQ ID NO: 44626 - RNA, 18 nt, Artificial Sequence
  Description of Artificial Sequence: Synthetic oligonucleotide
cagacccccucggacagu

SEQ ID NO: 44627 - RNA, 18 nt, Artificial Sequence
  Description of Artificial Sequence: Synthetic oligonucleotide
ugguacagacccccucgg

SEQ ID NO: 44628 - RNA, 18 nt, Artificial Sequence
  Description of Artificial Sequence: Synthetic oligonucleotide
aucguugguacagacccc

SEQ ID NO: 44629 - RNA, 18 nt, Artificial Sequence
  Description of Artificial Sequence: Synthetic oligonucleotide
auguuaucguugguacag

SEQ ID NO: 44630 - RNA, 18 nt, Artificial Sequence
  Description of Artificial Sequence: Synthetic oligonucleotide
uugguauguuaucguugg

SEQ ID NO: 44631 - RNA, 18 nt, Artificial Sequence
  Description of Artificial Sequence: Synthetic oligonucleotide
cacacauccguuggacac

SEQ ID NO: 44632 - RNA, 18 nt, Artificial Sequence
  Description of Artificial Sequence: Synthetic oligonucleotide
uuacucacacauccguug

SEQ ID NO: 44633 - RNA, 18 nt, Artificial Sequence
  Description of Artificial Sequence: Synthetic oligonucleotide
gaauuuuacucacacauc

SEQ ID NO: 44634 - RNA, 18 nt, Artificial Sequence
  Description of Artificial Sequence: Synthetic oligonucleotide
gcccagaauuuuacucac

SEQ ID NO: 44635 - RNA, 18 nt, Artificial Sequence
  Description of Artificial Sequence: Synthetic oligonucleotide
uaccugcccagaauuuua

SEQ ID NO: 44636 - RNA, 18 nt, Artificial Sequence
  Description of Artificial Sequence: Synthetic oligonucleotide
cguaauaccugcccagaa

SEQ ID NO: 44637 - RNA, 18 nt, Artificial Sequence
  Description of Artificial Sequence: Synthetic oligonucleotide
agucucguaauaccugcc

SEQ ID NO: 44638 - RNA, 18 nt, Artificial Sequence
  Description of Artificial Sequence: Synthetic oligonucleotide
gagccagucucguaauac

SEQ ID NO: 44639 - RNA, 18 nt, Artificial Sequence
  Description of Artificial Sequence: Synthetic oligonucleotide
ugauggagccagucucgu

SEQ ID NO: 44640 - RNA, 18 nt, Artificial Sequence
  Description of Artificial Sequence: Synthetic oligonucleotide
gggucugauggagccagu

SEQ ID NO: 44641 - RNA, 18 nt, Artificial Sequence
  Description of Artificial Sequence: Synthetic oligonucleotide
gcccugggucugauggag

SEQ ID NO: 44642 - RNA, 18 nt, Artificial Sequence
  Description of Artificial Sequence: Synthetic oligonucleotide
cgauugcccugggucuga

SEQ ID NO: 44643 - RNA, 18 nt, Artificial Sequence
  Description of Artificial Sequence: Synthetic oligonucleotide
accaccgauugcccuggg

SEQ ID NO: 44644 - RNA, 18 nt, Artificial Sequence
  Description of Artificial Sequence: Synthetic oligonucleotide
uuacuaccaccgauugcc

SEQ ID NO: 44645 - RNA, 18 nt, Artificial Sequence
  Description of Artificial Sequence: Synthetic oligonucleotide
ucgguuuacuaccaccga

SEQ ID NO: 44646 - RNA, 18 nt, Artificial Sequence
  Description of Artificial Sequence: Synthetic oligonucleotide
uacucucgguuuacuacc

SEQ ID NO: 44647 - RNA, 18 nt, Artificial Sequence
  Description of Artificial Sequence: Synthetic oligonucleotide
gucgcuacucucgguuua

SEQ ID NO: 44648 - RNA, 18 nt, Artificial Sequence
  Description of Artificial Sequence: Synthetic oligonucleotide
cuggagucgcuacucucg

SEQ ID NO: 44649 - RNA, 18 nt, Artificial Sequence
  Description of Artificial Sequence: Synthetic oligonucleotide
aacuucuggagucgcuac

SEQ ID NO: 44650 - RNA, 18 nt, Artificial Sequence
  Description of Artificial Sequence: Synthetic oligonucleotide
cuuacaacuucuggaguc

SEQ ID NO: 44651 - RNA, 18 nt, Artificial Sequence
  Description of Artificial Sequence: Synthetic oligonucleotide
uuuugcuuacaacuucug

SEQ ID NO: 44652 - RNA, 18 nt, Artificial Sequence
  Description of Artificial Sequence: Synthetic oligonucleotide
ggcuauuuugcuuacaac

SEQ ID NO: 44653 - RNA, 18 nt, Artificial Sequence
  Description of Artificial Sequence: Synthetic oligonucleotide
uacugggcuauuuugcuu

SEQ ID NO: 44654 - RNA, 18 nt, Artificial Sequence
  Description of Artificial Sequence: Synthetic oligonucleotide
gcuuauacugggcuauuu

SEQ ID NO: 44655 - RNA, 18 nt, Artificial Sequence
  Description of Artificial Sequence: Synthetic oligonucleotide
cucccgcuuauacugggc

SEQ ID NO: 44656 - RNA, 18 nt, Artificial Sequence
  Description of Artificial Sequence: Synthetic oligonucleotide
gggcacucccgcuuauac

SEQ ID NO: 44657 - RNA, 18 nt, Artificial Sequence
  Description of Artificial Sequence: Synthetic oligonucleotide
uggacgggcacucccgcu

SEQ ID NO: 44658 - RNA, 18 nt, Artificial Sequence
  Description of Artificial Sequence: Synthetic oligonucleotide
aaagauggacgggcacuc

SEQ ID NO: 44659 - RNA, 18 nt, Artificial Sequence
  Description of Artificial Sequence: Synthetic oligonucleotide
caagcaaagauggacggg

SEQ ID NO: 44660 - RNA, 18 nt, Artificial Sequence
  Description of Artificial Sequence: Synthetic oligonucleotide
uuucccaagcaaagaugg

SEQ ID NO: 44661 - RNA, 18 nt, Artificial Sequence
  Description of Artificial Sequence: Synthetic oligonucleotide
ucggauuucccaagcaaa

SEQ ID NO: 44662 - RNA, 18 nt, Artificial Sequence
  Description of Artificial Sequence: Synthetic oligonucleotide
cugucucggauuucccaa

SEQ ID NO: 44663 - RNA, 18 nt, Artificial Sequence
  Description of Artificial Sequence: Synthetic oligonucleotide
guaaucugucucggauuu

SEQ ID NO: 44664 - RNA, 18 nt, Artificial Sequence
  Description of Artificial Sequence: Synthetic oligonucleotide
ggacaguaaucugucucg

SEQ ID NO: 44665 - RNA, 18 nt, Artificial Sequence
  Description of Artificial Sequence: Synthetic oligonucleotide
cccucggacaguaaucug

SEQ ID NO: 44666 - RNA, 18 nt, Artificial Sequence
  Description of Artificial Sequence: Synthetic oligonucleotide
agacccccucggacagua

SEQ ID NO: 44667 - RNA, 18 nt, Artificial Sequence
  Description of Artificial Sequence: Synthetic oligonucleotide
gguacagacccccucgga

SEQ ID NO: 44668 - RNA, 18 nt, Artificial Sequence
  Description of Artificial Sequence: Synthetic oligonucleotide
ucguugguacagaccccc

SEQ ID NO: 44669 - RNA, 18 nt, Artificial Sequence
  Description of Artificial Sequence: Synthetic oligonucleotide
uguuaucguugguacaga

SEQ ID NO: 44670 - RNA, 18 nt, Artificial Sequence
  Description of Artificial Sequence: Synthetic oligonucleotide
ugguauguuaucguuggu

SEQ ID NO: 44671 - RNA, 18 nt, Artificial Sequence
  Description of Artificial Sequence: Synthetic oligonucleotide
gcagauguucucaaugaa

SEQ ID NO: 44672 - RNA, 18 nt, Artificial Sequence
  Description of Artificial Sequence: Synthetic oligonucleotide
ggagggcagauguucuca

SEQ ID NO: 44673 - RNA, 18 nt, Artificial Sequence
  Description of Artificial Sequence: Synthetic oligonucleotide
ggcagggagggcagaugu

SEQ ID NO: 44674 - RNA, 18 nt, Artificial Sequence
  Description of Artificial Sequence: Synthetic oligonucleotide
cuuagggcagggagggca

SEQ ID NO: 44675 - RNA, 18 nt, Artificial Sequence
  Description of Artificial Sequence: Synthetic oligonucleotide
uugggcuuagggcaggga

SEQ ID NO: 44676 - RNA, 18 nt, Artificial Sequence
  Description of Artificial Sequence: Synthetic oligonucleotide
gagcauugggcuuagggc

SEQ ID NO: 44677 - RNA, 18 nt, Artificial Sequence
  Description of Artificial Sequence: Synthetic oligonucleotide
ggagagagcauugggcuu

SEQ ID NO: 44678 - RNA, 18 nt, Artificial Sequence
  Description of Artificial Sequence: Synthetic oligonucleotide
aaagaggagagagcauug

SEQ ID NO: 44679 - RNA, 18 nt, Artificial Sequence
  Description of Artificial Sequence: Synthetic oligonucleotide
gagguaaagaggagagag

SEQ ID NO: 44680 - RNA, 18 nt, Artificial Sequence
  Description of Artificial Sequence: Synthetic oligonucleotide
gggaggagguaaagagga

SEQ ID NO: 44681 - RNA, 18 nt, Artificial Sequence
  Description of Artificial Sequence: Synthetic oligonucleotide
agggugggaggagguaaa

SEQ ID NO: 44682 - RNA, 18 nt, Artificial Sequence
  Description of Artificial Sequence: Synthetic oligonucleotide
gagagagggugggaggag

SEQ ID NO: 44683 - RNA, 18 nt, Artificial Sequence
  Description of Artificial Sequence: Synthetic oligonucleotide
guggagagagaggguggg

SEQ ID NO: 44684 - RNA, 18 nt, Artificial Sequence
  Description of Artificial Sequence: Synthetic oligonucleotide
agacaguggagagagagg

SEQ ID NO: 44685 - RNA, 18 nt, Artificial Sequence
  Description of Artificial Sequence: Synthetic oligonucleotide
cuaagagacaguggagag

SEQ ID NO: 44686 - RNA, 18 nt, Artificial Sequence
  Description of Artificial Sequence: Synthetic oligonucleotide
acagacuaagagacagug

SEQ ID NO: 44687 - RNA, 18 nt, Artificial Sequence
  Description of Artificial Sequence: Synthetic oligonucleotide
aggacacagacuaagaga

SEQ ID NO: 44688 - RNA, 18 nt, Artificial Sequence
  Description of Artificial Sequence: Synthetic oligonucleotide
gggagaggacacagacua

SEQ ID NO: 44689 - RNA, 18 nt, Artificial Sequence
  Description of Artificial Sequence: Synthetic oligonucleotide
gagcagggagaggacaca

SEQ ID NO: 44690 - RNA, 18 nt, Artificial Sequence
  Description of Artificial Sequence: Synthetic oligonucleotide
auguggagcagggagagg

SEQ ID NO: 44691 - RNA, 18 nt, Artificial Sequence
  Description of Artificial Sequence: Synthetic oligonucleotide
gacaaauguggagcaggg

SEQ ID NO: 44692 - RNA, 18 nt, Artificial Sequence
  Description of Artificial Sequence: Synthetic oligonucleotide
aaggagacaaauguggag

SEQ ID NO: 44693 - RNA, 18 nt, Artificial Sequence
  Description of Artificial Sequence: Synthetic oligonucleotide
guacaaaggagacaaaug

SEQ ID NO: 44694 - RNA, 18 nt, Artificial Sequence
  Description of Artificial Sequence: Synthetic oligonucleotide
cccagguacaaaggagac

SEQ ID NO: 44695 - RNA, 18 nt, Artificial Sequence
  Description of Artificial Sequence: Synthetic oligonucleotide
guucccccagguacaaag

SEQ ID NO: 44696 - RNA, 18 nt, Artificial Sequence
  Description of Artificial Sequence: Synthetic oligonucleotide
ucucuguucccccaggua

SEQ ID NO: 44697 - RNA, 18 nt, Artificial Sequence
  Description of Artificial Sequence: Synthetic oligonucleotide
auuccucucuguuccccc

SEQ ID NO: 44698 - RNA, 18 nt, Artificial Sequence
  Description of Artificial Sequence: Synthetic oligonucleotide
agggcauuccucucuguu

SEQ ID NO: 44699 - RNA, 18 nt, Artificial Sequence
  Description of Artificial Sequence: Synthetic oligonucleotide
aagucagggcauuccucu

SEQ ID NO: 44700 - RNA, 18 nt, Artificial Sequence
  Description of Artificial Sequence: Synthetic oligonucleotide
aagaaaagucagggcauu

SEQ ID NO: 44701 - RNA, 18 nt, Artificial Sequence
  Description of Artificial Sequence: Synthetic oligonucleotide
agucaaagaaaagucagg

SEQ ID NO: 44702 - RNA, 18 nt, Artificial Sequence
  Description of Artificial Sequence: Synthetic oligonucleotide
cagacagucaaagaaaag

SEQ ID NO: 44703 - RNA, 18 nt, Artificial Sequence
  Description of Artificial Sequence: Synthetic oligonucleotide
uuuuccagacagucaaag

SEQ ID NO: 44704 - RNA, 18 nt, Artificial Sequence
  Description of Artificial Sequence: Synthetic oligonucleotide
ucccauuuuccagacagu

SEQ ID NO: 44705 - RNA, 18 nt, Artificial Sequence
  Description of Artificial Sequence: Synthetic oligonucleotide
uugacucccauuuuccag

SEQ ID NO: 44706 - RNA, 18 nt, Artificial Sequence
  Description of Artificial Sequence: Synthetic oligonucleotide
cacacuugacucccauuu

SEQ ID NO: 44707 - RNA, 18 nt, Artificial Sequence
  Description of Artificial Sequence: Synthetic oligonucleotide
cuccccacacuugacucc

SEQ ID NO: 44708 - RNA, 18 nt, Artificial Sequence
  Description of Artificial Sequence: Synthetic oligonucleotide
aaugacuccccacacuug

SEQ ID NO: 44709 - RNA, 18 nt, Artificial Sequence
  Description of Artificial Sequence: Synthetic oligonucleotide
aagugaaugacuccccac

SEQ ID NO: 44710 - RNA, 18 nt, Artificial Sequence
  Description of Artificial Sequence: Synthetic oligonucleotide
aaaugaagugaaugacuc

SEQ ID NO: 44711 - RNA, 18 nt, Artificial Sequence
  Description of Artificial Sequence: Synthetic oligonucleotide
caugcaaaugaagugaau

SEQ ID NO: 44712 - RNA, 18 nt, Artificial Sequence
  Description of Artificial Sequence: Synthetic oligonucleotide
ugcagcaugcaaaugaag

SEQ ID NO: 44713 - RNA, 18 nt, Artificial Sequence
  Description of Artificial Sequence: Synthetic oligonucleotide
uguuuugcagcaugcaaa

SEQ ID NO: 44714 - RNA, 18 nt, Artificial Sequence
  Description of Artificial Sequence: Synthetic oligonucleotide
cccucuguuuugcagcau

SEQ ID NO: 44715 - RNA, 18 nt, Artificial Sequence
  Description of Artificial Sequence: Synthetic oligonucleotide
cuccgcccucuguuuugc

SEQ ID NO: 44716 - RNA, 18 nt, Artificial Sequence
  Description of Artificial Sequence: Synthetic oligonucleotide
ggugccuccgcccucugu

SEQ ID NO: 44717 - RNA, 18 nt, Artificial Sequence
  Description of Artificial Sequence: Synthetic oligonucleotide
ucccuggugccuccgccc

SEQ ID NO: 44718 - RNA, 18 nt, Artificial Sequence
  Description of Artificial Sequence: Synthetic oligonucleotide
gccuuucccuggugccuc

SEQ ID NO: 44719 - RNA, 18 nt, Artificial Sequence
  Description of Artificial Sequence: Synthetic oligonucleotide
caagugccuuucccuggu

SEQ ID NO: 44720 - RNA, 18 nt, Artificial Sequence
  Description of Artificial Sequence: Synthetic oligonucleotide
ucauucaagugccuuucc

SEQ ID NO: 44721 - RNA, 18 nt, Artificial Sequence
  Description of Artificial Sequence: Synthetic oligonucleotide
cuucuucauucaagugcc

SEQ ID NO: 44722 - RNA, 18 nt, Artificial Sequence
  Description of Artificial Sequence: Synthetic oligonucleotide
uuuuccuucuucauucaa

SEQ ID NO: 44723 - RNA, 18 nt, Artificial Sequence
  Description of Artificial Sequence: Synthetic oligonucleotide
ucucauuuuccuucuuca

SEQ ID NO: 44724 - RNA, 18 nt, Artificial Sequence
  Description of Artificial Sequence: Synthetic oligonucleotide
cugguucucauuuuccuu

SEQ ID NO: 44725 - RNA, 18 nt, Artificial Sequence
  Description of Artificial Sequence: Synthetic oligonucleotide
acaaucugguucucauuu

SEQ ID NO: 44726 - RNA, 18 nt, Artificial Sequence
  Description of Artificial Sequence: Synthetic oligonucleotide
aaguuacaaucugguucu

SEQ ID NO: 44727 - RNA, 18 nt, Artificial Sequence
  Description of Artificial Sequence: Synthetic oligonucleotide
ggacgaaguuacaaucug

SEQ ID NO: 44728 - RNA, 18 nt, Artificial Sequence
  Description of Artificial Sequence: Synthetic oligonucleotide
gauuaggacgaaguuaca

SEQ ID NO: 44729 - RNA, 18 nt, Artificial Sequence
  Description of Artificial Sequence: Synthetic oligonucleotide
agguggauuaggacgaag

SEQ ID NO: 44730 - RNA, 18 nt, Artificial Sequence
  Description of Artificial Sequence: Synthetic oligonucleotide
cuggcagguggauuagga

SEQ ID NO: 44731 - RNA, 18 nt, Artificial Sequence
  Description of Artificial Sequence: Synthetic oligonucleotide
aaguucuggcagguggau

SEQ ID NO: 44732 - RNA, 18 nt, Artificial Sequence
  Description of Artificial Sequence: Synthetic oligonucleotide
aaggaaaguucuggcagg

SEQ ID NO: 44733 - RNA, 18 nt, Artificial Sequence
  Description of Artificial Sequence: Synthetic oligonucleotide
accugaaggaaaguucug

SEQ ID NO: 44734 - RNA, 18 nt, Artificial Sequence
  Description of Artificial Sequence: Synthetic oligonucleotide
gugacaccugaaggaaag

SEQ ID NO: 44735 - RNA, 18 nt, Artificial Sequence
  Description of Artificial Sequence: Synthetic oligonucleotide
gaugugugacaccugaag

SEQ ID NO: 44736 - RNA, 18 nt, Artificial Sequence
  Description of Artificial Sequence: Synthetic oligonucleotide
aaauggaugugugacacc

SEQ ID NO: 44737 - RNA, 18 nt, Artificial Sequence
  Description of Artificial Sequence: Synthetic oligonucleotide
gauggaaauggaugugug

SEQ ID NO: 44738 - RNA, 18 nt, Artificial Sequence
  Description of Artificial Sequence: Synthetic oligonucleotide
auuaggauggaaauggau

SEQ ID NO: 44739 - RNA, 18 nt, Artificial Sequence
  Description of Artificial Sequence: Synthetic oligonucleotide
uuaauauuaggauggaaa

SEQ ID NO: 44740 - RNA, 18 nt, Artificial Sequence
  Description of Artificial Sequence: Synthetic oligonucleotide
auuguuuaauauuaggau

SEQ ID NO: 44741 - RNA, 18 nt, Artificial Sequence
  Description of Artificial Sequence: Synthetic oligonucleotide
auuauauuguuuaauauu

SEQ ID NO: 44742 - RNA, 18 nt, Artificial Sequence
  Description of Artificial Sequence: Synthetic oligonucleotide
cuuucauuauauuguuua

SEQ ID NO: 44743 - RNA, 18 nt, Artificial Sequence
  Description of Artificial Sequence: Synthetic oligonucleotide
gcuuucuuucauuauauu

SEQ ID NO: 44744 - RNA, 18 nt, Artificial Sequence
  Description of Artificial Sequence: Synthetic oligonucleotide
gaugugugacaccugaag

SEQ ID NO: 44745 - RNA, 18 nt, Artificial Sequence
  Description of Artificial Sequence: Synthetic oligonucleotide
aaauggaugugugacacc

SEQ ID NO: 44746 - RNA, 18 nt, Artificial Sequence
  Description of Artificial Sequence: Synthetic oligonucleotide
gauggaaauggaugugug

SEQ ID NO: 44747 - RNA, 18 nt, Artificial Sequence
  Description of Artificial Sequence: Synthetic oligonucleotide
auuaggauggaaauggau

SEQ ID NO: 44748 - RNA, 18 nt, Artificial Sequence
  Description of Artificial Sequence: Synthetic oligonucleotide
uuaauauuaggauggaaa

SEQ ID NO: 44749 - RNA, 18 nt, Artificial Sequence
  Description of Artificial Sequence: Synthetic oligonucleotide
auuguuuaauauuaggau

SEQ ID NO: 44750 - RNA, 18 nt, Artificial Sequence
  Description of Artificial Sequence: Synthetic oligonucleotide
auuauauuguuuaauauu

SEQ ID NO: 44751 - RNA, 18 nt, Artificial Sequence
  Description of Artificial Sequence: Synthetic oligonucleotide
cuuucauuauauuguuua

SEQ ID NO: 44752 - RNA, 18 nt, Artificial Sequence
  Description of Artificial Sequence: Synthetic oligonucleotide
gcuuucuuucauuauauu

SEQ ID NO: 44753 - RNA, 18 nt, Artificial Sequence
  Description of Artificial Sequence: Synthetic oligonucleotide
guaaagcuuucuuucauu

SEQ ID NO: 44754 - RNA, 18 nt, Artificial Sequence
  Description of Artificial Sequence: Synthetic oligonucleotide
uuguuguaaagcuuucuu

SEQ ID NO: 44755 - RNA, 18 nt, Artificial Sequence
  Description of Artificial Sequence: Synthetic oligonucleotide
uagacuuguuguaaagcu

SEQ ID NO: 44756 - RNA, 18 nt, Artificial Sequence
  Description of Artificial Sequence: Synthetic oligonucleotide
cuauuuagacuuguugua

SEQ ID NO: 44757 - RNA, 18 nt, Artificial Sequence
  Description of Artificial Sequence: Synthetic oligonucleotide
aaaaacuauuuagacuug

SEQ ID NO: 44758 - RNA, 18 nt, Artificial Sequence
  Description of Artificial Sequence: Synthetic oligonucleotide
aaaauaaaaacuauuuag

SEQ ID NO: 44759 - RNA, 18 nt, Artificial Sequence
  Description of Artificial Sequence: Synthetic oligonucleotide
gcccgaaaauaaaaacua

SEQ ID NO: 44760 - RNA, 18 nt, Artificial Sequence
  Description of Artificial Sequence: Synthetic oligonucleotide
agacugcccgaaaauaaa

SEQ ID NO: 44761 - RNA, 18 nt, Artificial Sequence
  Description of Artificial Sequence: Synthetic oligonucleotide
uuaaaagacugcccgaaa

SEQ ID NO: 44762 - RNA, 18 nt, Artificial Sequence
  Description of Artificial Sequence: Synthetic oligonucleotide
cuuuguuaaaagacugcc

SEQ ID NO: 44763 - RNA, 18 nt, Artificial Sequence
  Description of Artificial Sequence: Synthetic oligonucleotide
cuuugcuuuguuaaaaga

SEQ ID NO: 44764 - RNA, 18 nt, Artificial Sequence
  Description of Artificial Sequence: Synthetic oligonucleotide
gguugcuuugcuuuguua

SEQ ID NO: 44765 - RNA, 18 nt, Artificial Sequence
  Description of Artificial Sequence: Synthetic oligonucleotide
cacacgguugcuuugcuu

SEQ ID NO: 44766 - RNA, 18 nt, Artificial Sequence
  Description of Artificial Sequence: Synthetic oligonucleotide
uaacucacacgguugcuu

SEQ ID NO: 44767 - RNA, 18 nt, Artificial Sequence
  Description of Artificial Sequence: Synthetic oligonucleotide
ugaccuaacucacacggu

SEQ ID NO: 44768 - RNA, 18 nt, Artificial Sequence
  Description of Artificial Sequence: Synthetic oligonucleotide
ucuggugaccuaacucac

SEQ ID NO: 44769 - RNA, 18 nt, Artificial Sequence
  Description of Artificial Sequence: Synthetic oligonucleotide
gugucucuggugaccuaa

SEQ ID NO: 44770 - RNA, 18 nt, Artificial Sequence
  Description of Artificial Sequence: Synthetic oligonucleotide
gcuuggugucucugguga

SEQ ID NO: 44771 - RNA, 18 nt, Artificial Sequence
  Description of Artificial Sequence: Synthetic oligonucleotide
ccauugcuuggugucucu

SEQ ID NO: 44772 - RNA, 18 nt, Artificial Sequence
  Description of Artificial Sequence: Synthetic oligonucleotide
cuucaccauugcuuggug

SEQ ID NO: 44773 - RNA, 18 nt, Artificial Sequence
  Description of Artificial Sequence: Synthetic oligonucleotide
ggguccuucaccauugcu

SEQ ID NO: 44774 - RNA, 18 nt, Artificial Sequence
  Description of Artificial Sequence: Synthetic oligonucleotide
agagaauugggcggaggg

SEQ ID NO: 44775 - RNA, 18 nt, Artificial Sequence
  Description of Artificial Sequence: Synthetic oligonucleotide
ggauagagaauugggcgg

SEQ ID NO: 44776 - RNA, 18 nt, Artificial Sequence
  Description of Artificial Sequence: Synthetic oligonucleotide
uaguuggauagagaauug

SEQ ID NO: 44777 - RNA, 18 nt, Artificial Sequence
  Description of Artificial Sequence: Synthetic oligonucleotide
aaauuuaguuggauagag

SEQ ID NO: 44778 - RNA, 18 nt, Artificial Sequence
  Description of Artificial Sequence: Synthetic oligonucleotide
cauggaaauuuaguugga

SEQ ID NO: 44779 - RNA, 18 nt, Artificial Sequence
  Description of Artificial Sequence: Synthetic oligonucleotide
uugggcauggaaauuuag

SEQ ID NO: 44780 - RNA, 18 nt, Artificial Sequence
  Description of Artificial Sequence: Synthetic oligonucleotide
ucacuuugggcauggaaa

SEQ ID NO: 44781 - RNA, 18 nt, Artificial Sequence
  Description of Artificial Sequence: Synthetic oligonucleotide
agcuaucacuuugggcau

SEQ ID NO: 44782 - RNA, 18 nt, Artificial Sequence
  Description of Artificial Sequence: Synthetic oligonucleotide
augauagcuaucacuuug

SEQ ID NO: 44783 - RNA, 18 nt, Artificial Sequence
  Description of Artificial Sequence: Synthetic oligonucleotide
aaaaaaugauagcuauca

SEQ ID NO: 44784 - RNA, 18 nt, Artificial Sequence
  Description of Artificial Sequence: Synthetic oligonucleotide
cguggaaaaaaugauagc

SEQ ID NO: 44785 - RNA, 18 nt, Artificial Sequence
  Description of Artificial Sequence: Synthetic oligonucleotide
uacaccguggaaaaaaug

SEQ ID NO: 44786 - RNA, 18 nt, Artificial Sequence
  Description of Artificial Sequence: Synthetic oligonucleotide
gcagauacaccguggaaa

SEQ ID NO: 44787 - RNA, 18 nt, Artificial Sequence
  Description of Artificial Sequence: Synthetic oligonucleotide
gauuugcagauacaccgu

SEQ ID NO: 44788 - RNA, 18 nt, Artificial Sequence
  Description of Artificial Sequence: Synthetic oligonucleotide
ggguggauuugcagauac

SEQ ID NO: 44789 - RNA, 18 nt, Artificial Sequence
  Description of Artificial Sequence: Synthetic oligonucleotide
acaguggguggauuugca

SEQ ID NO: 44790 - RNA, 18 nt, Artificial Sequence
  Description of Artificial Sequence: Synthetic oligonucleotide
ccgggacaguggguggau

SEQ ID NO: 44791 - RNA, 18 nt, Artificial Sequence
  Description of Artificial Sequence: Synthetic oligonucleotide
ccaccccgggacaguggg

SEQ ID NO: 44792 - RNA, 18 nt, Artificial Sequence
  Description of Artificial Sequence: Synthetic oligonucleotide
cccagccaccccgggaca

SEQ ID NO: 44793 - RNA, 18 nt, Artificial Sequence
  Description of Artificial Sequence: Synthetic oligonucleotide
aagcucccagccaccccg

SEQ ID NO: 44794 - RNA, 18 nt, Artificial Sequence
  Description of Artificial Sequence: Synthetic oligonucleotide
uuaaaaagcucccagcca

SEQ ID NO: 44795 - RNA, 18 nt, Artificial Sequence
  Description of Artificial Sequence: Synthetic oligonucleotide
acccguuaaaaagcuccc

SEQ ID NO: 44796 - RNA, 18 nt, Artificial Sequence
  Description of Artificial Sequence: Synthetic oligonucleotide
ucucaacccguuaaaaag

SEQ ID NO: 44797 - RNA, 18 nt, Artificial Sequence
  Description of Artificial Sequence: Synthetic oligonucleotide
gcaacucucaacccguua

SEQ ID NO: 44798 - RNA, 18 nt, Artificial Sequence
  Description of Artificial Sequence: Synthetic oligonucleotide
aaaaagcaacucucaacc

SEQ ID NO: 44799 - RNA, 18 nt, Artificial Sequence
  Description of Artificial Sequence: Synthetic oligonucleotide
accuuaaaaagcaacucu

SEQ ID NO: 44800 - RNA, 18 nt, Artificial Sequence
  Description of Artificial Sequence: Synthetic oligonucleotide
ccacaaccuuaaaaagca

SEQ ID NO: 44801 - RNA, 18 nt, Artificial Sequence
  Description of Artificial Sequence: Synthetic oligonucleotide
cucacccacaaccuuaaa

SEQ ID NO: 44802 - RNA, 18 nt, Artificial Sequence
  Description of Artificial Sequence: Synthetic oligonucleotide
cucagcucacccacaacc

SEQ ID NO: 44803 - RNA, 18 nt, Artificial Sequence
  Description of Artificial Sequence: Synthetic oligonucleotide
cccaucucagcucaccca

SEQ ID NO: 44804 - RNA, 18 nt, Artificial Sequence
  Description of Artificial Sequence: Synthetic oligonucleotide
agucacccaucucagcuc

SEQ ID NO: 44805 - RNA, 18 nt, Artificial Sequence
  Description of Artificial Sequence: Synthetic oligonucleotide
gacacagucacccaucuc

SEQ ID NO: 44806 - RNA, 18 nt, Artificial Sequence
  Description of Artificial Sequence: Synthetic oligonucleotide
cugaagacacagucaccc

SEQ ID NO: 44807 - RNA, 18 nt, Artificial Sequence
  Description of Artificial Sequence: Synthetic oligonucleotide
gucuccugaagacacagu

SEQ ID NO: 44808 - RNA, 18 nt, Artificial Sequence
  Description of Artificial Sequence: Synthetic oligonucleotide
guagugucuccugaagac

SEQ ID NO: 44809 - RNA, 18 nt, Artificial Sequence
  Description of Artificial Sequence: Synthetic oligonucleotide
aaaugguagugucuccug

SEQ ID NO: 44810 - RNA, 18 nt, Artificial Sequence
  Description of Artificial Sequence: Synthetic oligonucleotide
aaaccaaaugguaguguc

SEQ ID NO: 44811 - RNA, 18 nt, Artificial Sequence
  Description of Artificial Sequence: Synthetic oligonucleotide
aaaucaaaccaaauggua

SEQ ID NO: 44812 - RNA, 18 nt, Artificial Sequence
  Description of Artificial Sequence: Synthetic oligonucleotide
cucuguuuauugaugaca

SEQ ID NO: 44813 - RNA, 18 nt, Artificial Sequence
  Description of Artificial Sequence: Synthetic oligonucleotide
aagaacucuguuuauuga

SEQ ID NO: 44814 - RNA, 18 nt, Artificial Sequence
  Description of Artificial Sequence: Synthetic oligonucleotide
uugcgaagaacucuguuu

SEQ ID NO: 44815 - RNA, 18 nt, Artificial Sequence
  Description of Artificial Sequence: Synthetic oligonucleotide
ccagguugcgaagaacuc

SEQ ID NO: 44816 - RNA, 18 nt, Artificial Sequence
  Description of Artificial Sequence: Synthetic oligonucleotide
gcuagccagguugcgaag

SEQ ID NO: 44817 - RNA, 18 nt, Artificial Sequence
  Description of Artificial Sequence: Synthetic oligonucleotide
uuuucgcuagccagguug

SEQ ID NO: 44818 - RNA, 18 nt, Artificial Sequence
  Description of Artificial Sequence: Synthetic oligonucleotide
guugcuuuucgcuagcca

SEQ ID NO: 44819 - RNA, 18 nt, Artificial Sequence
  Description of Artificial Sequence: Synthetic oligonucleotide
caucuguugcuuuucgcu

SEQ ID NO: 44820 - RNA, 18 nt, Artificial Sequence
  Description of Artificial Sequence: Synthetic oligonucleotide
gcgcccaucuguugcuuu

SEQ ID NO: 44821 - RNA, 18 nt, Artificial Sequence
  Description of Artificial Sequence: Synthetic oligonucleotide
cgucugcgcccaucuguu

SEQ ID NO: 44822 - RNA, 18 nt, Artificial Sequence
  Description of Artificial Sequence: Synthetic oligonucleotide
caugccgucugcgcccau

SEQ ID NO: 44823 - RNA, 18 nt, Artificial Sequence
  Description of Artificial Sequence: Synthetic oligonucleotide
ucauacaugccgucugcg

SEQ ID NO: 44824 - RNA, 18 nt, Artificial Sequence
  Description of Artificial Sequence: Synthetic oligonucleotide
guuuaucauacaugccgu

SEQ ID NO: 44825 - RNA, 18 nt, Artificial Sequence
  Description of Artificial Sequence: Synthetic oligonucleotide
ccuuaguuuaucauacau

SEQ ID NO: 44826 - RNA, 18 nt, Artificial Sequence
  Description of Artificial Sequence: Synthetic oligonucleotide
aacauccuuaguuuauca

SEQ ID NO: 44827 - RNA, 18 nt, Artificial Sequence
  Description of Artificial Sequence: Synthetic oligonucleotide
cguucaacauccuuaguu

SEQ ID NO: 44828 - RNA, 18 nt, Artificial Sequence
  Description of Artificial Sequence: Synthetic oligonucleotide
cugcccguucaacauccu

SEQ ID NO: 44829 - RNA, 18 nt, Artificial Sequence
  Description of Artificial Sequence: Synthetic oligonucleotide
ccggucugcccguucaac

SEQ ID NO: 44830 - RNA, 18 nt, Artificial Sequence
  Description of Artificial Sequence: Synthetic oligonucleotide
agcuuccggucugcccgu

SEQ ID NO: 44831 - RNA, 18 nt, Artificial Sequence
  Description of Artificial Sequence: Synthetic oligonucleotide
gccccagcuuccggucug

SEQ ID NO: 44832 - RNA, 18 nt, Artificial Sequence
  Description of Artificial Sequence: Synthetic oligonucleotide
cgggugccccagcuuccg

SEQ ID NO: 44833 - RNA, 18 nt, Artificial Sequence
  Description of Artificial Sequence: Synthetic oligonucleotide
cagggcgggugccccagc

SEQ ID NO: 44834 - RNA, 18 nt, Artificial Sequence
  Description of Artificial Sequence: Synthetic oligonucleotide
ccaaccagggcgggugcc

SEQ ID NO: 44835 - RNA, 18 nt, Artificial Sequence
  Description of Artificial Sequence: Synthetic oligonucleotide
ggauaccaaccagggcgg

SEQ ID NO: 44836 - RNA, 18 nt, Artificial Sequence
  Description of Artificial Sequence: Synthetic oligonucleotide
uccccggauaccaaccag

SEQ ID NO: 44837 - RNA, 18 nt, Artificial Sequence
  Description of Artificial Sequence: Synthetic oligonucleotide
cgaaguccccggauacca

SEQ ID NO: 44838 - RNA, 18 nt, Artificial Sequence
  Description of Artificial Sequence: Synthetic oligonucleotide
ggcaccgaaguccccgga

SEQ ID NO: 44839 - RNA, 18 nt, Artificial Sequence
  Description of Artificial Sequence: Synthetic oligonucleotide
gcccuggcaccgaagucc

SEQ ID NO: 44840 - RNA, 18 nt, Artificial Sequence
  Description of Artificial Sequence: Synthetic oligonucleotide
agguugcccuggcaccga

SEQ ID NO: 44841 - RNA, 18 nt, Artificial Sequence
  Description of Artificial Sequence: Synthetic oligonucleotide
ugcguagguugcccuggc

SEQ ID NO: 44842 - RNA, 18 nt, Artificial Sequence
  Description of Artificial Sequence: Synthetic oligonucleotide
gccgcgggauuccacggg

SEQ ID NO: 44843 - RNA, 18 nt, Artificial Sequence
  Description of Artificial Sequence: Synthetic oligonucleotide
augcuggcucuggcuggg

SEQ ID NO: 44844 - RNA, 18 nt, Artificial Sequence
  Description of Artificial Sequence: Synthetic oligonucleotide
ucugcaugcuggcucugg

SEQ ID NO: 44845 - RNA, 18 nt, Artificial Sequence
  Description of Artificial Sequence: Synthetic oligonucleotide
ccagaaagaccagaggca

SEQ ID NO: 44846 - RNA, 18 nt, Artificial Sequence
  Description of Artificial Sequence: Synthetic oligonucleotide
aagucccagaaagaccag

SEQ ID NO: 44847 - RNA, 18 nt, Artificial Sequence
  Description of Artificial Sequence: Synthetic oligonucleotide
gcccgaagucccagaaag

SEQ ID NO: 44848 - RNA, 18 nt, Artificial Sequence
  Description of Artificial Sequence: Synthetic oligonucleotide
cccgagcccgaaguccca

SEQ ID NO: 44849 - RNA, 18 nt, Artificial Sequence
  Description of Artificial Sequence: Synthetic oligonucleotide
cgcaccccgagcccgaag

SEQ ID NO: 44850 - RNA, 18 nt, Artificial Sequence
  Description of Artificial Sequence: Synthetic oligonucleotide
guccgcgcaccccgagcc

SEQ ID NO: 44851 - RNA, 18 nt, Artificial Sequence
  Description of Artificial Sequence: Synthetic oligonucleotide
cucggguccgcgcacccc

SEQ ID NO: 44852 - RNA, 18 nt, Artificial Sequence
  Description of Artificial Sequence: Synthetic oligonucleotide
ugacccucggguccgcgc

SEQ ID NO: 44853 - RNA, 18 nt, Artificial Sequence
  Description of Artificial Sequence: Synthetic oligonucleotide
uccccugacccucggguc

SEQ ID NO: 44854 - RNA, 18 nt, Artificial Sequence
  Description of Artificial Sequence: Synthetic oligonucleotide
uguccuccccugacccuc

SEQ ID NO: 44855 - RNA, 18 nt, Artificial Sequence
  Description of Artificial Sequence: Synthetic oligonucleotide
cccuguguccuccccuga

SEQ ID NO: 44856 - RNA, 18 nt, Artificial Sequence
  Description of Artificial Sequence: Synthetic oligonucleotide
cgagucccuguguccucc

SEQ ID NO: 44857 - RNA, 18 nt, Artificial Sequence
  Description of Artificial Sequence: Synthetic oligonucleotide
cgucgcgagucccugugu

SEQ ID NO: 44858 - RNA, 18 nt, Artificial Sequence
  Description of Artificial Sequence: Synthetic oligonucleotide
gcgggcgucgcgaguccc

SEQ ID NO: 44859 - RNA, 18 nt, Artificial Sequence
  Description of Artificial Sequence: Synthetic oligonucleotide
ccagcgcgggcgucgcga

SEQ ID NO: 44860 - RNA, 18 nt, Artificial Sequence
  Description of Artificial Sequence: Synthetic oligonucleotide
ccgggccagcgcgggcgu

SEQ ID NO: 44861 - RNA, 18 nt, Artificial Sequence
  Description of Artificial Sequence: Synthetic oligonucleotide
ggcggccgggccagcgcg

SEQ ID NO: 44862 - RNA, 18 nt, Artificial Sequence
  Description of Artificial Sequence: Synthetic oligonucleotide
cggucggcggccgggcca

SEQ ID NO: 44863 - RNA, 18 nt, Artificial Sequence
  Description of Artificial Sequence: Synthetic oligonucleotide
ucagucggucggcggccg

SEQ ID NO: 44864 - RNA, 18 nt, Artificial Sequence
  Description of Artificial Sequence: Synthetic oligonucleotide
gggccucagucggucggc

SEQ ID NO: 44865 - RNA, 18 nt, Artificial Sequence
  Description of Artificial Sequence: Synthetic oligonucleotide
uccccgggccucagucgg

SEQ ID NO: 44866 - RNA, 18 nt, Artificial Sequence
  Description of Artificial Sequence: Synthetic oligonucleotide
gcagguccccgggccuca

SEQ ID NO: 44867 - RNA, 18 nt, Artificial Sequence
  Description of Artificial Sequence: Synthetic oligonucleotide
ccgccgcagguccccggg

SEQ ID NO: 44868 - RNA, 18 nt, Artificial Sequence
  Description of Artificial Sequence: Synthetic oligonucleotide
agcagccgccgcaggucc

SEQ ID NO: 44869 - RNA, 18 nt, Artificial Sequence
  Description of Artificial Sequence: Synthetic oligonucleotide
gggagcagccgccgcagg

SEQ ID NO: 44870 - RNA, 18 nt, Artificial Sequence
  Description of Artificial Sequence: Synthetic oligonucleotide
ugccgggcgcggagcggg

SEQ ID NO: 44871 - RNA, 18 nt, Artificial Sequence
  Description of Artificial Sequence: Synthetic oligonucleotide
cgggcugccgggcgcgga

SEQ ID NO: 44872 - RNA, 18 nt, Artificial Sequence
  Description of Artificial Sequence: Synthetic oligonucleotide
ccucccgggcugccgggc

SEQ ID NO: 44873 - RNA, 18 nt, Artificial Sequence
  Description of Artificial Sequence: Synthetic oligonucleotide
ccuccccucccgggcugc

SEQ ID NO: 44874 - RNA, 18 nt, Artificial Sequence
  Description of Artificial Sequence: Synthetic oligonucleotide
aacgcccuccccucccgg

SEQ ID NO: 44875 - RNA, 18 nt, Artificial Sequence
  Description of Artificial Sequence: Synthetic oligonucleotide
aagcaaacgcccuccccu

SEQ ID NO: 44876 - RNA, 18 nt, Artificial Sequence
  Description of Artificial Sequence: Synthetic oligonucleotide
gagccaagcaaacgcccu

SEQ ID NO: 44877 - RNA, 18 nt, Artificial Sequence
  Description of Artificial Sequence: Synthetic oligonucleotide
gagaagagccaagcaaac

SEQ ID NO: 44878 - RNA, 18 nt, Artificial Sequence
  Description of Artificial Sequence: Synthetic oligonucleotide
guaucgagaagagccaag

SEQ ID NO: 44879 - RNA, 18 nt, Artificial Sequence
  Description of Artificial Sequence: Synthetic oligonucleotide
cuccaguaucgagaagag

SEQ ID NO: 44880 - RNA, 18 nt, Artificial Sequence
  Description of Artificial Sequence: Synthetic oligonucleotide
ugcuucuccaguaucgag

SEQ ID NO: 44881 - RNA, 18 nt, Artificial Sequence
  Description of Artificial Sequence: Synthetic oligonucleotide
gccccugcuucuccagua

SEQ ID NO: 44882 - RNA, 18 nt, Artificial Sequence
  Description of Artificial Sequence: Synthetic oligonucleotide
gcccagccccugcuucuc

SEQ ID NO: 44883 - RNA, 18 nt, Artificial Sequence
  Description of Artificial Sequence: Synthetic oligonucleotide
uaagggcccagccccugc

SEQ ID NO: 44884 - RNA, 18 nt, Artificial Sequence
  Description of Artificial Sequence: Synthetic oligonucleotide
guucuuaagggcccagcc

SEQ ID NO: 44885 - RNA, 18 nt, Artificial Sequence
  Description of Artificial Sequence: Synthetic oligonucleotide
gggcuguucuuaagggcc

SEQ ID NO: 44886 - RNA, 18 nt, Artificial Sequence
  Description of Artificial Sequence: Synthetic oligonucleotide
cgggcgggcuguucuuaa

SEQ ID NO: 44887 - RNA, 18 nt, Artificial Sequence
  Description of Artificial Sequence: Synthetic oligonucleotide
aaacucgggcgggcuguu

SEQ ID NO: 44888 - RNA, 18 nt, Artificial Sequence
  Description of Artificial Sequence: Synthetic oligonucleotide
uucgaaaacucgggcggg

SEQ ID NO: 44889 - RNA, 18 nt, Artificial Sequence
  Description of Artificial Sequence: Synthetic oligonucleotide
gcagcuucgaaaacucgg

SEQ ID NO: 44890 - RNA, 18 nt, Artificial Sequence
  Description of Artificial Sequence: Synthetic oligonucleotide
cuaccgcagcuucgaaaa

SEQ ID NO: 44891 - RNA, 18 nt, Artificial Sequence
  Description of Artificial Sequence: Synthetic oligonucleotide
uuucucuaccgcagcuuc

SEQ ID NO: 44892 - RNA, 18 nt, Artificial Sequence
  Description of Artificial Sequence: Synthetic oligonucleotide
ggguuucucuaccgcagc

SEQ ID NO: 44893 - RNA, 18 nt, Artificial Sequence
  Description of Artificial Sequence: Synthetic oligonucleotide
ugaguuacaggauuuggg

SEQ ID NO: 44894 - RNA, 18 nt, Artificial Sequence
  Description of Artificial Sequence: Synthetic oligonucleotide
gggugugaguuacaggau

SEQ ID NO: 44895 - RNA, 18 nt, Artificial Sequence
  Description of Artificial Sequence: Synthetic oligonucleotide
gggucagagcccgggcag

SEQ ID NO: 44896 - RNA, 18 nt, Artificial Sequence
  Description of Artificial Sequence: Synthetic oligonucleotide
ccagccccucucuccggg

SEQ ID NO: 44897 - RNA, 18 nt, Artificial Sequence
  Description of Artificial Sequence: Synthetic oligonucleotide
ucagcccagccccucucu

SEQ ID NO: 44898 - RNA, 18 nt, Artificial Sequence
  Description of Artificial Sequence: Synthetic oligonucleotide
ccugaucagcccagcccc

SEQ ID NO: 44899 - RNA, 18 nt, Artificial Sequence
  Description of Artificial Sequence: Synthetic oligonucleotide
cccgcccugaucagccca

SEQ ID NO: 44900 - RNA, 18 nt, Artificial Sequence
  Description of Artificial Sequence: Synthetic oligonucleotide
uucgccccgcccugauca

SEQ ID NO: 44901 - RNA, 18 nt, Artificial Sequence
  Description of Artificial Sequence: Synthetic oligonucleotide
aagacuucgccccgcccu

SEQ ID NO: 44902 - RNA, 18 nt, Artificial Sequence
  Description of Artificial Sequence: Synthetic oligonucleotide
aggagaagacuucgcccc

SEQ ID NO: 44903 - RNA, 18 nt, Artificial Sequence
  Description of Artificial Sequence: Synthetic oligonucleotide
caacuaggagaagacuuc

SEQ ID NO: 44904 - RNA, 18 nt, Artificial Sequence
  Description of Artificial Sequence: Synthetic oligonucleotide
ucgcucaacuaggagaag

SEQ ID NO: 44905 - RNA, 18 nt, Artificial Sequence
  Description of Artificial Sequence: Synthetic oligonucleotide
ccuucucgcucaacuagg

SEQ ID NO: 44906 - RNA, 18 nt, Artificial Sequence
  Description of Artificial Sequence: Synthetic oligonucleotide
ggccuccuucucgcucaa

SEQ ID NO: 44907 - RNA, 18 nt, Artificial Sequence
  Description of Artificial Sequence: Synthetic oligonucleotide
gggccuccuucucgcuca

SEQ ID NO: 44908 - RNA, 18 nt, Artificial Sequence
  Description of Artificial Sequence: Synthetic oligonucleotide
uuggcuaagcccaaaggg

SEQ ID NO: 44909 - RNA, 18 nt, Artificial Sequence
  Description of Artificial Sequence: Synthetic oligonucleotide
cagucuuggcuaagccca

SEQ ID NO: 44910 - RNA, 18 nt, Artificial Sequence
  Description of Artificial Sequence: Synthetic oligonucleotide
acuuucagucuuggcuaa

SEQ ID NO: 44911 - RNA, 18 nt, Artificial Sequence
  Description of Artificial Sequence: Synthetic oligonucleotide
uggagacuuucagucuug

SEQ ID NO: 44912 - RNA, 18 nt, Artificial Sequence
  Description of Artificial Sequence: Synthetic oligonucleotide
guugguggagacuuucag

SEQ ID NO: 44913 - RNA, 18 nt, Artificial Sequence
  Description of Artificial Sequence: Synthetic oligonucleotide
gccggguugguggagacu

SEQ ID NO: 44914 - RNA, 18 nt, Artificial Sequence
  Description of Artificial Sequence: Synthetic oligonucleotide
accccgccggguuggugg

SEQ ID NO: 44915 - RNA, 18 nt, Artificial Sequence
  Description of Artificial Sequence: Synthetic oligonucleotide
ccccaaccccgccggguu

SEQ ID NO: 44916 - RNA, 18 nt, Artificial Sequence
  Description of Artificial Sequence: Synthetic oligonucleotide
gaagcccccaaccccgcc

SEQ ID NO: 44917 - RNA, 18 nt, Artificial Sequence
  Description of Artificial Sequence: Synthetic oligonucleotide
ggagagaagcccccaacc

SEQ ID NO: 44918 - RNA, 18 nt, Artificial Sequence
  Description of Artificial Sequence: Synthetic oligonucleotide
gggagagaagcccccaac

SEQ ID NO: 44919 - RNA, 18 nt, Artificial Sequence
  Description of Artificial Sequence: Synthetic oligonucleotide
cccugagagugacuuggg

SEQ ID NO: 44920 - RNA, 18 nt, Artificial Sequence
  Description of Artificial Sequence: Synthetic oligonucleotide
agcugcccugagagugac

SEQ ID NO: 44921 - RNA, 18 nt, Artificial Sequence
  Description of Artificial Sequence: Synthetic oligonucleotide
ggaggagcugcccugaga

SEQ ID NO: 44922 - RNA, 18 nt, Artificial Sequence
  Description of Artificial Sequence: Synthetic oligonucleotide
gggaggagcugcccugag

SEQ ID NO: 44923 - RNA, 18 nt, Artificial Sequence
  Description of Artificial Sequence: Synthetic oligonucleotide
uucuaggcccguaguggg

SEQ ID NO: 44924 - RNA, 18 nt, Artificial Sequence
  Description of Artificial Sequence: Synthetic oligonucleotide
aucccuucuaggcccgua

SEQ ID NO: 44925 - RNA, 18 nt, Artificial Sequence
  Description of Artificial Sequence: Synthetic oligonucleotide
uccccaucccuucuaggc

SEQ ID NO: 44926 - RNA, 18 nt, Artificial Sequence
  Description of Artificial Sequence: Synthetic oligonucleotide
uggguucuacagauccca

SEQ ID NO: 44927 - RNA, 18 nt, Artificial Sequence
  Description of Artificial Sequence: Synthetic oligonucleotide
aaccauggguucuacaga

SEQ ID NO: 44928 - RNA, 18 nt, Artificial Sequence
  Description of Artificial Sequence: Synthetic oligonucleotide
ccgcaaaccauggguucu

SEQ ID NO: 44929 - RNA, 18 nt, Artificial Sequence
  Description of Artificial Sequence: Synthetic oligonucleotide
ugucaccgcaaaccaugg

SEQ ID NO: 44930 - RNA, 18 nt, Artificial Sequence
  Description of Artificial Sequence: Synthetic oligonucleotide
cugagugucaccgcaaac

SEQ ID NO: 44931 - RNA, 18 nt, Artificial Sequence
  Description of Artificial Sequence: Synthetic oligonucleotide
ccccucugagugucaccg

SEQ ID NO: 44932 - RNA, 18 nt, Artificial Sequence
  Description of Artificial Sequence: Synthetic oligonucleotide
aagauccccucugagugu

SEQ ID NO: 44933 - RNA, 18 nt, Artificial Sequence
  Description of Artificial Sequence: Synthetic oligonucleotide
ucccaaagauccccucug

SEQ ID NO: 44934 - RNA, 18 nt, Artificial Sequence
  Description of Artificial Sequence: Synthetic oligonucleotide
aaaucucccaaagauccc

SEQ ID NO: 44935 - RNA, 18 nt, Artificial Sequence
  Description of Artificial Sequence: Synthetic oligonucleotide
ucuauaaaucucccaaag

SEQ ID NO: 44936 - RNA, 18 nt, Artificial Sequence
  Description of Artificial Sequence: Synthetic oligonucleotide
ccggcucuauaaaucucc

SEQ ID NO: 44937 - RNA, 18 nt, Artificial Sequence
  Description of Artificial Sequence: Synthetic oligonucleotide
aagaaccggcucuauaaa

SEQ ID NO: 44938 - RNA, 18 nt, Artificial Sequence
  Description of Artificial Sequence: Synthetic oligonucleotide
gcgcuaagaaccggcucu

SEQ ID NO: 44939 - RNA, 18 nt, Artificial Sequence
  Description of Artificial Sequence: Synthetic oligonucleotide
acaaagcgcuaagaaccg

SEQ ID NO: 44940 - RNA, 18 nt, Artificial Sequence
  Description of Artificial Sequence: Synthetic oligonucleotide
aacccacaaagcgcuaag

SEQ ID NO: 44941 - RNA, 18 nt, Artificial Sequence
  Description of Artificial Sequence: Synthetic oligonucleotide
cucugaacccacaaagcg

SEQ ID NO: 44942 - RNA, 18 nt, Artificial Sequence
  Description of Artificial Sequence: Synthetic oligonucleotide
ccagccucugaacccaca

SEQ ID NO: 44943 - RNA, 18 nt, Artificial Sequence
  Description of Artificial Sequence: Synthetic oligonucleotide
ugcagccagccucugaac

SEQ ID NO: 44944 - RNA, 18 nt, Artificial Sequence
  Description of Artificial Sequence: Synthetic oligonucleotide
aacacugcagccagccuc

SEQ ID NO: 44945 - RNA, 18 nt, Artificial Sequence
  Description of Artificial Sequence: Synthetic oligonucleotide
ucauaaacacugcagcca

SEQ ID NO: 44946 - RNA, 18 nt, Artificial Sequence
  Description of Artificial Sequence: Synthetic oligonucleotide
ccucuucauaaacacugc

SEQ ID NO: 44947 - RNA, 18 nt, Artificial Sequence
  Description of Artificial Sequence: Synthetic oligonucleotide
cugccccucuucauaaac

SEQ ID NO: 44948 - RNA, 18 nt, Artificial Sequence
  Description of Artificial Sequence: Synthetic oligonucleotide
gcccacugccccucuuca

SEQ ID NO: 44949 - RNA, 18 nt, Artificial Sequence
  Description of Artificial Sequence: Synthetic oligonucleotide
ccccagcccacugccccu

SEQ ID NO: 44950 - RNA, 18 nt, Artificial Sequence
  Description of Artificial Sequence: Synthetic oligonucleotide
aguguccccagcccacug

SEQ ID NO: 44951 - RNA, 18 nt, Artificial Sequence
  Description of Artificial Sequence: Synthetic oligonucleotide
ccagcaguguccccagcc

SEQ ID NO: 44952 - RNA, 18 nt, Artificial Sequence
  Description of Artificial Sequence: Synthetic oligonucleotide
uaaccccagcaguguccc

SEQ ID NO: 44953 - RNA, 18 nt, Artificial Sequence
  Description of Artificial Sequence: Synthetic oligonucleotide
agccauaaccccagcagu

SEQ ID NO: 44954 - RNA, 18 nt, Artificial Sequence
  Description of Artificial Sequence: Synthetic oligonucleotide
acuacagccauaacccca

SEQ ID NO: 44955 - RNA, 18 nt, Artificial Sequence
  Description of Artificial Sequence: Synthetic oligonucleotide
accucacuacagccauaa

SEQ ID NO: 44956 - RNA, 18 nt, Artificial Sequence
  Description of Artificial Sequence: Synthetic oligonucleotide
cauggaccucacuacagc

SEQ ID NO: 44957 - RNA, 18 nt, Artificial Sequence
  Description of Artificial Sequence: Synthetic oligonucleotide
guacacauggaccucacu

SEQ ID NO: 44958 - RNA, 18 nt, Artificial Sequence
  Description of Artificial Sequence: Synthetic oligonucleotide
aacaaguacacauggacc

SEQ ID NO: 44959 - RNA, 18 nt, Artificial Sequence
  Description of Artificial Sequence: Synthetic oligonucleotide
caaggaacaaguacacau

SEQ ID NO: 44960 - RNA, 18 nt, Artificial Sequence
  Description of Artificial Sequence: Synthetic oligonucleotide
caugccaaggaacaagua

SEQ ID NO: 44961 - RNA, 18 nt, Artificial Sequence
  Description of Artificial Sequence: Synthetic oligonucleotide
agacacaugccaaggaac

SEQ ID NO: 44962 - RNA, 18 nt, Artificial Sequence
  Description of Artificial Sequence: Synthetic oligonucleotide
gagucagacacaugccaa

SEQ ID NO: 44963 - RNA, 18 nt, Artificial Sequence
  Description of Artificial Sequence: Synthetic oligonucleotide
acacagagucagacacau

SEQ ID NO: 44964 - RNA, 18 nt, Artificial Sequence
  Description of Artificial Sequence: Synthetic oligonucleotide
cagcaacacagagucaga

SEQ ID NO: 44965 - RNA, 18 nt, Artificial Sequence
  Description of Artificial Sequence: Synthetic oligonucleotide
ugcagcagcaacacagag

SEQ ID NO: 44966 - RNA, 18 nt, Artificial Sequence
  Description of Artificial Sequence: Synthetic oligonucleotide
uguacugcagcagcaaca

SEQ ID NO: 44967 - RNA, 18 nt, Artificial Sequence
  Description of Artificial Sequence: Synthetic oligonucleotide
cccacuguacugcagcag

SEQ ID NO: 44968 - RNA, 18 nt, Artificial Sequence
  Description of Artificial Sequence: Synthetic oligonucleotide
cccugcccacuguacugc

SEQ ID NO: 44969 - RNA, 18 nt, Artificial Sequence
  Description of Artificial Sequence: Synthetic oligonucleotide
cgugccccugcccacugu

SEQ ID NO: 44970 - RNA, 18 nt, Artificial Sequence
  Description of Artificial Sequence: Synthetic oligonucleotide
gcaaccgugccccugccc

SEQ ID NO: 44971 - RNA, 18 nt, Artificial Sequence
  Description of Artificial Sequence: Synthetic oligonucleotide
uccaagcaaccgugcccc

SEQ ID NO: 44972 - RNA, 18 nt, Artificial Sequence
  Description of Artificial Sequence: Synthetic oligonucleotide
cccaguccaagcaaccgu

SEQ ID NO: 44973 - RNA, 18 nt, Artificial Sequence
  Description of Artificial Sequence: Synthetic oligonucleotide
ggcagcccaguccaagca

SEQ ID NO: 44974 - RNA, 18 nt, Artificial Sequence
  Description of Artificial Sequence: Synthetic oligonucleotide
caucgggcagcccagucc

SEQ ID NO: 44975 - RNA, 18 nt, Artificial Sequence
  Description of Artificial Sequence: Synthetic oligonucleotide
ccagacaucgggcagccc

SEQ ID NO: 44976 - RNA, 18 nt, Artificial Sequence
  Description of Artificial Sequence: Synthetic oligonucleotide
ccaugccagacaucgggc

SEQ ID NO: 44977 - RNA, 18 nt, Artificial Sequence
  Description of Artificial Sequence: Synthetic oligonucleotide
accagccaugccagacau

SEQ ID NO: 44978 - RNA, 18 nt, Artificial Sequence
  Description of Artificial Sequence: Synthetic oligonucleotide
ggaccaccagccaugcca

SEQ ID NO: 44979 - RNA, 18 nt, Artificial Sequence
  Description of Artificial Sequence: Synthetic oligonucleotide
caacaggaccaccagcca

SEQ ID NO: 44980 - RNA, 18 nt, Artificial Sequence
  Description of Artificial Sequence: Synthetic oligonucleotide
aaggacaacaggaccacc

SEQ ID NO: 44981 - RNA, 18 nt, Artificial Sequence
  Description of Artificial Sequence: Synthetic oligonucleotide
aaauaaaggacaacagga

SEQ ID NO: 44982 - RNA, 18 nt, Artificial Sequence
  Description of Artificial Sequence: Synthetic oligonucleotide
cgaucaaauaaaggacaa

SEQ ID NO: 44983 - RNA, 18 nt, Artificial Sequence
  Description of Artificial Sequence: Synthetic oligonucleotide
gcuaucgaucaaauaaag

SEQ ID NO: 44984 - RNA, 18 nt, Artificial Sequence
  Description of Artificial Sequence: Synthetic oligonucleotide
ucccugcuaucgaucaaa

SEQ ID NO: 44985 - RNA, 18 nt, Artificial Sequence
  Description of Artificial Sequence: Synthetic oligonucleotide
ucaguucccugcuaucga

SEQ ID NO: 44986 - RNA, 18 nt, Artificial Sequence
  Description of Artificial Sequence: Synthetic oligonucleotide
ggcggucaguucccugcu

SEQ ID NO: 44987 - RNA, 18 nt, Artificial Sequence
  Description of Artificial Sequence: Synthetic oligonucleotide
accucggcggucaguucc

SEQ ID NO: 44988 - RNA, 18 nt, Artificial Sequence
  Description of Artificial Sequence: Synthetic oligonucleotide
ugccaaccucggcgguca

SEQ ID NO: 44989 - RNA, 18 nt, Artificial Sequence
  Description of Artificial Sequence: Synthetic oligonucleotide
accugugccaaccucggc

SEQ ID NO: 44990 - RNA, 18 nt, Artificial Sequence
  Description of Artificial Sequence: Synthetic oligonucleotide
ugccaaccugugccaacc

SEQ ID NO: 44991 - RNA, 18 nt, Artificial Sequence
  Description of Artificial Sequence: Synthetic oligonucleotide
cccccugccaaccugugc

SEQ ID NO: 44992 - RNA, 18 nt, Artificial Sequence
  Description of Artificial Sequence: Synthetic oligonucleotide
cucaucccccugccaacc

SEQ ID NO: 44993 - RNA, 18 nt, Artificial Sequence
  Description of Artificial Sequence: Synthetic oligonucleotide
gcauccucaucccccugc

SEQ ID NO: 44994 - RNA, 18 nt, Artificial Sequence
  Description of Artificial Sequence: Synthetic oligonucleotide
acaaugcauccucauccc

SEQ ID NO: 44995 - RNA, 18 nt, Artificial Sequence
  Description of Artificial Sequence: Synthetic oligonucleotide
caaccacaaugcauccuc

SEQ ID NO: 44996 - RNA, 18 nt, Artificial Sequence
  Description of Artificial Sequence: Synthetic oligonucleotide
ggagacaaccacaaugca

SEQ ID NO: 44997 - RNA, 18 nt, Artificial Sequence
  Description of Artificial Sequence: Synthetic oligonucleotide
gaggaggagacaaccaca

SEQ ID NO: 44998 - RNA, 18 nt, Artificial Sequence
  Description of Artificial Sequence: Synthetic oligonucleotide
gagaggaggaggagacaa

SEQ ID NO: 44999 - RNA, 18 nt, Artificial Sequence
  Description of Artificial Sequence: Synthetic oligonucleotide
agaaggagaggaggagga

SEQ ID NO: 45000 - RNA, 18 nt, Artificial Sequence
  Description of Artificial Sequence: Synthetic oligonucleotide
gaggaagaaggagaggag

SEQ ID NO: 45001 - RNA, 18 nt, Artificial Sequence
  Description of Artificial Sequence: Synthetic oligonucleotide
gggaagaggaagaaggag

SEQ ID NO: 45002 - RNA, 18 nt, Artificial Sequence
  Description of Artificial Sequence: Synthetic oligonucleotide
aaaggagaggaggaaggg

SEQ ID NO: 45003 - RNA, 18 nt, Artificial Sequence
  Description of Artificial Sequence: Synthetic oligonucleotide
agaaaggagaggaggaag

SEQ ID NO: 45004 - RNA, 18 nt, Artificial Sequence
  Description of Artificial Sequence: Synthetic oligonucleotide
agaacagaaaggagagga

SEQ ID NO: 45005 - RNA, 18 nt, Artificial Sequence
  Description of Artificial Sequence: Synthetic oligonucleotide
gaacaagaacagaaagga

SEQ ID NO: 45006 - RNA, 18 nt, Artificial Sequence
  Description of Artificial Sequence: Synthetic oligonucleotide
agggagaacaagaacaga

SEQ ID NO: 45007 - RNA, 18 nt, Artificial Sequence
  Description of Artificial Sequence: Synthetic oligonucleotide
agaugagggagaacaaga

SEQ ID NO: 45008 - RNA, 18 nt, Artificial Sequence
  Description of Artificial Sequence: Synthetic oligonucleotide
gaggaagaugagggagaa

SEQ ID NO: 45009 - RNA, 18 nt, Artificial Sequence
  Description of Artificial Sequence: Synthetic oligonucleotide
aggaagaggaagaugagg

SEQ ID NO: 45010 - RNA, 18 nt, Artificial Sequence
  Description of Artificial Sequence: Synthetic oligonucleotide
gaagaaggaagaggaaga

SEQ ID NO: 45011 - RNA, 18 nt, Artificial Sequence
  Description of Artificial Sequence: Synthetic oligonucleotide
agggagaagaaggaagag

SEQ ID NO: 45012 - RNA, 18 nt, Artificial Sequence
  Description of Artificial Sequence: Synthetic oligonucleotide
agaagagggagaagaagg

SEQ ID NO: 45013 - RNA, 18 nt, Artificial Sequence
  Description of Artificial Sequence: Synthetic oligonucleotide
gaggaagaagagggagaa

SEQ ID NO: 45014 - RNA, 18 nt, Artificial Sequence
  Description of Artificial Sequence: Synthetic oligonucleotide
gugaagaggaagaagagg

SEQ ID NO: 45015 - RNA, 18 nt, Artificial Sequence
  Description of Artificial Sequence: Synthetic oligonucleotide
gcagagugaagaggaaga

SEQ ID NO: 45016 - RNA, 18 nt, Artificial Sequence
  Description of Artificial Sequence: Synthetic oligonucleotide
agagagcagagugaagag

SEQ ID NO: 45017 - RNA, 18 nt, Artificial Sequence
  Description of Artificial Sequence: Synthetic oligonucleotide
agagaagagagcagagug

SEQ ID NO: 45018 - RNA, 18 nt, Artificial Sequence
  Description of Artificial Sequence: Synthetic oligonucleotide
aaagaagagaagagagca

SEQ ID NO: 45019 - RNA, 18 nt, Artificial Sequence
  Description of Artificial Sequence: Synthetic oligonucleotide
ugauucacuccgcuguga

SEQ ID NO: 45020 - RNA, 18 nt, Artificial Sequence
  Description of Artificial Sequence: Synthetic oligonucleotide
cgagcugauucacuccgc

SEQ ID NO: 45021 - RNA, 18 nt, Artificial Sequence
  Description of Artificial Sequence: Synthetic oligonucleotide
accaccgagcugauucac

SEQ ID NO: 45022 - RNA, 18 nt, Artificial Sequence
  Description of Artificial Sequence: Synthetic oligonucleotide
aagacaccaccgagcuga

SEQ ID NO: 45023 - RNA, 18 nt, Artificial Sequence
  Description of Artificial Sequence: Synthetic oligonucleotide
ugacaaagacaccaccga

SEQ ID NO: 45024 - RNA, 18 nt, Artificial Sequence
  Description of Artificial Sequence: Synthetic oligonucleotide
cccguugacaaagacacc

SEQ ID NO: 45025 - RNA, 18 nt, Artificial Sequence
  Description of Artificial Sequence: Synthetic oligonucleotide
ggccgcccguugacaaag

SEQ ID NO: 45026 - RNA, 18 nt, Artificial Sequence
  Description of Artificial Sequence: Synthetic oligonucleotide
gcaguggccgcccguuga

SEQ ID NO: 45027 - RNA, 18 nt, Artificial Sequence
  Description of Artificial Sequence: Synthetic oligonucleotide
guccggcaguggccgccc

SEQ ID NO: 45028 - RNA, 18 nt, Artificial Sequence
  Description of Artificial Sequence: Synthetic oligonucleotide
guggaguccggcaguggc

SEQ ID NO: 45029 - RNA, 18 nt, Artificial Sequence
  Description of Artificial Sequence: Synthetic oligonucleotide
gccggguggaguccggca

SEQ ID NO: 45030 - RNA, 18 nt, Artificial Sequence
  Description of Artificial Sequence: Synthetic oligonucleotide
cuucugccggguggaguc

SEQ ID NO: 45031 - RNA, 18 nt, Artificial Sequence
  Description of Artificial Sequence: Synthetic oligonucleotide
acaaucuucugccgggug

SEQ ID NO: 45032 - RNA, 18 nt, Artificial Sequence
  Description of Artificial Sequence: Synthetic oligonucleotide
gcucuacaaucuucugcc

SEQ ID NO: 45033 - RNA, 18 nt, Artificial Sequence
  Description of Artificial Sequence: Synthetic oligonucleotide
agcuagcucuacaaucuu

SEQ ID NO: 45034 - RNA, 18 nt, Artificial Sequence
  Description of Artificial Sequence: Synthetic oligonucleotide
cugugagcuagcucuaca

SEQ ID NO: 45035 - RNA, 18 nt, Artificial Sequence
  Description of Artificial Sequence: Synthetic oligonucleotide
ccccgcugugagcuagcu

SEQ ID NO: 45036 - RNA, 18 nt, Artificial Sequence
  Description of Artificial Sequence: Synthetic oligonucleotide
ccgggccccgcugugagc

SEQ ID NO: 45037 - RNA, 18 nt, Artificial Sequence
  Description of Artificial Sequence: Synthetic oligonucleotide
cacggccgggccccgcug

SEQ ID NO: 45038 - RNA, 18 nt, Artificial Sequence
  Description of Artificial Sequence: Synthetic oligonucleotide
ugucgcacggccgggccc

SEQ ID NO: 45039 - RNA, 18 nt, Artificial Sequence
  Description of Artificial Sequence: Synthetic oligonucleotide
ggaaaugucgcacggccg

SEQ ID NO: 45040 - RNA, 18 nt, Artificial Sequence
  Description of Artificial Sequence: Synthetic oligonucleotide
auucgggaaaugucgcac

SEQ ID NO: 45041 - RNA, 18 nt, Artificial Sequence
  Description of Artificial Sequence: Synthetic oligonucleotide
gcagaauucgggaaaugu

SEQ ID NO: 45042 - RNA, 18 nt, Artificial Sequence
  Description of Artificial Sequence: Synthetic oligonucleotide
gauucacuccgcugugac

SEQ ID NO: 45043 - RNA, 18 nt, Artificial Sequence
  Description of Artificial Sequence: Synthetic oligonucleotide
gagcugauucacuccgcu

SEQ ID NO: 45044 - RNA, 18 nt, Artificial Sequence
  Description of Artificial Sequence: Synthetic oligonucleotide
ccaccgagcugauucacu

SEQ ID NO: 45045 - RNA, 18 nt, Artificial Sequence
  Description of Artificial Sequence: Synthetic oligonucleotide
agacaccaccgagcugau

SEQ ID NO: 45046 - RNA, 18 nt, Artificial Sequence
  Description of Artificial Sequence: Synthetic oligonucleotide
gacaaagacaccaccgag

SEQ ID NO: 45047 - RNA, 18 nt, Artificial Sequence
  Description of Artificial Sequence: Synthetic oligonucleotide
ccguugacaaagacacca

SEQ ID NO: 45048 - RNA, 18 nt, Artificial Sequence
  Description of Artificial Sequence: Synthetic oligonucleotide
gccgcccguugacaaaga

SEQ ID NO: 45049 - RNA, 18 nt, Artificial Sequence
  Description of Artificial Sequence: Synthetic oligonucleotide
caguggccgcccguugac

SEQ ID NO: 45050 - RNA, 18 nt, Artificial Sequence
  Description of Artificial Sequence: Synthetic oligonucleotide
uccggcaguggccgcccg

SEQ ID NO: 45051 - RNA, 18 nt, Artificial Sequence
  Description of Artificial Sequence: Synthetic oligonucleotide
uggaguccggcaguggcc

SEQ ID NO: 45052 - RNA, 18 nt, Artificial Sequence
  Description of Artificial Sequence: Synthetic oligonucleotide
ccggguggaguccggcag

SEQ ID NO: 45053 - RNA, 18 nt, Artificial Sequence
  Description of Artificial Sequence: Synthetic oligonucleotide
uucugccggguggagucc

SEQ ID NO: 45054 - RNA, 18 nt, Artificial Sequence
  Description of Artificial Sequence: Synthetic oligonucleotide
caaucuucugccgggugg

SEQ ID NO: 45055 - RNA, 18 nt, Artificial Sequence
  Description of Artificial Sequence: Synthetic oligonucleotide
cucuacaaucuucugccg

SEQ ID NO: 45056 - RNA, 18 nt, Artificial Sequence
  Description of Artificial Sequence: Synthetic oligonucleotide
gcuagcucuacaaucuuc

SEQ ID NO: 45057 - RNA, 18 nt, Artificial Sequence
  Description of Artificial Sequence: Synthetic oligonucleotide
ugugagcuagcucuacaa

SEQ ID NO: 45058 - RNA, 18 nt, Artificial Sequence
  Description of Artificial Sequence: Synthetic oligonucleotide
cccgcugugagcuagcuc

SEQ ID NO: 45059 - RNA, 18 nt, Artificial Sequence
  Description of Artificial Sequence: Synthetic oligonucleotide
cgggccccgcugugagcu

SEQ ID NO: 45060 - RNA, 18 nt, Artificial Sequence
  Description of Artificial Sequence: Synthetic oligonucleotide
acggccgggccccgcugu

SEQ ID NO: 45061 - RNA, 18 nt, Artificial Sequence
  Description of Artificial Sequence: Synthetic oligonucleotide
gucgcacggccgggcccc

SEQ ID NO: 45062 - RNA, 18 nt, Artificial Sequence
  Description of Artificial Sequence: Synthetic oligonucleotide
gaaaugucgcacggccgg

SEQ ID NO: 45063 - RNA, 18 nt, Artificial Sequence
  Description of Artificial Sequence: Synthetic oligonucleotide
uucgggaaaugucgcacg

SEQ ID NO: 45064 - RNA, 18 nt, Artificial Sequence
  Description of Artificial Sequence: Synthetic oligonucleotide
cagaauucgggaaauguc

SEQ ID NO: 45065 - RNA, 18 nt, Artificial Sequence
  Description of Artificial Sequence: Synthetic oligonucleotide
gggcggcgccgggaggau

SEQ ID NO: 45066 - RNA, 18 nt, Artificial Sequence
  Description of Artificial Sequence: Synthetic oligonucleotide
agaguggagggccgcggg

SEQ ID NO: 45067 - RNA, 18 nt, Artificial Sequence
  Description of Artificial Sequence: Synthetic oligonucleotide
cguugagaguggagggcc

SEQ ID NO: 45068 - RNA, 18 nt, Artificial Sequence
  Description of Artificial Sequence: Synthetic oligonucleotide
gagggcguugagagugga

SEQ ID NO: 45069 - RNA, 18 nt, Artificial Sequence
  Description of Artificial Sequence: Synthetic oligonucleotide
gaagagagggcguugaga

SEQ ID NO: 45070 - RNA, 18 nt, Artificial Sequence
  Description of Artificial Sequence: Synthetic oligonucleotide
gaaaugaagagagggcgu

SEQ ID NO: 45071 - RNA, 18 nt, Artificial Sequence
  Description of Artificial Sequence: Synthetic oligonucleotide
aguaagaaaugaagagag

SEQ ID NO: 45072 - RNA, 18 nt, Artificial Sequence
  Description of Artificial Sequence: Synthetic oligonucleotide
uuuacaguaagaaaugaa

SEQ ID NO: 45073 - RNA, 18 nt, Artificial Sequence
  Description of Artificial Sequence: Synthetic oligonucleotide
caucguuuacaguaagaa

SEQ ID NO: 45074 - RNA, 18 nt, Artificial Sequence
  Description of Artificial Sequence: Synthetic oligonucleotide
auuagcaucguuuacagu

SEQ ID NO: 45075 - RNA, 18 nt, Artificial Sequence
  Description of Artificial Sequence: Synthetic oligonucleotide
ccauaauuagcaucguuu

SEQ ID NO: 45076 - RNA, 18 nt, Artificial Sequence
  Description of Artificial Sequence: Synthetic oligonucleotide
ggguccauaauuagcauc

SEQ ID NO: 45077 - RNA, 18 nt, Artificial Sequence
  Description of Artificial Sequence: Synthetic oligonucleotide
gaaagugggaaggcaggg

SEQ ID NO: 45078 - RNA, 18 nt, Artificial Sequence
  Description of Artificial Sequence: Synthetic oligonucleotide
gggaaagugggaaggcag

SEQ ID NO: 45079 - RNA, 18 nt, Artificial Sequence
  Description of Artificial Sequence: Synthetic oligonucleotide
gaugguggaaggagaggg

SEQ ID NO: 45080 - RNA, 18 nt, Artificial Sequence
  Description of Artificial Sequence: Synthetic oligonucleotide
ggaaggaugguggaagga

SEQ ID NO: 45081 - RNA, 18 nt, Artificial Sequence
  Description of Artificial Sequence: Synthetic oligonucleotide
gauagggaaggauggugg

SEQ ID NO: 45082 - RNA, 18 nt, Artificial Sequence
  Description of Artificial Sequence: Synthetic oligonucleotide
aaagagauagggaaggau

SEQ ID NO: 45083 - RNA, 18 nt, Artificial Sequence
  Description of Artificial Sequence: Synthetic oligonucleotide
gguugaaagagauaggga

SEQ ID NO: 45084 - RNA, 18 nt, Artificial Sequence
  Description of Artificial Sequence: Synthetic oligonucleotide
acccagguugaaagagau

SEQ ID NO: 45085 - RNA, 18 nt, Artificial Sequence
  Description of Artificial Sequence: Synthetic oligonucleotide
aacugacccagguugaaa

SEQ ID NO: 45086 - RNA, 18 nt, Artificial Sequence
  Description of Artificial Sequence: Synthetic oligonucleotide
uauguaacugacccaggu

SEQ ID NO: 45087 - RNA, 18 nt, Artificial Sequence
  Description of Artificial Sequence: Synthetic oligonucleotide
uaucuuauguaacugacc

SEQ ID NO: 45088 - RNA, 18 nt, Artificial Sequence
  Description of Artificial Sequence: Synthetic oligonucleotide
ugaguuaucuuauguaac

SEQ ID NO: 45089 - RNA, 18 nt, Artificial Sequence
  Description of Artificial Sequence: Synthetic oligonucleotide
gcagaugaguuaucuuau

SEQ ID NO: 45090 - RNA, 18 nt, Artificial Sequence
  Description of Artificial Sequence: Synthetic oligonucleotide
cugaagcagaugaguuau

SEQ ID NO: 45091 - RNA, 18 nt, Artificial Sequence
  Description of Artificial Sequence: Synthetic oligonucleotide
uuuuucugaagcagauga

SEQ ID NO: 45092 - RNA, 18 nt, Artificial Sequence
  Description of Artificial Sequence: Synthetic oligonucleotide
caauauuuuucugaagca

SEQ ID NO: 45093 - RNA, 18 nt, Artificial Sequence
  Description of Artificial Sequence: Synthetic oligonucleotide
gcacacaauauuuuucug

SEQ ID NO: 45094 - RNA, 18 nt, Artificial Sequence
  Description of Artificial Sequence: Synthetic oligonucleotide
aauccgcacacaauauuu

SEQ ID NO: 45095 - RNA, 18 nt, Artificial Sequence
  Description of Artificial Sequence: Synthetic oligonucleotide
aaaaaaauccgcacacaa

SEQ ID NO: 45096 - RNA, 18 nt, Artificial Sequence
  Description of Artificial Sequence: Synthetic oligonucleotide
uuuuuaaaaaaauccgca

SEQ ID NO: 45097 - RNA, 18 nt, Artificial Sequence
  Description of Artificial Sequence: Synthetic oligonucleotide
agauuuuuuuaaaaaaau

SEQ ID NO: 45098 - RNA, 18 nt, Artificial Sequence
  Description of Artificial Sequence: Synthetic oligonucleotide
gagaaagauuuuuuuaaa

SEQ ID NO: 45099 - RNA, 18 nt, Artificial Sequence
  Description of Artificial Sequence: Synthetic oligonucleotide
aaaaagagaaagauuuuu

SEQ ID NO: 45100 - RNA, 18 nt, Artificial Sequence
  Description of Artificial Sequence: Synthetic oligonucleotide
caaauaaaaagagaaaga

SEQ ID NO: 45101 - RNA, 18 nt, Artificial Sequence
  Description of Artificial Sequence: Synthetic oligonucleotide
uuuaccaaauaaaaagag

SEQ ID NO: 45102 - RNA, 18 nt, Artificial Sequence
  Description of Artificial Sequence: Synthetic oligonucleotide
augucuuuaccaaauaaa

SEQ ID NO: 45103 - RNA, 18 nt, Artificial Sequence
  Description of Artificial Sequence: Synthetic oligonucleotide
aaugaaugucuuuaccaa

SEQ ID NO: 45104 - RNA, 18 nt, Artificial Sequence
  Description of Artificial Sequence: Synthetic oligonucleotide
cccacaaugaaugucuuu

SEQ ID NO: 45105 - RNA, 18 nt, Artificial Sequence
  Description of Artificial Sequence: Synthetic oligonucleotide
cuguucccacaaugaaug

SEQ ID NO: 45106 - RNA, 18 nt, Artificial Sequence
  Description of Artificial Sequence: Synthetic oligonucleotide
auaaacuguucccacaau

SEQ ID NO: 45107 - RNA, 18 nt, Artificial Sequence
  Description of Artificial Sequence: Synthetic oligonucleotide
gguucauaaacuguuccc

SEQ ID NO: 45108 - RNA, 18 nt, Artificial Sequence
  Description of Artificial Sequence: Synthetic oligonucleotide
auuacgguucauaaacug

SEQ ID NO: 45109 - RNA, 18 nt, Artificial Sequence
  Description of Artificial Sequence: Synthetic oligonucleotide
agcuuauuacgguucaua

SEQ ID NO: 45110 - RNA, 18 nt, Artificial Sequence
  Description of Artificial Sequence: Synthetic oligonucleotide
aacucagcuuauuacggu

SEQ ID NO: 45111 - RNA, 18 nt, Artificial Sequence
  Description of Artificial Sequence: Synthetic oligonucleotide
uauauaacucagcuuauu

SEQ ID NO: 45112 - RNA, 18 nt, Artificial Sequence
  Description of Artificial Sequence: Synthetic oligonucleotide
cgguuuauauaacucagc

SEQ ID NO: 45113 - RNA, 18 nt, Artificial Sequence
  Description of Artificial Sequence: Synthetic oligonucleotide
uaugccgguuuauauaac

SEQ ID NO: 45114 - RNA, 18 nt, Artificial Sequence
  Description of Artificial Sequence: Synthetic oligonucleotide
gaaauuaugccgguuuau

SEQ ID NO: 45115 - RNA, 18 nt, Artificial Sequence
  Description of Artificial Sequence: Synthetic oligonucleotide
agaaugaaauuaugccgg

SEQ ID NO: 45116 - RNA, 18 nt, Artificial Sequence
  Description of Artificial Sequence: Synthetic oligonucleotide
agagcagaaugaaauuau

SEQ ID NO: 45117 - RNA, 18 nt, Artificial Sequence
  Description of Artificial Sequence: Synthetic oligonucleotide
gggagagcagaaugaaau

SEQ ID NO: 45118 - RNA, 18 nt, Artificial Sequence
  Description of Artificial Sequence: Synthetic oligonucleotide
agguaagcaugggcuggg

SEQ ID NO: 45119 - RNA, 18 nt, Artificial Sequence
  Description of Artificial Sequence: Synthetic oligonucleotide
agcugagguaagcauggg

SEQ ID NO: 45120 - RNA, 18 nt, Artificial Sequence
  Description of Artificial Sequence: Synthetic oligonucleotide
ucaaaagcugagguaagc

SEQ ID NO: 45121 - RNA, 18 nt, Artificial Sequence
  Description of Artificial Sequence: Synthetic oligonucleotide
auaccucaaaagcugagg

SEQ ID NO: 45122 - RNA, 18 nt, Artificial Sequence
  Description of Artificial Sequence: Synthetic oligonucleotide
aacaaauaccucaaaagc

SEQ ID NO: 45123 - RNA, 18 nt, Artificial Sequence
  Description of Artificial Sequence: Synthetic oligonucleotide
gaauaaacaaauaccuca

SEQ ID NO: 45124 - RNA, 18 nt, Artificial Sequence
  Description of Artificial Sequence: Synthetic oligonucleotide
augaagaauaaacaaaua

SEQ ID NO: 45125 - RNA, 18 nt, Artificial Sequence
  Description of Artificial Sequence: Synthetic oligonucleotide
uaaacaugaagaauaaac

SEQ ID NO: 45126 - RNA, 18 nt, Artificial Sequence
  Description of Artificial Sequence: Synthetic oligonucleotide
auucauaaacaugaagaa

SEQ ID NO: 45127 - RNA, 18 nt, Artificial Sequence
  Description of Artificial Sequence: Synthetic oligonucleotide
auauuauucauaaacaug

SEQ ID NO: 45128 - RNA, 18 nt, Artificial Sequence
  Description of Artificial Sequence: Synthetic oligonucleotide
aauauauauuauucauaa

SEQ ID NO: 45129 - RNA, 18 nt, Artificial Sequence
  Description of Artificial Sequence: Synthetic oligonucleotide
aaaucaauauauauuauu

SEQ ID NO: 45130 - RNA, 18 nt, Artificial Sequence
  Description of Artificial Sequence: Synthetic oligonucleotide
uuuuaaaaucaauauaua

SEQ ID NO: 45131 - RNA, 18 nt, Artificial Sequence
  Description of Artificial Sequence: Synthetic oligonucleotide
uugccuuuuaaaaucaau

SEQ ID NO: 45132 - RNA, 18 nt, Artificial Sequence
  Description of Artificial Sequence: Synthetic oligonucleotide
agcauuugccuuuuaaaa

SEQ ID NO: 45133 - RNA, 18 nt, Artificial Sequence
  Description of Artificial Sequence: Synthetic oligonucleotide
uaaauagcauuugccuuu

SEQ ID NO: 45134 - RNA, 18 nt, Artificial Sequence
  Description of Artificial Sequence: Synthetic oligonucleotide
aggaguaaauagcauuug

SEQ ID NO: 45135 - RNA, 18 nt, Artificial Sequence
  Description of Artificial Sequence: Synthetic oligonucleotide
uagggaggaguaaauagc

SEQ ID NO: 45136 - RNA, 18 nt, Artificial Sequence
  Description of Artificial Sequence: Synthetic oligonucleotide
ugaguuagggaggaguaa

SEQ ID NO: 45137 - RNA, 18 nt, Artificial Sequence
  Description of Artificial Sequence: Synthetic oligonucleotide
aaaugugaguuagggagg

SEQ ID NO: 45138 - RNA, 18 nt, Artificial Sequence
  Description of Artificial Sequence: Synthetic oligonucleotide
ugaguaaaugugaguuag

SEQ ID NO: 45139 - RNA, 18 nt, Artificial Sequence
  Description of Artificial Sequence: Synthetic oligonucleotide
ucaauugaguaaauguga

SEQ ID NO: 45140 - RNA, 18 nt, Artificial Sequence
  Description of Artificial Sequence: Synthetic oligonucleotide
aauacucaauugaguaaa

SEQ ID NO: 45141 - RNA, 18 nt, Artificial Sequence
  Description of Artificial Sequence: Synthetic oligonucleotide
agcauuugccuuuuaaaa

SEQ ID NO: 45142 - RNA, 18 nt, Artificial Sequence
  Description of Artificial Sequence: Synthetic oligonucleotide
uaaauagcauuugccuuu

SEQ ID NO: 45143 - RNA, 18 nt, Artificial Sequence
  Description of Artificial Sequence: Synthetic oligonucleotide
aggaguaaauagcauuug

SEQ ID NO: 45144 - RNA, 18 nt, Artificial Sequence
  Description of Artificial Sequence: Synthetic oligonucleotide
uagggaggaguaaauagc

SEQ ID NO: 45145 - RNA, 18 nt, Artificial Sequence
  Description of Artificial Sequence: Synthetic oligonucleotide
ugaguuagggaggaguaa

SEQ ID NO: 45146 - RNA, 18 nt, Artificial Sequence
  Description of Artificial Sequence: Synthetic oligonucleotide
aaaugugaguuagggagg

SEQ ID NO: 45147 - RNA, 18 nt, Artificial Sequence
  Description of Artificial Sequence: Synthetic oligonucleotide
ugaguaaaugugaguuag

SEQ ID NO: 45148 - RNA, 18 nt, Artificial Sequence
  Description of Artificial Sequence: Synthetic oligonucleotide
ucaauugaguaaauguga

SEQ ID NO: 45149 - RNA, 18 nt, Artificial Sequence
  Description of Artificial Sequence: Synthetic oligonucleotide
aauacucaauugaguaaa

SEQ ID NO: 45150 - RNA, 18 nt, Artificial Sequence
  Description of Artificial Sequence: Synthetic oligonucleotide
uaaaaaauacucaauuga

SEQ ID NO: 45151 - RNA, 18 nt, Artificial Sequence
  Description of Artificial Sequence: Synthetic oligonucleotide
uucuuuaaaaaauacuca

SEQ ID NO: 45152 - RNA, 18 nt, Artificial Sequence
  Description of Artificial Sequence: Synthetic oligonucleotide
ucuucuucuuuaaaaaau

SEQ ID NO: 45153 - RNA, 18 nt, Artificial Sequence
  Description of Artificial Sequence: Synthetic oligonucleotide
uuacuucuucuucuuuaa

SEQ ID NO: 45154 - RNA, 18 nt, Artificial Sequence
  Description of Artificial Sequence: Synthetic oligonucleotide
uuuuuuuacuucuucuuc

SEQ ID NO: 45155 - RNA, 18 nt, Artificial Sequence
  Description of Artificial Sequence: Synthetic oligonucleotide
acugauuuuuuuacuucu

SEQ ID NO: 45156 - RNA, 18 nt, Artificial Sequence
  Description of Artificial Sequence: Synthetic oligonucleotide
aauaaacugauuuuuuua

SEQ ID NO: 45157 - RNA, 18 nt, Artificial Sequence
  Description of Artificial Sequence: Synthetic oligonucleotide
uaaaaaauaaacugauuu

SEQ ID NO: 45158 - RNA, 18 nt, Artificial Sequence
  Description of Artificial Sequence: Synthetic oligonucleotide
aaagguaaaaaauaaacu

SEQ ID NO: 45159 - RNA, 18 nt, Artificial Sequence
  Description of Artificial Sequence: Synthetic oligonucleotide
agaacaaagguaaaaaau

SEQ ID NO: 45160 - RNA, 18 nt, Artificial Sequence
  Description of Artificial Sequence: Synthetic oligonucleotide
uuuaaagaacaaagguaa

SEQ ID NO: 45161 - RNA, 18 nt, Artificial Sequence
  Description of Artificial Sequence: Synthetic oligonucleotide
uauguuuuaaagaacaaa

SEQ ID NO: 45162 - RNA, 18 nt, Artificial Sequence
  Description of Artificial Sequence: Synthetic oligonucleotide
ggcguuauguuuuaaaga

SEQ ID NO: 45163 - RNA, 18 nt, Artificial Sequence
  Description of Artificial Sequence: Synthetic oligonucleotide
aaaguggcguuauguuuu

SEQ ID NO: 45164 - RNA, 18 nt, Artificial Sequence
  Description of Artificial Sequence: Synthetic oligonucleotide
ugcuuaaaguggcguuau

SEQ ID NO: 45165 - RNA, 18 nt, Artificial Sequence
  Description of Artificial Sequence: Synthetic oligonucleotide
gaccuugcuuaaaguggc

SEQ ID NO: 45166 - RNA, 18 nt, Artificial Sequence
  Description of Artificial Sequence: Synthetic oligonucleotide
gugcugaccuugcuuaaa

SEQ ID NO: 45167 - RNA, 18 nt, Artificial Sequence
  Description of Artificial Sequence: Synthetic oligonucleotide
uuuuugugcugaccuugc

SEQ ID NO: 45168 - RNA, 18 nt, Artificial Sequence
  Description of Artificial Sequence: Synthetic oligonucleotide
auuuauuuuugugcugac

SEQ ID NO: 45169 - RNA, 18 nt, Artificial Sequence
  Description of Artificial Sequence: Synthetic oligonucleotide
gauaaauuuauuuuugug

SEQ ID NO: 45170 - RNA, 18 nt, Artificial Sequence
  Description of Artificial Sequence: Synthetic oligonucleotide
aaguagauaaauuuauuu

SEQ ID NO: 45171 - RNA, 18 nt, Artificial Sequence
  Description of Artificial Sequence: Synthetic oligonucleotide
aaacgaaguagauaaauu

SEQ ID NO: 45172 - RNA, 18 nt, Artificial Sequence
  Description of Artificial Sequence: Synthetic oligonucleotide
caucaaaacgaaguagau

SEQ ID NO: 45173 - RNA, 18 nt, Artificial Sequence
  Description of Artificial Sequence: Synthetic oligonucleotide
agaugcaucaaaacgaag

SEQ ID NO: 45174 - RNA, 18 nt, Artificial Sequence
  Description of Artificial Sequence: Synthetic oligonucleotide
ccugaagaugcaucaaaa

SEQ ID NO: 45175 - RNA, 18 nt, Artificial Sequence
  Description of Artificial Sequence: Synthetic oligonucleotide
cacugccugaagaugcau

SEQ ID NO: 45176 - RNA, 18 nt, Artificial Sequence
  Description of Artificial Sequence: Synthetic oligonucleotide
uuaaacacugccugaaga

SEQ ID NO: 45177 - RNA, 18 nt, Artificial Sequence
  Description of Artificial Sequence: Synthetic oligonucleotide
uuuucuuaaacacugccu

SEQ ID NO: 45178 - RNA, 18 nt, Artificial Sequence
  Description of Artificial Sequence: Synthetic oligonucleotide
aaaacuuuucuuaaacac

SEQ ID NO: 45179 - RNA, 18 nt, Artificial Sequence
  Description of Artificial Sequence: Synthetic oligonucleotide
aaaaaaaaacuuuucuua

SEQ ID NO: 45180 - RNA, 18 nt, Artificial Sequence
  Description of Artificial Sequence: Synthetic oligonucleotide
uuuuaaaaaaaaaacuuu

SEQ ID NO: 45181 - RNA, 18 nt, Artificial Sequence
  Description of Artificial Sequence: Synthetic oligonucleotide
gcuuuuuuuaaaaaaaaa

SEQ ID NO: 45182 - RNA, 18 nt, Artificial Sequence
  Description of Artificial Sequence: Synthetic oligonucleotide
uaaaagcuuuuuuuaaaa

SEQ ID NO: 45183 - RNA, 18 nt, Artificial Sequence
  Description of Artificial Sequence: Synthetic oligonucleotide
gaauuuaaaagcuuuuuu

SEQ ID NO: 45184 - RNA, 18 nt, Artificial Sequence
  Description of Artificial Sequence: Synthetic oligonucleotide
aaaacgaauuuaaaagcu

SEQ ID NO: 45185 - RNA, 18 nt, Artificial Sequence
  Description of Artificial Sequence: Synthetic oligonucleotide
acuaaaaaacgaauuuaa

SEQ ID NO: 45186 - RNA, 18 nt, Artificial Sequence
  Description of Artificial Sequence: Synthetic oligonucleotide
uuugaacuaaaaaacgaa

SEQ ID NO: 45187 - RNA, 18 nt, Artificial Sequence
  Description of Artificial Sequence: Synthetic oligonucleotide
aacaauuugaacuaaaaa

SEQ ID NO: 45188 - RNA, 18 nt, Artificial Sequence
  Description of Artificial Sequence: Synthetic oligonucleotide
uuucaaacaauuugaacu

SEQ ID NO: 45189 - RNA, 18 nt, Artificial Sequence
  Description of Artificial Sequence: Synthetic oligonucleotide
gauacuuucaaacaauuu

SEQ ID NO: 45190 - RNA, 18 nt, Artificial Sequence
  Description of Artificial Sequence: Synthetic oligonucleotide
augaugauacuuucaaac

SEQ ID NO: 45191 - RNA, 18 nt, Artificial Sequence
  Description of Artificial Sequence: Synthetic oligonucleotide
caaauaugaugauacuuu

SEQ ID NO: 45192 - RNA, 18 nt, Artificial Sequence
  Description of Artificial Sequence: Synthetic oligonucleotide
aacuacaaauaugaugau

SEQ ID NO: 45193 - RNA, 18 nt, Artificial Sequence
  Description of Artificial Sequence: Synthetic oligonucleotide
cuaaaaacuacaaauaug

SEQ ID NO: 45194 - RNA, 18 nt, Artificial Sequence
  Description of Artificial Sequence: Synthetic oligonucleotide
uagcccuaaaaacuacaa

SEQ ID NO: 45195 - RNA, 18 nt, Artificial Sequence
  Description of Artificial Sequence: Synthetic oligonucleotide
auuuguagcccuaaaaac

SEQ ID NO: 45196 - RNA, 18 nt, Artificial Sequence
  Description of Artificial Sequence: Synthetic oligonucleotide
auuacauuuguagcccua

SEQ ID NO: 45197 - RNA, 18 nt, Artificial Sequence
  Description of Artificial Sequence: Synthetic oligonucleotide
uuaaaauuacauuuguag

SEQ ID NO: 45198 - RNA, 18 nt, Artificial Sequence
  Description of Artificial Sequence: Synthetic oligonucleotide
uuuucuuaaaauuacauu

SEQ ID NO: 45199 - RNA, 18 nt, Artificial Sequence
  Description of Artificial Sequence: Synthetic oligonucleotide
gcuuuuuuucuuaaaauu

SEQ ID NO: 45200 - RNA, 18 nt, Artificial Sequence
  Description of Artificial Sequence: Synthetic oligonucleotide
agagagcuuuuuuucuua

SEQ ID NO: 45201 - RNA, 18 nt, Artificial Sequence
  Description of Artificial Sequence: Synthetic oligonucleotide
acuguagagagcuuuuuu

SEQ ID NO: 45202 - RNA, 18 nt, Artificial Sequence
  Description of Artificial Sequence: Synthetic oligonucleotide
aacuuacuguagagagcu

SEQ ID NO: 45203 - RNA, 18 nt, Artificial Sequence
  Description of Artificial Sequence: Synthetic oligonucleotide
augagaacuuacuguaga

SEQ ID NO: 45204 - RNA, 18 nt, Artificial Sequence
  Description of Artificial Sequence: Synthetic oligonucleotide
augguaugagaacuuacu

SEQ ID NO: 45205 - RNA, 18 nt, Artificial Sequence
  Description of Artificial Sequence: Synthetic oligonucleotide
cuucaaugguaugagaac

SEQ ID NO: 45206 - RNA, 18 nt, Artificial Sequence
  Description of Artificial Sequence: Synthetic oligonucleotide
uauaccuucaaugguaug

SEQ ID NO: 45207 - RNA, 18 nt, Artificial Sequence
  Description of Artificial Sequence: Synthetic oligonucleotide
aaaaauauaccuucaaug

SEQ ID NO: 45208 - RNA, 18 nt, Artificial Sequence
  Description of Artificial Sequence: Synthetic oligonucleotide
aacacaaaaauauaccuu

SEQ ID NO: 45209 - RNA, 18 nt, Artificial Sequence
  Description of Artificial Sequence: Synthetic oligonucleotide
ucuauaacacaaaaauau

SEQ ID NO: 45210 - RNA, 18 nt, Artificial Sequence
  Description of Artificial Sequence: Synthetic oligonucleotide
augggucuauaacacaaa

SEQ ID NO: 45211 - RNA, 18 nt, Artificial Sequence
  Description of Artificial Sequence: Synthetic oligonucleotide
ucugcaugggucuauaac

SEQ ID NO: 45212 - RNA, 18 nt, Artificial Sequence
  Description of Artificial Sequence: Synthetic oligonucleotide
uugcaucugcaugggucu

SEQ ID NO: 45213 - RNA, 18 nt, Artificial Sequence
  Description of Artificial Sequence: Synthetic oligonucleotide
gacuuuugcaucugcaug

SEQ ID NO: 45214 - RNA, 18 nt, Artificial Sequence
  Description of Artificial Sequence: Synthetic oligonucleotide
acuuggacuuuugcaucu

SEQ ID NO: 45215 - RNA, 18 nt, Artificial Sequence
  Description of Artificial Sequence: Synthetic oligonucleotide
ccagcacuuggacuuuug

SEQ ID NO: 45216 - RNA, 18 nt, Artificial Sequence
  Description of Artificial Sequence: Synthetic oligonucleotide
auuguccagcacuuggac

SEQ ID NO: 45217 - RNA, 18 nt, Artificial Sequence
  Description of Artificial Sequence: Synthetic oligonucleotide
uuuugauuguccagcacu

SEQ ID NO: 45218 - RNA, 18 nt, Artificial Sequence
  Description of Artificial Sequence: Synthetic oligonucleotide
uuacguuuugauugucca

SEQ ID NO: 45219 - RNA, 18 nt, Artificial Sequence
  Description of Artificial Sequence: Synthetic oligonucleotide
caagcuuacguuuugauu

SEQ ID NO: 45220 - RNA, 18 nt, Artificial Sequence
  Description of Artificial Sequence: Synthetic oligonucleotide
aaugacaagcuuacguuu

SEQ ID NO: 45221 - RNA, 18 nt, Artificial Sequence
  Description of Artificial Sequence: Synthetic oligonucleotide
uaaacaaugacaagcuua

SEQ ID NO: 45222 - RNA, 18 nt, Artificial Sequence
  Description of Artificial Sequence: Synthetic oligonucleotide
ugcauuaaacaaugacaa

SEQ ID NO: 45223 - RNA, 18 nt, Artificial Sequence
  Description of Artificial Sequence: Synthetic oligonucleotide
aaguaugcauuaaacaau

SEQ ID NO: 45224 - RNA, 18 nt, Artificial Sequence
  Description of Artificial Sequence: Synthetic oligonucleotide
uguuuaaguaugcauuaa

SEQ ID NO: 45225 - RNA, 18 nt, Artificial Sequence
  Description of Artificial Sequence: Synthetic oligonucleotide
aaaauuguuuaaguaugc

SEQ ID NO: 45226 - RNA, 18 nt, Artificial Sequence
  Description of Artificial Sequence: Synthetic oligonucleotide
aaaauaaaauuguuuaag

SEQ ID NO: 45227 - RNA, 18 nt, Artificial Sequence
  Description of Artificial Sequence: Synthetic oligonucleotide
agacaaaaauaaaauugu

SEQ ID NO: 45228 - RNA, 18 nt, Artificial Sequence
  Description of Artificial Sequence: Synthetic oligonucleotide
uuucaagacaaaaauaaa

SEQ ID NO: 45229 - RNA, 18 nt, Artificial Sequence
  Description of Artificial Sequence: Synthetic oligonucleotide
aauaauuucaagacaaaa

SEQ ID NO: 45230 - RNA, 18 nt, Artificial Sequence
  Description of Artificial Sequence: Synthetic oligonucleotide
uuauuaauaauuucaaga

SEQ ID NO: 45231 - RNA, 18 nt, Artificial Sequence
  Description of Artificial Sequence: Synthetic oligonucleotide
ccacauuauuaauaauuu

SEQ ID NO: 45232 - RNA, 18 nt, Artificial Sequence
  Description of Artificial Sequence: Synthetic oligonucleotide
gaaaaccacauuauuaau

SEQ ID NO: 45233 - RNA, 18 nt, Artificial Sequence
  Description of Artificial Sequence: Synthetic oligonucleotide
ggacagaaaaccacauua

SEQ ID NO: 45234 - RNA, 18 nt, Artificial Sequence
  Description of Artificial Sequence: Synthetic oligonucleotide
ucacacauccguuggaca

SEQ ID NO: 45235 - RNA, 18 nt, Artificial Sequence
  Description of Artificial Sequence: Synthetic oligonucleotide
uuuacucacacauccguu

SEQ ID NO: 45236 - RNA, 18 nt, Artificial Sequence
  Description of Artificial Sequence: Synthetic oligonucleotide
agaauuuuacucacacau

SEQ ID NO: 45237 - RNA, 18 nt, Artificial Sequence
  Description of Artificial Sequence: Synthetic oligonucleotide
ugcccagaauuuuacuca

SEQ ID NO: 45238 - RNA, 18 nt, Artificial Sequence
  Description of Artificial Sequence: Synthetic oligonucleotide
auaccugcccagaauuuu

SEQ ID NO: 45239 - RNA, 18 nt, Artificial Sequence
  Description of Artificial Sequence: Synthetic oligonucleotide
ucguaauaccugcccaga

SEQ ID NO: 45240 - RNA, 18 nt, Artificial Sequence
  Description of Artificial Sequence: Synthetic oligonucleotide
cagucucguaauaccugc

SEQ ID NO: 45241 - RNA, 18 nt, Artificial Sequence
  Description of Artificial Sequence: Synthetic oligonucleotide
ggagccagucucguaaua

SEQ ID NO: 45242 - RNA, 18 nt, Artificial Sequence
  Description of Artificial Sequence: Synthetic oligonucleotide
cugauggagccagucucg

SEQ ID NO: 45243 - RNA, 18 nt, Artificial Sequence
  Description of Artificial Sequence: Synthetic oligonucleotide
ugggucugauggagccag

SEQ ID NO: 45244 - RNA, 18 nt, Artificial Sequence
  Description of Artificial Sequence: Synthetic oligonucleotide
ugcccugggucugaugga

SEQ ID NO: 45245 - RNA, 18 nt, Artificial Sequence
  Description of Artificial Sequence: Synthetic oligonucleotide
ccgauugcccugggucug

SEQ ID NO: 45246 - RNA, 18 nt, Artificial Sequence
  Description of Artificial Sequence: Synthetic oligonucleotide
uaccaccgauugcccugg

SEQ ID NO: 45247 - RNA, 18 nt, Artificial Sequence
  Description of Artificial Sequence: Synthetic oligonucleotide
uuuacuaccaccgauugc

SEQ ID NO: 45248 - RNA, 18 nt, Artificial Sequence
  Description of Artificial Sequence: Synthetic oligonucleotide
cucgguuuacuaccaccg

SEQ ID NO: 45249 - RNA, 18 nt, Artificial Sequence
  Description of Artificial Sequence: Synthetic oligonucleotide
cuacucucgguuuacuac

SEQ ID NO: 45250 - RNA, 18 nt, Artificial Sequence
  Description of Artificial Sequence: Synthetic oligonucleotide
agucgcuacucucgguuu

SEQ ID NO: 45251 - RNA, 18 nt, Artificial Sequence
  Description of Artificial Sequence: Synthetic oligonucleotide
ucuggagucgcuacucuc

SEQ ID NO: 45252 - RNA, 18 nt, Artificial Sequence
  Description of Artificial Sequence: Synthetic oligonucleotide
caacuucuggagucgcua

SEQ ID NO: 45253 - RNA, 18 nt, Artificial Sequence
  Description of Artificial Sequence: Synthetic oligonucleotide
gcuuacaacuucuggagu

SEQ ID NO: 45254 - RNA, 18 nt, Artificial Sequence
  Description of Artificial Sequence: Synthetic oligonucleotide
auuuugcuuacaacuucu

SEQ ID NO: 45255 - RNA, 18 nt, Artificial Sequence
  Description of Artificial Sequence: Synthetic oligonucleotide
gggcuauuuugcuuacaa

SEQ ID NO: 45256 - RNA, 18 nt, Artificial Sequence
  Description of Artificial Sequence: Synthetic oligonucleotide
auacugggcuauuuugcu

SEQ ID NO: 45257 - RNA, 18 nt, Artificial Sequence
  Description of Artificial Sequence: Synthetic oligonucleotide
cgcuuauacugggcuauu

SEQ ID NO: 45258 - RNA, 18 nt, Artificial Sequence
  Description of Artificial Sequence: Synthetic oligonucleotide
acucccgcuuauacuggg

SEQ ID NO: 45259 - RNA, 18 nt, Artificial Sequence
  Description of Artificial Sequence: Synthetic oligonucleotide
cgggcacucccgcuuaua

SEQ ID NO: 45260 - RNA, 18 nt, Artificial Sequence
  Description of Artificial Sequence: Synthetic oligonucleotide
auggacgggcacucccgc

SEQ ID NO: 45261 - RNA, 18 nt, Artificial Sequence
  Description of Artificial Sequence: Synthetic oligonucleotide
caaagauggacgggcacu

SEQ ID NO: 45262 - RNA, 18 nt, Artificial Sequence
  Description of Artificial Sequence: Synthetic oligonucleotide
ccaagcaaagauggacgg

SEQ ID NO: 45263 - RNA, 18 nt, Artificial Sequence
  Description of Artificial Sequence: Synthetic oligonucleotide
auuucccaagcaaagaug

SEQ ID NO: 45264 - RNA, 18 nt, Artificial Sequence
  Description of Artificial Sequence: Synthetic oligonucleotide
cucggauuucccaagcaa

SEQ ID NO: 45265 - RNA, 18 nt, Artificial Sequence
  Description of Artificial Sequence: Synthetic oligonucleotide
ucugucucggauuuccca

SEQ ID NO: 45266 - RNA, 18 nt, Artificial Sequence
  Description of Artificial Sequence: Synthetic oligonucleotide
aguaaucugucucggauu

SEQ ID NO: 45267 - RNA, 18 nt, Artificial Sequence
  Description of Artificial Sequence: Synthetic oligonucleotide
cggacaguaaucugucuc

SEQ ID NO: 45268 - RNA, 18 nt, Artificial Sequence
  Description of Artificial Sequence: Synthetic oligonucleotide
ccccucggacaguaaucu

SEQ ID NO: 45269 - RNA, 18 nt, Artificial Sequence
  Description of Artificial Sequence: Synthetic oligonucleotide
cagacccccucggacagu

SEQ ID NO: 45270 - RNA, 18 nt, Artificial Sequence
  Description of Artificial Sequence: Synthetic oligonucleotide
ugguacagacccccucgg

SEQ ID NO: 45271 - RNA, 18 nt, Artificial Sequence
  Description of Artificial Sequence: Synthetic oligonucleotide
aucguugguacagacccc

SEQ ID NO: 45272 - RNA, 18 nt, Artificial Sequence
  Description of Artificial Sequence: Synthetic oligonucleotide
auguuaucguugguacag

SEQ ID NO: 45273 - RNA, 18 nt, Artificial Sequence
  Description of Artificial Sequence: Synthetic oligonucleotide
uugguauguuaucguugg

SEQ ID NO: 45274 - RNA, 18 nt, Artificial Sequence
  Description of Artificial Sequence: Synthetic oligonucleotide
cacacauccguuggacac

SEQ ID NO: 45275 - RNA, 18 nt, Artificial Sequence
  Description of Artificial Sequence: Synthetic oligonucleotide
uuacucacacauccguug

SEQ ID NO: 45276 - RNA, 18 nt, Artificial Sequence
  Description of Artificial Sequence: Synthetic oligonucleotide
gaauuuuacucacacauc

SEQ ID NO: 45277 - RNA, 18 nt, Artificial Sequence
  Description of Artificial Sequence: Synthetic oligonucleotide
gcccagaauuuuacucac

SEQ ID NO: 45278 - RNA, 18 nt, Artificial Sequence
  Description of Artificial Sequence: Synthetic oligonucleotide
uaccugcccagaauuuua

SEQ ID NO: 45279 - RNA, 18 nt, Artificial Sequence
  Description of Artificial Sequence: Synthetic oligonucleotide
cguaauaccugcccagaa

SEQ ID NO: 45280 - RNA, 18 nt, Artificial Sequence
  Description of Artificial Sequence: Synthetic oligonucleotide
agucucguaauaccugcc

SEQ ID NO: 45281 - RNA, 18 nt, Artificial Sequence
  Description of Artificial Sequence: Synthetic oligonucleotide
gagccagucucguaauac

SEQ ID NO: 45282 - RNA, 18 nt, Artificial Sequence
  Description of Artificial Sequence: Synthetic oligonucleotide
ugauggagccagucucgu

SEQ ID NO: 45283 - RNA, 18 nt, Artificial Sequence
  Description of Artificial Sequence: Synthetic oligonucleotide
gggucugauggagccagu

SEQ ID NO: 45284 - RNA, 18 nt, Artificial Sequence
  Description of Artificial Sequence: Synthetic oligonucleotide
gcccugggucugauggag

SEQ ID NO: 45285 - RNA, 18 nt, Artificial Sequence
  Description of Artificial Sequence: Synthetic oligonucleotide
cgauugcccugggucuga

SEQ ID NO: 45286 - RNA, 18 nt, Artificial Sequence
  Description of Artificial Sequence: Synthetic oligonucleotide
accaccgauugcccuggg

SEQ ID NO: 45287 - RNA, 18 nt, Artificial Sequence
  Description of Artificial Sequence: Synthetic oligonucleotide
uuacuaccaccgauugcc

SEQ ID NO: 45288 - RNA, 18 nt, Artificial Sequence
  Description of Artificial Sequence: Synthetic oligonucleotide
ucgguuuacuaccaccga

SEQ ID NO: 45289 - RNA, 18 nt, Artificial Sequence
  Description of Artificial Sequence: Synthetic oligonucleotide
uacucucgguuuacuacc

SEQ ID NO: 45290 - RNA, 18 nt, Artificial Sequence
  Description of Artificial Sequence: Synthetic oligonucleotide
gucgcuacucucgguuua

SEQ ID NO: 45291 - RNA, 18 nt, Artificial Sequence
  Description of Artificial Sequence: Synthetic oligonucleotide
cuggagucgcuacucucg

SEQ ID NO: 45292 - RNA, 18 nt, Artificial Sequence
  Description of Artificial Sequence: Synthetic oligonucleotide
aacuucuggagucgcuac

SEQ ID NO: 45293 - RNA, 18 nt, Artificial Sequence
  Description of Artificial Sequence: Synthetic oligonucleotide
cuuacaacuucuggaguc

SEQ ID NO: 45294 - RNA, 18 nt, Artificial Sequence
  Description of Artificial Sequence: Synthetic oligonucleotide
uuuugcuuacaacuucug

SEQ ID NO: 45295 - RNA, 18 nt, Artificial Sequence
  Description of Artificial Sequence: Synthetic oligonucleotide
ggcuauuuugcuuacaac

SEQ ID NO: 45296 - RNA, 18 nt, Artificial Sequence
  Description of Artificial Sequence: Synthetic oligonucleotide
uacugggcuauuuugcuu

SEQ ID NO: 45297 - RNA, 18 nt, Artificial Sequence
  Description of Artificial Sequence: Synthetic oligonucleotide
gcuuauacugggcuauuu

SEQ ID NO: 45298 - RNA, 18 nt, Artificial Sequence
  Description of Artificial Sequence: Synthetic oligonucleotide
cucccgcuuauacugggc

SEQ ID NO: 45299 - RNA, 18 nt, Artificial Sequence
  Description of Artificial Sequence: Synthetic oligonucleotide
gggcacucccgcuuauac

SEQ ID NO: 45300 - RNA, 18 nt, Artificial Sequence
  Description of Artificial Sequence: Synthetic oligonucleotide
uggacgggcacucccgcu

SEQ ID NO: 45301 - RNA, 18 nt, Artificial Sequence
  Description of Artificial Sequence: Synthetic oligonucleotide
aaagauggacgggcacuc

SEQ ID NO: 45302 - RNA, 18 nt, Artificial Sequence
  Description of Artificial Sequence: Synthetic oligonucleotide
caagcaaagauggacggg

SEQ ID NO: 45303 - RNA, 18 nt, Artificial Sequence
  Description of Artificial Sequence: Synthetic oligonucleotide
uuucccaagcaaagaugg

SEQ ID NO: 45304 - RNA, 18 nt, Artificial Sequence
  Description of Artificial Sequence: Synthetic oligonucleotide
ucggauuucccaagcaaa

SEQ ID NO: 45305 - RNA, 18 nt, Artificial Sequence
  Description of Artificial Sequence: Synthetic oligonucleotide
cugucucggauuucccaa

SEQ ID NO: 45306 - RNA, 18 nt, Artificial Sequence
  Description of Artificial Sequence: Synthetic oligonucleotide
guaaucugucucggauuu

SEQ ID NO: 45307 - RNA, 18 nt, Artificial Sequence
  Description of Artificial Sequence: Synthetic oligonucleotide
ggacaguaaucugucucg

SEQ ID NO: 45308 - RNA, 18 nt, Artificial Sequence
  Description of Artificial Sequence: Synthetic oligonucleotide
cccucggacaguaaucug

SEQ ID NO: 45309 - RNA, 18 nt, Artificial Sequence
  Description of Artificial Sequence: Synthetic oligonucleotide
agacccccucggacagua

SEQ ID NO: 45310 - RNA, 18 nt, Artificial Sequence
  Description of Artificial Sequence: Synthetic oligonucleotide
gguacagacccccucgga

SEQ ID NO: 45311 - RNA, 18 nt, Artificial Sequence
  Description of Artificial Sequence: Synthetic oligonucleotide
ucguugguacagaccccc

SEQ ID NO: 45312 - RNA, 18 nt, Artificial Sequence
  Description of Artificial Sequence: Synthetic oligonucleotide
uguuaucguugguacaga

SEQ ID NO: 45313 - RNA, 18 nt, Artificial Sequence
  Description of Artificial Sequence: Synthetic oligonucleotide
ugguauguuaucguuggu

SEQ ID NO: 45314 - RNA, 18 nt, Artificial Sequence
  Description of Artificial Sequence: Synthetic oligonucleotide
gcagauguucucaaugaa

SEQ ID NO: 45315 - RNA, 18 nt, Artificial Sequence
  Description of Artificial Sequence: Synthetic oligonucleotide
ggagggcagauguucuca

SEQ ID NO: 45316 - RNA, 18 nt, Artificial Sequence
  Description of Artificial Sequence: Synthetic oligonucleotide
ggcagggagggcagaugu

SEQ ID NO: 45317 - RNA, 18 nt, Artificial Sequence
  Description of Artificial Sequence: Synthetic oligonucleotide
cuuagggcagggagggca

SEQ ID NO: 45318 - RNA, 18 nt, Artificial Sequence
  Description of Artificial Sequence: Synthetic oligonucleotide
uugggcuuagggcaggga

SEQ ID NO: 45319 - RNA, 18 nt, Artificial Sequence
  Description of Artificial Sequence: Synthetic oligonucleotide
gagcauugggcuuagggc

SEQ ID NO: 45320 - RNA, 18 nt, Artificial Sequence
  Description of Artificial Sequence: Synthetic oligonucleotide
ggagagagcauugggcuu

SEQ ID NO: 45321 - RNA, 18 nt, Artificial Sequence
  Description of Artificial Sequence: Synthetic oligonucleotide
aaagaggagagagcauug

SEQ ID NO: 45322 - RNA, 18 nt, Artificial Sequence
  Description of Artificial Sequence: Synthetic oligonucleotide
gagguaaagaggagagag

SEQ ID NO: 45323 - RNA, 18 nt, Artificial Sequence
  Description of Artificial Sequence: Synthetic oligonucleotide
gggaggagguaaagagga

SEQ ID NO: 45324 - RNA, 18 nt, Artificial Sequence
  Description of Artificial Sequence: Synthetic oligonucleotide
agggugggaggagguaaa

SEQ ID NO: 45325 - RNA, 18 nt, Artificial Sequence
  Description of Artificial Sequence: Synthetic oligonucleotide
gagagagggugggaggag

SEQ ID NO: 45326 - RNA, 18 nt, Artificial Sequence
  Description of Artificial Sequence: Synthetic oligonucleotide
guggagagagaggguggg

SEQ ID NO: 45327 - RNA, 18 nt, Artificial Sequence
  Description of Artificial Sequence: Synthetic oligonucleotide
agacaguggagagagagg

SEQ ID NO: 45328 - RNA, 18 nt, Artificial Sequence
  Description of Artificial Sequence: Synthetic oligonucleotide
cuaagagacaguggagag

SEQ ID NO: 45329 - RNA, 18 nt, Artificial Sequence
  Description of Artificial Sequence: Synthetic oligonucleotide
acagacuaagagacagug

SEQ ID NO: 45330 - RNA, 18 nt, Artificial Sequence
  Description of Artificial Sequence: Synthetic oligonucleotide
aggacacagacuaagaga

SEQ ID NO: 45331 - RNA, 18 nt, Artificial Sequence
  Description of Artificial Sequence: Synthetic oligonucleotide
gggagaggacacagacua

SEQ ID NO: 45332 - RNA, 18 nt, Artificial Sequence
  Description of Artificial Sequence: Synthetic oligonucleotide
gagcagggagaggacaca

SEQ ID NO: 45333 - RNA, 18 nt, Artificial Sequence
  Description of Artificial Sequence: Synthetic oligonucleotide
auguggagcagggagagg

SEQ ID NO: 45334 - RNA, 18 nt, Artificial Sequence
  Description of Artificial Sequence: Synthetic oligonucleotide
gacaaauguggagcaggg

SEQ ID NO: 45335 - RNA, 18 nt, Artificial Sequence
  Description of Artificial Sequence: Synthetic oligonucleotide
aaggagacaaauguggag

SEQ ID NO: 45336 - RNA, 18 nt, Artificial Sequence
  Description of Artificial Sequence: Synthetic oligonucleotide
guacaaaggagacaaaug

SEQ ID NO: 45337 - RNA, 18 nt, Artificial Sequence
  Description of Artificial Sequence: Synthetic oligonucleotide
cccagguacaaaggagac

SEQ ID NO: 45338 - RNA, 18 nt, Artificial Sequence
  Description of Artificial Sequence: Synthetic oligonucleotide
guucccccagguacaaag

SEQ ID NO: 45339 - RNA, 18 nt, Artificial Sequence
  Description of Artificial Sequence: Synthetic oligonucleotide
ucucuguucccccaggua

SEQ ID NO: 45340 - RNA, 18 nt, Artificial Sequence
  Description of Artificial Sequence: Synthetic oligonucleotide
auuccucucuguuccccc

SEQ ID NO: 45341 - RNA, 18 nt, Artificial Sequence
  Description of Artificial Sequence: Synthetic oligonucleotide
agggcauuccucucuguu

SEQ ID NO: 45342 - RNA, 18 nt, Artificial Sequence
  Description of Artificial Sequence: Synthetic oligonucleotide
aagucagggcauuccucu

SEQ ID NO: 45343 - RNA, 18 nt, Artificial Sequence
  Description of Artificial Sequence: Synthetic oligonucleotide
aagaaaagucagggcauu

SEQ ID NO: 45344 - RNA, 18 nt, Artificial Sequence
  Description of Artificial Sequence: Synthetic oligonucleotide
agucaaagaaaagucagg

SEQ ID NO: 45345 - RNA, 18 nt, Artificial Sequence
  Description of Artificial Sequence: Synthetic oligonucleotide
cagacagucaaagaaaag

SEQ ID NO: 45346 - RNA, 18 nt, Artificial Sequence
  Description of Artificial Sequence: Synthetic oligonucleotide
uuuuccagacagucaaag

SEQ ID NO: 45347 - RNA, 18 nt, Artificial Sequence
  Description of Artificial Sequence: Synthetic oligonucleotide
ucccauuuuccagacagu

SEQ ID NO: 45348 - RNA, 18 nt, Artificial Sequence
  Description of Artificial Sequence: Synthetic oligonucleotide
uugacucccauuuuccag

SEQ ID NO: 45349 - RNA, 18 nt, Artificial Sequence
  Description of Artificial Sequence: Synthetic oligonucleotide
cacacuugacucccauuu

SEQ ID NO: 45350 - RNA, 18 nt, Artificial Sequence
  Description of Artificial Sequence: Synthetic oligonucleotide
cuccccacacuugacucc

SEQ ID NO: 45351 - RNA, 18 nt, Artificial Sequence
  Description of Artificial Sequence: Synthetic oligonucleotide
aaugacuccccacacuug

SEQ ID NO: 45352 - RNA, 18 nt, Artificial Sequence
  Description of Artificial Sequence: Synthetic oligonucleotide
aagugaaugacuccccac

SEQ ID NO: 45353 - RNA, 18 nt, Artificial Sequence
  Description of Artificial Sequence: Synthetic oligonucleotide
aaaugaagugaaugacuc

SEQ ID NO: 45354 - RNA, 18 nt, Artificial Sequence
  Description of Artificial Sequence: Synthetic oligonucleotide
caugcaaaugaagugaau

SEQ ID NO: 45355 - RNA, 18 nt, Artificial Sequence
  Description of Artificial Sequence: Synthetic oligonucleotide
ugcagcaugcaaaugaag

SEQ ID NO: 45356 - RNA, 18 nt, Artificial Sequence
  Description of Artificial Sequence: Synthetic oligonucleotide
uguuuugcagcaugcaaa

SEQ ID NO: 45357 - RNA, 18 nt, Artificial Sequence
  Description of Artificial Sequence: Synthetic oligonucleotide
cccucuguuuugcagcau

SEQ ID NO: 45358 - RNA, 18 nt, Artificial Sequence
  Description of Artificial Sequence: Synthetic oligonucleotide
cuccgcccucuguuuugc

SEQ ID NO: 45359 - RNA, 18 nt, Artificial Sequence
  Description of Artificial Sequence: Synthetic oligonucleotide
ggugccuccgcccucugu

SEQ ID NO: 45360 - RNA, 18 nt, Artificial Sequence
  Description of Artificial Sequence: Synthetic oligonucleotide
ucccuggugccuccgccc

SEQ ID NO: 45361 - RNA, 18 nt, Artificial Sequence
  Description of Artificial Sequence: Synthetic oligonucleotide
gccuuucccuggugccuc

SEQ ID NO: 45362 - RNA, 18 nt, Artificial Sequence
  Description of Artificial Sequence: Synthetic oligonucleotide
caagugccuuucccuggu

SEQ ID NO: 45363 - RNA, 18 nt, Artificial Sequence
  Description of Artificial Sequence: Synthetic oligonucleotide
ucauucaagugccuuucc

SEQ ID NO: 45364 - RNA, 18 nt, Artificial Sequence
  Description of Artificial Sequence: Synthetic oligonucleotide
cuucuucauucaagugcc

SEQ ID NO: 45365 - RNA, 18 nt, Artificial Sequence
  Description of Artificial Sequence: Synthetic oligonucleotide
uuuuccuucuucauucaa

SEQ ID NO: 45366 - RNA, 18 nt, Artificial Sequence
  Description of Artificial Sequence: Synthetic oligonucleotide
ucucauuuuccuucuuca

SEQ ID NO: 45367 - RNA, 18 nt, Artificial Sequence
  Description of Artificial Sequence: Synthetic oligonucleotide
cugguucucauuuuccuu

SEQ ID NO: 45368 - RNA, 18 nt, Artificial Sequence
  Description of Artificial Sequence: Synthetic oligonucleotide
acaaucugguucucauuu

SEQ ID NO: 45369 - RNA, 18 nt, Artificial Sequence
  Description of Artificial Sequence: Synthetic oligonucleotide
aaguuacaaucugguucu

SEQ ID NO: 45370 - RNA, 18 nt, Artificial Sequence
  Description of Artificial Sequence: Synthetic oligonucleotide
ggacgaaguuacaaucug

SEQ ID NO: 45371 - RNA, 18 nt, Artificial Sequence
  Description of Artificial Sequence: Synthetic oligonucleotide
gauuaggacgaaguuaca

SEQ ID NO: 45372 - RNA, 18 nt, Artificial Sequence
  Description of Artificial Sequence: Synthetic oligonucleotide
agguggauuaggacgaag

SEQ ID NO: 45373 - RNA, 18 nt, Artificial Sequence
  Description of Artificial Sequence: Synthetic oligonucleotide
cuggcagguggauuagga

SEQ ID NO: 45374 - RNA, 18 nt, Artificial Sequence
  Description of Artificial Sequence: Synthetic oligonucleotide
aaguucuggcagguggau

SEQ ID NO: 45375 - RNA, 18 nt, Artificial Sequence
  Description of Artificial Sequence: Synthetic oligonucleotide
aaggaaaguucuggcagg

SEQ ID NO: 45376 - RNA, 18 nt, Artificial Sequence
  Description of Artificial Sequence: Synthetic oligonucleotide
accugaaggaaaguucug

SEQ ID NO: 45377 - RNA, 18 nt, Artificial Sequence
  Description of Artificial Sequence: Synthetic oligonucleotide
gugacaccugaaggaaag

SEQ ID NO: 45378 - RNA, 18 nt, Artificial Sequence
  Description of Artificial Sequence: Synthetic oligonucleotide
gaugugugacaccugaag

SEQ ID NO: 45379 - RNA, 18 nt, Artificial Sequence
  Description of Artificial Sequence: Synthetic oligonucleotide
aaauggaugugugacacc

SEQ ID NO: 45380 - RNA, 18 nt, Artificial Sequence
  Description of Artificial Sequence: Synthetic oligonucleotide
gauggaaauggaugugug

SEQ ID NO: 45381 - RNA, 18 nt, Artificial Sequence
  Description of Artificial Sequence: Synthetic oligonucleotide
auuaggauggaaauggau

SEQ ID NO: 45382 - RNA, 18 nt, Artificial Sequence
  Description of Artificial Sequence: Synthetic oligonucleotide
uuaauauuaggauggaaa

SEQ ID NO: 45383 - RNA, 18 nt, Artificial Sequence
  Description of Artificial Sequence: Synthetic oligonucleotide
auuguuuaauauuaggau

SEQ ID NO: 45384 - RNA, 18 nt, Artificial Sequence
  Description of Artificial Sequence: Synthetic oligonucleotide
auuauauuguuuaauauu

SEQ ID NO: 45385 - RNA, 18 nt, Artificial Sequence
  Description of Artificial Sequence: Synthetic oligonucleotide
cuuucauuauauuguuua

SEQ ID NO: 45386 - RNA, 18 nt, Artificial Sequence
  Description of Artificial Sequence: Synthetic oligonucleotide
gcuuucuuucauuauauu

SEQ ID NO: 45387 - RNA, 18 nt, Artificial Sequence
  Description of Artificial Sequence: Synthetic oligonucleotide
gaugugugacaccugaag

SEQ ID NO: 45388 - RNA, 18 nt, Artificial Sequence
  Description of Artificial Sequence: Synthetic oligonucleotide
aaauggaugugugacacc

SEQ ID NO: 45389 - RNA, 18 nt, Artificial Sequence
  Description of Artificial Sequence: Synthetic oligonucleotide
gauggaaauggaugugug

SEQ ID NO: 45390 - RNA, 18 nt, Artificial Sequence
  Description of Artificial Sequence: Synthetic oligonucleotide
auuaggauggaaauggau

SEQ ID NO: 45391 - RNA, 18 nt, Artificial Sequence
  Description of Artificial Sequence: Synthetic oligonucleotide
uuaauauuaggauggaaa

SEQ ID NO: 45392 - RNA, 18 nt, Artificial Sequence
  Description of Artificial Sequence: Synthetic oligonucleotide
auuguuuaauauuaggau

SEQ ID NO: 45393 - RNA, 18 nt, Artificial Sequence
  Description of Artificial Sequence: Synthetic oligonucleotide
auuauauuguuuaauauu

SEQ ID NO: 45394 - RNA, 18 nt, Artificial Sequence
  Description of Artificial Sequence: Synthetic oligonucleotide
cuuucauuauauuguuua

SEQ ID NO: 45395 - RNA, 18 nt, Artificial Sequence
  Description of Artificial Sequence: Synthetic oligonucleotide
gcuuucuuucauuauauu

SEQ ID NO: 45396 - RNA, 18 nt, Artificial Sequence
  Description of Artificial Sequence: Synthetic oligonucleotide
guaaagcuuucuuucauu

SEQ ID NO: 45397 - RNA, 18 nt, Artificial Sequence
  Description of Artificial Sequence: Synthetic oligonucleotide
uuguuguaaagcuuucuu

SEQ ID NO: 45398 - RNA, 18 nt, Artificial Sequence
  Description of Artificial Sequence: Synthetic oligonucleotide
uagacuuguuguaaagcu

SEQ ID NO: 45399 - RNA, 18 nt, Artificial Sequence
  Description of Artificial Sequence: Synthetic oligonucleotide
cuauuuagacuuguugua

SEQ ID NO: 45400 - RNA, 18 nt, Artificial Sequence
  Description of Artificial Sequence: Synthetic oligonucleotide
aaaaacuauuuagacuug

SEQ ID NO: 45401 - RNA, 18 nt, Artificial Sequence
  Description of Artificial Sequence: Synthetic oligonucleotide
aaaauaaaaacuauuuag

SEQ ID NO: 45402 - RNA, 18 nt, Artificial Sequence
  Description of Artificial Sequence: Synthetic oligonucleotide
gcccgaaaauaaaaacua

SEQ ID NO: 45403 - RNA, 18 nt, Artificial Sequence
  Description of Artificial Sequence: Synthetic oligonucleotide
agacugcccgaaaauaaa

SEQ ID NO: 45404 - RNA, 18 nt, Artificial Sequence
  Description of Artificial Sequence: Synthetic oligonucleotide
uuaaaagacugcccgaaa

SEQ ID NO: 45405 - RNA, 18 nt, Artificial Sequence
  Description of Artificial Sequence: Synthetic oligonucleotide
cuuuguuaaaagacugcc

SEQ ID NO: 45406 - RNA, 18 nt, Artificial Sequence
  Description of Artificial Sequence: Synthetic oligonucleotide
cuuugcuuuguuaaaaga

SEQ ID NO: 45407 - RNA, 18 nt, Artificial Sequence
  Description of Artificial Sequence: Synthetic oligonucleotide
gguugcuuugcuuuguua

SEQ ID NO: 45408 - RNA, 18 nt, Artificial Sequence
  Description of Artificial Sequence: Synthetic oligonucleotide
cacacgguugcuuugcuu

SEQ ID NO: 45409 - RNA, 18 nt, Artificial Sequence
  Description of Artificial Sequence: Synthetic oligonucleotide
uaacucacacgguugcuu

SEQ ID NO: 45410 - RNA, 18 nt, Artificial Sequence
  Description of Artificial Sequence: Synthetic oligonucleotide
ugaccuaacucacacggu

SEQ ID NO: 45411 - RNA, 18 nt, Artificial Sequence
  Description of Artificial Sequence: Synthetic oligonucleotide
ucuggugaccuaacucac

SEQ ID NO: 45412 - RNA, 18 nt, Artificial Sequence
  Description of Artificial Sequence: Synthetic oligonucleotide
gugucucuggugaccuaa

SEQ ID NO: 45413 - RNA, 18 nt, Artificial Sequence
  Description of Artificial Sequence: Synthetic oligonucleotide
gcuuggugucucugguga

SEQ ID NO: 45414 - RNA, 18 nt, Artificial Sequence
  Description of Artificial Sequence: Synthetic oligonucleotide
ccauugcuuggugucucu

SEQ ID NO: 45415 - RNA, 18 nt, Artificial Sequence
  Description of Artificial Sequence: Synthetic oligonucleotide
cuucaccauugcuuggug

SEQ ID NO: 45416 - RNA, 18 nt, Artificial Sequence
  Description of Artificial Sequence: Synthetic oligonucleotide
ggguccuucaccauugcu

SEQ ID NO: 45417 - RNA, 18 nt, Artificial Sequence
  Description of Artificial Sequence: Synthetic oligonucleotide
agagaauugggcggaggg

SEQ ID NO: 45418 - RNA, 18 nt, Artificial Sequence
  Description of Artificial Sequence: Synthetic oligonucleotide
ggauagagaauugggcgg

SEQ ID NO: 45419 - RNA, 18 nt, Artificial Sequence
  Description of Artificial Sequence: Synthetic oligonucleotide
uaguuggauagagaauug

SEQ ID NO: 45420 - RNA, 18 nt, Artificial Sequence
  Description of Artificial Sequence: Synthetic oligonucleotide
aaauuuaguuggauagag

SEQ ID NO: 45421 - RNA, 18 nt, Artificial Sequence
  Description of Artificial Sequence: Synthetic oligonucleotide
cauggaaauuuaguugga

SEQ ID NO: 45422 - RNA, 18 nt, Artificial Sequence
  Description of Artificial Sequence: Synthetic oligonucleotide
uugggcauggaaauuuag

SEQ ID NO: 45423 - RNA, 18 nt, Artificial Sequence
  Description of Artificial Sequence: Synthetic oligonucleotide
ucacuuugggcauggaaa

SEQ ID NO: 45424 - RNA, 18 nt, Artificial Sequence
  Description of Artificial Sequence: Synthetic oligonucleotide
agcuaucacuuugggcau

SEQ ID NO: 45425 - RNA, 18 nt, Artificial Sequence
  Description of Artificial Sequence: Synthetic oligonucleotide
augauagcuaucacuuug

SEQ ID NO: 45426 - RNA, 18 nt, Artificial Sequence
  Description of Artificial Sequence: Synthetic oligonucleotide
aaaaaaugauagcuauca

SEQ ID NO: 45427 - RNA, 18 nt, Artificial Sequence
  Description of Artificial Sequence: Synthetic oligonucleotide
cguggaaaaaaugauagc

SEQ ID NO: 45428 - RNA, 18 nt, Artificial Sequence
  Description of Artificial Sequence: Synthetic oligonucleotide
uacaccguggaaaaaaug

SEQ ID NO: 45429 - RNA, 18 nt, Artificial Sequence
  Description of Artificial Sequence: Synthetic oligonucleotide
gcagauacaccguggaaa

SEQ ID NO: 45430 - RNA, 18 nt, Artificial Sequence
  Description of Artificial Sequence: Synthetic oligonucleotide
gauuugcagauacaccgu

SEQ ID NO: 45431 - RNA, 18 nt, Artificial Sequence
  Description of Artificial Sequence: Synthetic oligonucleotide
ggguggauuugcagauac

SEQ ID NO: 45432 - RNA, 18 nt, Artificial Sequence
  Description of Artificial Sequence: Synthetic oligonucleotide
acaguggguggauuugca

SEQ ID NO: 45433 - RNA, 18 nt, Artificial Sequence
  Description of Artificial Sequence: Synthetic oligonucleotide
ccgggacaguggguggau

SEQ ID NO: 45434 - RNA, 18 nt, Artificial Sequence
  Description of Artificial Sequence: Synthetic oligonucleotide
ccaccccgggacaguggg

SEQ ID NO: 45435 - RNA, 18 nt, Artificial Sequence
  Description of Artificial Sequence: Synthetic oligonucleotide
cccagccaccccgggaca

SEQ ID NO: 45436 - RNA, 18 nt, Artificial Sequence
  Description of Artificial Sequence: Synthetic oligonucleotide
aagcucccagccaccccg

SEQ ID NO: 45437 - RNA, 18 nt, Artificial Sequence
  Description of Artificial Sequence: Synthetic oligonucleotide
uuaaaaagcucccagcca

SEQ ID NO: 45438 - RNA, 18 nt, Artificial Sequence
  Description of Artificial Sequence: Synthetic oligonucleotide
acccguuaaaaagcuccc

SEQ ID NO: 45439 - RNA, 18 nt, Artificial Sequence
  Description of Artificial Sequence: Synthetic oligonucleotide
ucucaacccguuaaaaag

SEQ ID NO: 45440 - RNA, 18 nt, Artificial Sequence
  Description of Artificial Sequence: Synthetic oligonucleotide
gcaacucucaacccguua

SEQ ID NO: 45441 - RNA, 18 nt, Artificial Sequence
  Description of Artificial Sequence: Synthetic oligonucleotide
aaaaagcaacucucaacc

SEQ ID NO: 45442 - RNA, 18 nt, Artificial Sequence
  Description of Artificial Sequence: Synthetic oligonucleotide
accuuaaaaagcaacucu

SEQ ID NO: 45443 - RNA, 18 nt, Artificial Sequence
  Description of Artificial Sequence: Synthetic oligonucleotide
ccacaaccuuaaaaagca

SEQ ID NO: 45444 - RNA, 18 nt, Artificial Sequence
  Description of Artificial Sequence: Synthetic oligonucleotide
cucacccacaaccuuaaa

SEQ ID NO: 45445 - RNA, 18 nt, Artificial Sequence
  Description of Artificial Sequence: Synthetic oligonucleotide
cucagcucacccacaacc

SEQ ID NO: 45446 - RNA, 18 nt, Artificial Sequence
  Description of Artificial Sequence: Synthetic oligonucleotide
cccaucucagcucaccca

SEQ ID NO: 45447 - RNA, 18 nt, Artificial Sequence
  Description of Artificial Sequence: Synthetic oligonucleotide
agucacccaucucagcuc

SEQ ID NO: 45448 - RNA, 18 nt, Artificial Sequence
  Description of Artificial Sequence: Synthetic oligonucleotide
gacacagucacccaucuc

SEQ ID NO: 45449 - RNA, 18 nt, Artificial Sequence
  Description of Artificial Sequence: Synthetic oligonucleotide
cugaagacacagucaccc

SEQ ID NO: 45450 - RNA, 18 nt, Artificial Sequence
  Description of Artificial Sequence: Synthetic oligonucleotide
gucuccugaagacacagu

SEQ ID NO: 45451 - RNA, 18 nt, Artificial Sequence
  Description of Artificial Sequence: Synthetic oligonucleotide
guagugucuccugaagac

SEQ ID NO: 45452 - RNA, 18 nt, Artificial Sequence
  Description of Artificial Sequence: Synthetic oligonucleotide
aaaugguagugucuccug

SEQ ID NO: 45453 - RNA, 18 nt, Artificial Sequence
  Description of Artificial Sequence: Synthetic oligonucleotide
aaaccaaaugguaguguc

SEQ ID NO: 45454 - RNA, 18 nt, Artificial Sequence
  Description of Artificial Sequence: Synthetic oligonucleotide
aaaucaaaccaaauggua

SEQ ID NO: 45455 - RNA, 18 nt, Artificial Sequence
  Description of Artificial Sequence: Synthetic oligonucleotide
cucuguuuauugaugaca

SEQ ID NO: 45456 - RNA, 18 nt, Artificial Sequence
  Description of Artificial Sequence: Synthetic oligonucleotide
aagaacucuguuuauuga

SEQ ID NO: 45457 - RNA, 18 nt, Artificial Sequence
  Description of Artificial Sequence: Synthetic oligonucleotide
uugcgaagaacucuguuu

SEQ ID NO: 45458 - RNA, 18 nt, Artificial Sequence
  Description of Artificial Sequence: Synthetic oligonucleotide
ccagguugcgaagaacuc

SEQ ID NO: 45459 - RNA, 18 nt, Artificial Sequence
  Description of Artificial Sequence: Synthetic oligonucleotide
gcuagccagguugcgaag

SEQ ID NO: 45460 - RNA, 18 nt, Artificial Sequence
  Description of Artificial Sequence: Synthetic oligonucleotide
uuuucgcuagccagguug

SEQ ID NO: 45461 - RNA, 18 nt, Artificial Sequence
  Description of Artificial Sequence: Synthetic oligonucleotide
guugcuuuucgcuagcca

SEQ ID NO: 45462 - RNA, 18 nt, Artificial Sequence
  Description of Artificial Sequence: Synthetic oligonucleotide
caucuguugcuuuucgcu

SEQ ID NO: 45463 - RNA, 18 nt, Artificial Sequence
  Description of Artificial Sequence: Synthetic oligonucleotide
gcgcccaucuguugcuuu

SEQ ID NO: 45464 - RNA, 18 nt, Artificial Sequence
  Description of Artificial Sequence: Synthetic oligonucleotide
cgucugcgcccaucuguu

SEQ ID NO: 45465 - RNA, 18 nt, Artificial Sequence
  Description of Artificial Sequence: Synthetic oligonucleotide
caugccgucugcgcccau

SEQ ID NO: 45466 - RNA, 18 nt, Artificial Sequence
  Description of Artificial Sequence: Synthetic oligonucleotide
ucauacaugccgucugcg

SEQ ID NO: 45467 - RNA, 18 nt, Artificial Sequence
  Description of Artificial Sequence: Synthetic oligonucleotide
guuuaucauacaugccgu

SEQ ID NO: 45468 - RNA, 18 nt, Artificial Sequence
  Description of Artificial Sequence: Synthetic oligonucleotide
ccuuaguuuaucauacau

SEQ ID NO: 45469 - RNA, 18 nt, Artificial Sequence
  Description of Artificial Sequence: Synthetic oligonucleotide
aacauccuuaguuuauca

SEQ ID NO: 45470 - RNA, 18 nt, Artificial Sequence
  Description of Artificial Sequence: Synthetic oligonucleotide
cguucaacauccuuaguu

SEQ ID NO: 45471 - RNA, 18 nt, Artificial Sequence
  Description of Artificial Sequence: Synthetic oligonucleotide
cugcccguucaacauccu

SEQ ID NO: 45472 - RNA, 18 nt, Artificial Sequence
  Description of Artificial Sequence: Synthetic oligonucleotide
ccggucugcccguucaac

SEQ ID NO: 45473 - RNA, 18 nt, Artificial Sequence
  Description of Artificial Sequence: Synthetic oligonucleotide
agcuuccggucugcccgu

SEQ ID NO: 45474 - RNA, 18 nt, Artificial Sequence
  Description of Artificial Sequence: Synthetic oligonucleotide
gccccagcuuccggucug

SEQ ID NO: 45475 - RNA, 18 nt, Artificial Sequence
  Description of Artificial Sequence: Synthetic oligonucleotide
cgggugccccagcuuccg

SEQ ID NO: 45476 - RNA, 18 nt, Artificial Sequence
  Description of Artificial Sequence: Synthetic oligonucleotide
cagggcgggugccccagc

SEQ ID NO: 45477 - RNA, 18 nt, Artificial Sequence
  Description of Artificial Sequence: Synthetic oligonucleotide
ccaaccagggcgggugcc

SEQ ID NO: 45478 - RNA, 18 nt, Artificial Sequence
  Description of Artificial Sequence: Synthetic oligonucleotide
ggauaccaaccagggcgg

SEQ ID NO: 45479 - RNA, 18 nt, Artificial Sequence
  Description of Artificial Sequence: Synthetic oligonucleotide
uccccggauaccaaccag

SEQ ID NO: 45480 - RNA, 18 nt, Artificial Sequence
  Description of Artificial Sequence: Synthetic oligonucleotide
cgaaguccccggauacca

SEQ ID NO: 45481 - RNA, 18 nt, Artificial Sequence
  Description of Artificial Sequence: Synthetic oligonucleotide
ggcaccgaaguccccgga

SEQ ID NO: 45482 - RNA, 18 nt, Artificial Sequence
  Description of Artificial Sequence: Synthetic oligonucleotide
gcccuggcaccgaagucc

SEQ ID NO: 45483 - RNA, 18 nt, Artificial Sequence
  Description of Artificial Sequence: Synthetic oligonucleotide
agguugcccuggcaccga

SEQ ID NO: 45484 - RNA, 18 nt, Artificial Sequence
  Description of Artificial Sequence: Synthetic oligonucleotide
ugcguagguugcccuggc

SEQ ID NO: 45485 - RNA, 18 nt, Artificial Sequence
  Description of Artificial Sequence: Synthetic oligonucleotide
gccgcgggauuccacggg

SEQ ID NO: 45486 - RNA, 18 nt, Artificial Sequence
  Description of Artificial Sequence: Synthetic oligonucleotide
augcuggcucuggcuggg

SEQ ID NO: 45487 - RNA, 18 nt, Artificial Sequence
  Description of Artificial Sequence: Synthetic oligonucleotide
ucugcaugcuggcucugg

SEQ ID NO: 45488 - RNA, 18 nt, Artificial Sequence
  Description of Artificial Sequence: Synthetic oligonucleotide
ccagaaagaccagaggca

SEQ ID NO: 45489 - RNA, 18 nt, Artificial Sequence
  Description of Artificial Sequence: Synthetic oligonucleotide
aagucccagaaagaccag

SEQ ID NO: 45490 - RNA, 18 nt, Artificial Sequence
  Description of Artificial Sequence: Synthetic oligonucleotide
gcccgaagucccagaaag

SEQ ID NO: 45491 - RNA, 18 nt, Artificial Sequence
  Description of Artificial Sequence: Synthetic oligonucleotide
cccgagcccgaaguccca

SEQ ID NO: 45492 - RNA, 18 nt, Artificial Sequence
  Description of Artificial Sequence: Synthetic oligonucleotide
cgcaccccgagcccgaag

SEQ ID NO: 45493 - RNA, 18 nt, Artificial Sequence
  Description of Artificial Sequence: Synthetic oligonucleotide
guccgcgcaccccgagcc

SEQ ID NO: 45494 - RNA, 18 nt, Artificial Sequence
  Description of Artificial Sequence: Synthetic oligonucleotide
cucggguccgcgcacccc

SEQ ID NO: 45495 - RNA, 18 nt, Artificial Sequence
  Description of Artificial Sequence: Synthetic oligonucleotide
ugacccucggguccgcgc

SEQ ID NO: 45496 - RNA, 18 nt, Artificial Sequence
  Description of Artificial Sequence: Synthetic oligonucleotide
uccccugacccucggguc

SEQ ID NO: 45497 - RNA, 18 nt, Artificial Sequence
  Description of Artificial Sequence: Synthetic oligonucleotide
uguccuccccugacccuc

SEQ ID NO: 45498 - RNA, 18 nt, Artificial Sequence
  Description of Artificial Sequence: Synthetic oligonucleotide
cccuguguccuccccuga

SEQ ID NO: 45499 - RNA, 18 nt, Artificial Sequence
  Description of Artificial Sequence: Synthetic oligonucleotide
cgagucccuguguccucc

SEQ ID NO: 45500 - RNA, 18 nt, Artificial Sequence
  Description of Artificial Sequence: Synthetic oligonucleotide
cgucgcgagucccugugu

SEQ ID NO: 45501 - RNA, 18 nt, Artificial Sequence
  Description of Artificial Sequence: Synthetic oligonucleotide
gcgggcgucgcgaguccc

SEQ ID NO: 45502 - RNA, 18 nt, Artificial Sequence
  Description of Artificial Sequence: Synthetic oligonucleotide
ccagcgcgggcgucgcga

SEQ ID NO: 45503 - RNA, 18 nt, Artificial Sequence
  Description of Artificial Sequence: Synthetic oligonucleotide
ccgggccagcgcgggcgu

SEQ ID NO: 45504 - RNA, 18 nt, Artificial Sequence
  Description of Artificial Sequence: Synthetic oligonucleotide
ggcggccgggccagcgcg

SEQ ID NO: 45505 - RNA, 18 nt, Artificial Sequence
  Description of Artificial Sequence: Synthetic oligonucleotide
cggucggcggccgggcca

SEQ ID NO: 45506 - RNA, 18 nt, Artificial Sequence
  Description of Artificial Sequence: Synthetic oligonucleotide
ucagucggucggcggccg

SEQ ID NO: 45507 - RNA, 18 nt, Artificial Sequence
  Description of Artificial Sequence: Synthetic oligonucleotide
gggccucagucggucggc

SEQ ID NO: 45508 - RNA, 18 nt, Artificial Sequence
  Description of Artificial Sequence: Synthetic oligonucleotide
uccccgggccucagucgg

SEQ ID NO: 45509 - RNA, 18 nt, Artificial Sequence
  Description of Artificial Sequence: Synthetic oligonucleotide
gcagguccccgggccuca

SEQ ID NO: 45510 - RNA, 18 nt, Artificial Sequence
  Description of Artificial Sequence: Synthetic oligonucleotide
ccgccgcagguccccggg

SEQ ID NO: 45511 - RNA, 18 nt, Artificial Sequence
  Description of Artificial Sequence: Synthetic oligonucleotide
agcagccgccgcaggucc

SEQ ID NO: 45512 - RNA, 18 nt, Artificial Sequence
  Description of Artificial Sequence: Synthetic oligonucleotide
gggagcagccgccgcagg

SEQ ID NO: 45513 - RNA, 18 nt, Artificial Sequence
  Description of Artificial Sequence: Synthetic oligonucleotide
ugccgggcgcggagcggg

SEQ ID NO: 45514 - RNA, 18 nt, Artificial Sequence
  Description of Artificial Sequence: Synthetic oligonucleotide
cgggcugccgggcgcgga

SEQ ID NO: 45515 - RNA, 18 nt, Artificial Sequence
  Description of Artificial Sequence: Synthetic oligonucleotide
ccucccgggcugccgggc

SEQ ID NO: 45516 - RNA, 18 nt, Artificial Sequence
  Description of Artificial Sequence: Synthetic oligonucleotide
ccuccccucccgggcugc

SEQ ID NO: 45517 - RNA, 18 nt, Artificial Sequence
  Description of Artificial Sequence: Synthetic oligonucleotide
aacgcccuccccucccgg
